US009920329B2

(12) United States Patent
Pankratov et al.

(10) Patent No.: US 9,920,329 B2
(45) Date of Patent: Mar. 20, 2018

(54) ISOLATED POLYNUCLEOTIDES AND POLYPEPTIDES, AND METHODS OF USING SAME FOR INCREASING PLANT YIELD AND/OR AGRICULTURAL CHARACTERISTICS

(71) Applicant: Evogene Ltd., Rehovot (IL)

(72) Inventors: Ilya Pankratov, Rehovot (IL); Hagai Karchi, Moshav Sitriya (IL)

(73) Assignee: Evogene Ltd., Rehovot (IL)

( * ) Notice: Subject to any disclaimer, the term of this patent is extended or adjusted under 35 U.S.C. 154(b) by 49 days.

(21) Appl. No.: 14/787,037

(22) PCT Filed: May 21, 2014

(86) PCT No.: PCT/IL2014/050454
§ 371 (c)(1),
(2) Date: Oct. 26, 2015

(87) PCT Pub. No.: WO2014/188428
PCT Pub. Date: Nov. 27, 2014

(65) Prior Publication Data
US 2016/0186197 A1 Jun. 30, 2016

Related U.S. Application Data

(60) Provisional application No. 61/870,380, filed on Aug. 27, 2013, provisional application No. 61/893,391, filed on Oct. 21, 2013, provisional application No. 61/826,066, filed on May 22, 2013.

(51) Int. Cl.
*A01H 5/00* (2006.01)
*C12N 15/82* (2006.01)
*C07K 14/415* (2006.01)

(52) U.S. Cl.
CPC ........ *C12N 15/8269* (2013.01); *C07K 14/415* (2013.01); *C12N 15/8209* (2013.01); *C12N 15/8243* (2013.01); *C12N 15/8247* (2013.01); *C12N 15/8261* (2013.01); *C12N 15/8262* (2013.01); *C12N 15/8271* (2013.01); *C12N 15/8273* (2013.01)

(58) Field of Classification Search
None
See application file for complete search history.

(56) References Cited

U.S. PATENT DOCUMENTS

| | | | |
|---|---|---|---|
| 6,084,153 A | 7/2000 | Good et al. | |
| 7,012,171 B2 * | 3/2006 | Burrell ............... | C12N 15/8245 435/101 |
| 2002/0046419 A1 | 4/2002 | Choo et al. | |
| 2005/0108791 A1 | 5/2005 | Edgerton | |
| 2006/0179511 A1 | 8/2006 | Chomet et al. | |
| 2007/0039067 A1 | 2/2007 | Feldmann et al. | |
| 2011/0214205 A1 | 9/2011 | Dietrich et al. | |

FOREIGN PATENT DOCUMENTS

| | | |
|---|---|---|
| WO | WO 2004/081173 | 9/2004 |
| WO | WO 2004/104162 | 12/2004 |
| WO | WO 2004/111183 | 12/2004 |
| WO | WO 2005/121364 | 12/2005 |
| WO | WO 2007/020638 | 2/2007 |
| WO | WO 2007/049275 | 5/2007 |
| WO | WO 2008/075364 | 6/2008 |
| WO | WO 2008/122980 | 10/2008 |
| WO | WO 2009/013750 | 1/2009 |
| WO | WO 2009/083958 | 7/2009 |
| WO | WO 2009/141824 | 11/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |

(Continued)

OTHER PUBLICATIONS

NCBI "Predicted: Novel Plant Snare 13-Like [Setaria Italica]", Database NCBI [Online], NCBI Reference Sequence: XP_004958461.1, Database GenBank Accession No. XP_004958461, Jun. 26, 2013.*
Keskin et al. (Protein Science, 13:1043-1055, 2004).*
Thornton et al. (Nature structural Biology, structural genomics supplement, Nov. 2000).*
Guo et al. (PNAS, 101: 9205-9210, 2004).*
Wells, (Biochemistry 29:8509-8517, 1990).*
Ngo et al., (The Protein Folding Problem and Tertiary Structure Prediction, K. Merz., and S. Le Grand (eds.) pp. 492-495,1994).*
Paterson et al. (Genbank Sequence Accession No. CM000768.1; Published Jun. 24, 2009).*
International Preliminary Report on Patentability dated Dec. 3, 2015 From the International Bureau of WIPO Re. Application No. PCT/IL2014/050454.
International Search Report and the Written Opinion dated Aug. 19, 2014 From the International Searching Authority Re. Application No. PCT/IL2014/050454.
Invitation to Pay Additional Fees dated Jul. 10, 2014 From the International Searching Authority Re. Application No. PCT/IL2014/050454.
Bao et al. "Cloning and Characterization of Three Genes Encoding Qb-Snare Proteins in Rice", Molecular Genetics and Genomics, 279(3): 291-301, Jan. 16, 2008.
Bao et al. "Snare 13 [Oryza Sativa Japonica Group]", Database NCBI [Online], Database GenBank No. AAU94637.1, Database Accession No. AAU94637, Feb. 25, 2008.

(Continued)

Primary Examiner — Vinod Kumar

(57) ABSTRACT

Provided are isolated polypeptides which are at least 80% homologous to SEQ ID NO: 474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 or 8164, isolated polynucleotides which are at least 80% identical to SEQ ID NOs: 1-170, 172-267, 269-424, 426-473, 761-2486, 2489-2494, 2496-4803 or 4804, nucleic acid constructs comprising same, transgenic cells expressing same, transgenic plants expressing same and method of using same for increasing yield, harvest index, abiotic stress tolerance, growth rate, biomass, vigor, oil content, photosynthetic capacity, seed yield, fiber yield, fiber quality, fiber length, and/or nitrogen use efficiency of a plant.

10 Claims, 10 Drawing Sheets

(56) References Cited

FOREIGN PATENT DOCUMENTS

| WO | WO 2013/027223 | 2/2013 |
| WO | WO 2013/078153 | 5/2013 |
| WO | WO 2013/080203 | 6/2013 |
| WO | WO 2013/098819 | 7/2013 |
| WO | WO 2013/128448 | 9/2013 |
| WO | WO 2013/179211 | 12/2013 |
| WO | WO 2014/033714 | 3/2014 |
| WO | WO 2014/102773 | 7/2014 |
| WO | WO 2014/102774 | 7/2014 |
| WO | WO 2014/188428 | 11/2014 |
| WO | WO 2015/029031 | 3/2015 |
| WO | WO 2015/181823 | 12/2015 |
| WO | WO 2016/030885 | 3/2016 |

OTHER PUBLICATIONS

NCBI "Predicted: Novel Plant Snare 13-Like [Setaria Railca]", Database NCBI [Online], NCBI Reference Sequence: XP_004958461.1, Database GenBank Accession No. XP_004958461, Jun. 26, 2013.

Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.

Examination Report dated Jul. 7, 2017 From the Instituto Mexicano de la Propiedad Industrial Re. Application No. 2015/015836 and Its Translation Into English. (6 Pages).

* cited by examiner pQFN, pQFNc

Normal conditions

Osmotic stress (15% PEG)

Nitrogen limiting conditions pQNa_RP

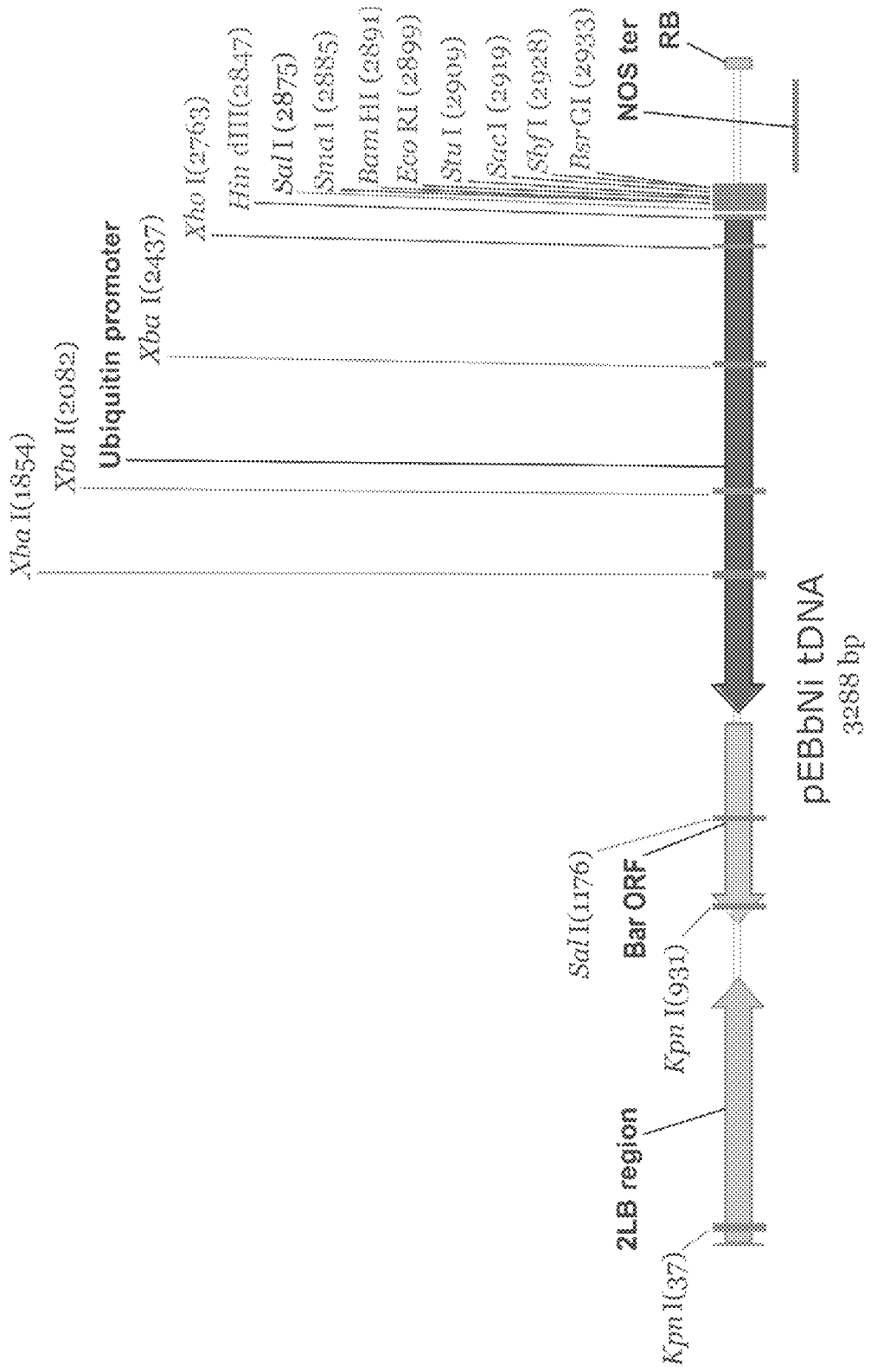

ISOLATED POLYNUCLEOTIDES AND POLYPEPTIDES, AND METHODS OF USING SAME FOR INCREASING PLANT YIELD AND/OR AGRICULTURAL CHARACTERISTICS

RELATED APPLICATIONS

This application is a National Phase of PCT Patent Application No. PCT/IL2014/050454 having International filing date of May 21, 2014, which claims the benefit of priority under 35 USC § 119(e) of U.S. Provisional Patent Applications Nos. 61/893,391 filed on Oct. 21, 2013, 61/870,380 filed on Aug. 27, 2013, and 61/826,066 filed on May 22, 2013. The contents of the above applications are all incorporated by reference as if fully set forth herein in their entirety.

SEQUENCE LISTING STATEMENT

The ASCII file, entitled 63922SequenceListing.txt, created on Oct. 26, 2015, comprising 19,184,365 bytes, submitted concurrently with the filing of this application is incorporated herein by reference.

FIELD AND BACKGROUND OF THE INVENTION

The present invention, in some embodiments thereof, relates to isolated polypeptides and polynucleotides, nucleic acid constructs comprising same, transgenic cells comprising same, transgenic plants transformed with said nucleic acid constructs and transgenic plants exogenously expressing same and more particularly, but not exclusively, to methods of using same for increasing yield (e.g., seed yield, oil yield, harvest index), biomass, photosynthetic capacity (e.g., leaf area), growth rate, vigor, oil content, fiber yield, fiber quality, fertilizer use efficiency (e.g., nitrogen use efficiency) and/or abiotic stress tolerance of a plant.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, proteins and oils and metabolites used in industrial processes. The ability to increase plant yield, whether through increase dry matter accumulation rate, modifying cellulose or lignin composition, increase stalk strength, enlarge meristem size, change of plant branching pattern, erectness of leaves, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

Vegetable or seed oils are the major source of energy and nutrition in human and animal diet. They are also used for the production of industrial products, such as paints, inks and lubricants. In addition, plant oils represent renewable sources of long-chain hydrocarbons, which can be used as fuel. Since the currently used fossil fuels are finite resources and are gradually being depleted, fast growing biomass crops may be used as alternative fuels or for energy feedstock and may reduce the dependence on fossil energy supplies. However, the major bottleneck for increasing consumption of plant oils as bio-fuel is the oil price, which is still higher than fossil fuel. In addition, the production rate of plant oil is limited by the availability of agricultural land and water. Thus, increasing plant oil yields from the same growing area can effectively overcome the shortage in production space and can decrease vegetable oil prices at the same time.

Studies aiming at increasing plant oil yields focus on the identification of genes involved in oil metabolism as well as in genes capable of increasing plant and seed yields in transgenic plants. Genes known to be involved in increasing plant oil yields include those participating in fatty acid synthesis or sequestering such as desaturase [e.g., DELTA6, DELTA12 or acyl-ACP (Ssi2; Arabidopsis Information Resource (TAIR; arabidopsis(dot)org/), TAIR No. AT2G43710)], OleosinA (TAIR No. AT3G01570) or FAD3 (TAR No. AT2G29980), and various transcription factors and activators such as Lec1 [TAIR No. AT1G21970, Lotan et al. 1998. Cell. 26; 93(7):1195-205], Lec2 [TAIR No. AT1G28300, Santos Mendoza et al. 2005, FEBS Lett. 579 (21):4666-70], Fus3 (TAIR No. AT3G26790), ABI3 [TAIR No. AT3G24650, Lara et al. 2003. J Biol Chem. 278(23): 21003-11] and Writ [TAIR No. AT3G54320, Cernac and Benning, 2004. Plant J. 40(4): 575-85].

Genetic engineering efforts aiming at increasing oil content in plants (e.g., in seeds) include upregulating endoplasmic reticulum (FAD3) and plastidal (FAD7) fatty acid desaturases in potato (Zabrouskov V., et al., 2002; Physiol Plant. 116:172-185); over-expressing the GmDof4 and GmDof11 transcription factors (Wang H W et al., 2007; Plant J. 52:716-29); over-expressing a yeast glycerol-3-phosphate dehydrogenase under the control of a seed-specific promoter (Vigeolas H, et al. 2007, Plant Biotechnol J. 5:431-41; U.S. Pat. Appl. No. 20060168684); using Arabidopsis FAE1 and yeast SLC1-1 genes for improvements in erucic acid and oil content in rapeseed (Katavic V, et al., 2000, Biochem Soc Trans. 28:935-7).

Various patent applications disclose genes and proteins, which can increase oil content in plants. These include for example, U.S. Pat. Appl. No. 20080076179 (lipid metabolism protein); U.S. Pat. Appl. No. 20060206961 (the Ypr140w polypeptide); U.S. Pat. Appl. No. 20060174373 [triacylglycerols synthesis enhancing protein (TEP)]; U.S. Pat. Appl. Nos. 20070169219, 20070006345, 20070006346 and 20060195943 (disclose transgenic plants with improved nitrogen use efficiency which can be used for the conversion into fuel or chemical feedstocks); WO2008/122980 (polynucleotides for increasing oil content, growth rate, biomass, yield and/or vigor of a plant).

A common approach to promote plant growth has been, and continues to be, the use of natural as well as synthetic nutrients (fertilizers). Thus, fertilizers are the fuel behind the "green revolution", directly responsible for the exceptional increase in crop yields during the last 40 years, and are considered the number one overhead expense in agriculture. For example, inorganic nitrogenous fertilizers such as ammonium nitrate, potassium nitrate, or urea, typically accounts for 40% of the costs associated with crops such as corn and wheat. Of the three macronutrients provided as main fertilizers [Nitrogen (N), Phosphate (P) and Potassium (K)], nitrogen is often the rate-limiting element in plant growth and all field crops have a fundamental dependence on inorganic nitrogenous fertilizer. Nitrogen is responsible for biosynthesis of amino and nucleic acids, prosthetic groups, plant hormones, plant chemical defenses, etc. and usually needs to be replenished every year, particularly for cereals, which comprise more than half of the cultivated areas worldwide. Thus, nitrogen is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant nitrogen. The stored nitrogen can be then redistributed from the leaves and stalk that served as storage compartments until grain formation.

Since fertilizer is rapidly depleted from most soil types, it must be supplied to growing crops two or three times during the growing season. In addition, the low nitrogen use efficiency (NUE) of the main crops (e.g., in the range of only 30-70%) negatively affects the input expenses for the farmer, due to the excess fertilizer applied. Moreover, the over and inefficient use of fertilizers are major factors responsible for environmental problems such as eutrophication of groundwater, lakes, rivers and seas, nitrate pollution in drinking water which can cause methemoglobinemia, phosphate pollution, atmospheric pollution and the like. However, in spite of the negative impact of fertilizers on the environment, and the limits on fertilizer use, which have been legislated in several countries, the use of fertilizers is expected to increase in order to support food and fiber production for rapid population growth on limited land resources. For example, it has been estimated that by 2050, more than 150 million tons of nitrogenous fertilizer will be used worldwide annually.

Increased use efficiency of nitrogen by plants should enable crops to be cultivated with lower fertilizer input, or alternatively to be cultivated on soils of poorer quality and would therefore have significant economic impact in both developed and developing agricultural systems.

Genetic improvement of fertilizer use efficiency (FUE) in plants can be generated either via traditional breeding or via genetic engineering.

Attempts to generate plants with increased FUE have been described in U.S. Pat. Appl. No. 20020046419 to Choo, et al.; U.S. Pat. Appl. No. 20050108791 to Edgerton et al.; U.S. Pat. Appl. No. 20060179511 to Chomet et al.; Good, A, et al. 2007 (Engineering nitrogen use efficiency with alanine aminotransferase. Canadian Journal of Botany 85: 252-262); and Good A G et al. 2004 (Trends Plant Sci. 9:597-605).

Yanagisawa et al. (Proc. Natl. Acad. Sci. U.S.A. 2004 101:7833-8) describe Dof1 transgenic plants, which exhibit improved growth under low-nitrogen conditions.

U.S. Pat. No. 6,084,153 to Good et al. discloses the use of a stress responsive promoter to control the expression of Alanine Amine Transferase (AlaAT) and transgenic canola plants with improved drought and nitrogen deficiency tolerance when compared to control plants.

Abiotic stress (ABS; also referred to as "environmental stress") conditions such as salinity, drought, flood, suboptimal temperature and toxic chemical pollution, cause substantial damage to agricultural plants. Most plants have evolved strategies to protect themselves against these conditions. However, if the severity and duration of the stress conditions are too great, the effects on plant development, growth and yield of most crop plants are profound. Furthermore, most of the crop plants are highly susceptible to abiotic stress and thus necessitate optimal growth conditions for commercial crop yields. Continuous exposure to stress causes major alterations in the plant metabolism, which ultimately leads to cell death and consequently yield losses.

Drought is a gradual phenomenon, which involves periods of abnormally dry weather that persists long enough to produce serious hydrologic imbalances such as crop damage, water supply shortage and increased susceptibility to various diseases. In severe cases, drought can last many years and results in devastating effects on agriculture and water supplies. Furthermore, drought is associated with increase susceptibility to various diseases.

For most crop plants, the land regions of the world are too arid. In addition, overuse of available water results in increased loss of agriculturally usable land (desertification), and increase of salt accumulation in soils adds to the loss of available water in soils.

Salinity, high salt levels, affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Soil salinity is thus one of the more important variables that determine whether a plant may thrive. In many parts of the world, sizable land areas are uncultivable due to naturally high soil salinity. Thus, salination of soils that are used for agricultural production is a significant and increasing problem in regions that rely heavily on agriculture, and is worsen by over-utilization, over-fertilization and water shortage, typically caused by climatic change and the demands of increasing population. Salt tolerance is of particular importance early in a plant's lifecycle, since evaporation from the soil surface causes upward water movement, and salt accumulates in the upper soil layer where the seeds are placed. On the other hand, germination normally takes place at a salt concentration, which is higher than the mean salt level in the whole soil profile.

Salt and drought stress signal transduction consist of ionic and osmotic homeostasis signaling pathways. The ionic aspect of salt stress is signaled via the SOS pathway where a calcium-responsive SOS3-SOS2 protein kinase complex controls the expression and activity of ion transporters such as SOS1. The osmotic component of salt stress involves complex plant reactions that overlap with drought and/or cold stress responses.

Suboptimal temperatures affect plant growth and development through the whole plant life cycle. Thus, low temperatures reduce germination rate and high temperatures result in leaf necrosis. In addition, mature plants that are exposed to excess of heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. The underlying mechanisms of chilling sensitivity are not completely understood yet, but probably involve the level of membrane saturation and other physiological deficiencies. Excessive light conditions, which occur under clear atmospheric conditions subsequent to cold late summer/autumn nights, can lead to photoinhibition of photosynthesis (disruption of photosynthesis). In addition, chilling may lead to yield losses and lower product quality through the delayed ripening of maize.

Common aspects of drought, cold and salt stress response [Reviewed in Xiong and Zhu (2002) Plant Cell Environ. 25: 131-139] include: (a) transient changes in the cytoplasmic calcium levels early in the signaling event; (b) signal transduction via mitogen-activated and/or calcium dependent protein kinases (CDPKs) and protein phosphatases; (c) increases in abscisic acid levels in response to stress triggering a subset of responses; (d) inositol phosphates as signal molecules (at least for a subset of the stress responsive transcriptional changes; (e) activation of phospholipases which in turn generates a diverse array of second messenger molecules, some of which might regulate the activity of stress responsive kinases; (f) induction of late embryogenesis abundant (LEA) type genes including the CRT/DRE responsive COR/RD genes; (g) increased levels of antioxidants and compatible osmolytes such as proline and soluble sugars; and (h) accumulation of reactive oxygen species such as superoxide, hydrogen peroxide, and hydroxyl radicals. Abscisic acid biosynthesis is regulated by osmotic stress at multiple steps. Both ABA-dependent and -independent osmotic stress signaling first modify constitutively expressed transcription factors, leading to the expression of early response transcriptional activators, which then activate downstream stress tolerance effector genes.

Several genes which increase tolerance to cold or salt stress can also improve drought stress protection, these include for example, the transcription factor AtCBF/DREB1, OsCDPK7 (Saijo et al. 2000, Plant J. 23: 319-327) or AVP1 (a vacuolar pyrophosphatase-proton pump, Gaxiola et al. 2001, Proc. Natl. Acad. Sci. USA 98: 11444-11449).

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

Genetic engineering efforts, aimed at conferring abiotic stress tolerance to transgenic crops, have been described in various publications [Apse and Blumwald (Curr Opin Biotechnol. 13:146-150, 2002), Quesada et al. (Plant Physiol. 130:951-963, 2002), Holmström et al. (Nature 379: 683-684, 1996), Xu et al. (Plant Physiol 110: 249-257, 1996), Pilon-Smits and Ebskamp (Plant Physiol 107: 125-130, 1995) and Tarczynski et al. (Science 259: 508-510, 1993)].

Various patents and patent applications disclose genes and proteins, which can be used for increasing tolerance of plants to abiotic stresses. These include for example, U.S. Pat. Nos. 5,296,462 and 5,356,816 (for increasing tolerance to cold stress); U.S. Pat. No. 6,670,528 (for increasing ABST); U.S. Pat. No. 6,720,477 (for increasing ABST); U.S. application Ser. Nos. 09/938,842 and 10/342,224 (for increasing ABST); U.S. application Ser. No. 10/231,035 (for increasing ABST); WO2004/104162 (for increasing ABST and biomass); WO2007/020638 (for increasing ABST, biomass, vigor and/or yield); WO2007/049275 (for increasing ABST, biomass, vigor and/or yield); WO2010/076756 (for increasing ABST, biomass and/or yield); WO2009/083958 (for increasing water use efficiency, fertilizer use efficiency, biotic/abiotic stress tolerance, yield and/or biomass); WO2010/020941 (for increasing nitrogen use efficiency, abiotic stress tolerance, yield and/or biomass); WO2009/141824 (for increasing plant utility); WO2010/049897 (for increasing plant yield).

Nutrient deficiencies cause adaptations of the root architecture, particularly notably for example is the root proliferation within nutrient rich patches to increase nutrient uptake. Nutrient deficiencies cause also the activation of plant metabolic pathways, which maximize the absorption, assimilation and distribution processes such as by activating architectural changes. Engineering the expression of the triggered genes may cause the plant to exhibit the architectural changes and enhanced metabolism also under other conditions.

In addition, it is widely known that the plants usually respond to water deficiency by creating a deeper root system that allows access to moisture located in deeper soil layers. Triggering this effect will allow the plants to access nutrients and water located in deeper soil horizons particularly those readily dissolved in water like nitrates.

Cotton and cotton by-products provide raw materials that are used to produce a wealth of consumer-based products in addition to textiles including cotton foodstuffs, livestock feed, fertilizer and paper. The production, marketing, consumption and trade of cotton-based products generate an excess of $100 billion annually in the U.S. alone, making cotton the number one value-added crop.

Even though 90% of cotton's value as a crop resides in the fiber (lint), yield and fiber quality has declined due to general erosion in genetic diversity of cotton varieties, and an increased vulnerability of the crop to environmental conditions.

There are many varieties of cotton plant, from which cotton fibers with a range of characteristics can be obtained and used for various applications. Cotton fibers may be characterized according to a variety of properties, some of which are considered highly desirable within the textile industry for the production of increasingly high quality products and optimal exploitation of modem spinning technologies. Commercially desirable properties include length, length uniformity, fineness, maturity ratio, decreased fuzz fiber production, micronaire, bundle strength, and single fiber strength. Much effort has been put into the improvement of the characteristics of cotton fibers mainly focusing on fiber length and fiber fineness. In particular, there is a great demand for cotton fibers of specific lengths.

A cotton fiber is composed of a single cell that has differentiated from an epidermal cell of the seed coat, developing through four stages, i.e., initiation, elongation, secondary cell wall thickening and maturation stages. More specifically, the elongation of a cotton fiber commences in the epidermal cell of the ovule immediately following flowering, after which the cotton fiber rapidly elongates for approximately 21 days. Fiber elongation is then terminated, and a secondary cell wall is formed and grown through maturation to become a mature cotton fiber.

Several candidate genes which are associated with the elongation, formation, quality and yield of cotton fibers were disclosed in various patent applications such as U.S. Pat. No. 5,880,100 and U.S. patent application Ser. Nos. 08/580,545, 08/867,484 and 09/262,653 (describing genes involved in cotton fiber elongation stage); WO0245485 (improving fiber quality by modulating sucrose synthase); U.S. Pat. No. 6,472,588 and WO0117333 (increasing fiber quality by transformation with a DNA encoding sucrose phosphate synthase); WO9508914 (using a fiber-specific promoter and a coding sequence encoding cotton peroxidase); WO9626639 (using an ovary specific promoter sequence to express plant growth modifying hormones in cotton ovule tissue, for altering fiber quality characteristics such as fiber dimension and strength); U.S. Pat. No. 5,981,834, U.S. Pat. No. 5,597,718, U.S. Pat. No. 5,620,882, U.S. Pat. No. 5,521,708 and U.S. Pat. No. 5,495,070 (coding sequences to alter the fiber characteristics of transgenic fiber producing plants); U.S. patent applications U.S. 2002049999 and U.S. 2003074697 (expressing a gene coding for endoxyloglucan transferase, catalase or peroxidase for improving cotton fiber characteristics); WO 01/40250 (improving cotton fiber quality by modulating transcription factor gene expression); WO 96/40924 (a cotton fiber transcriptional initiation regulatory region associated which is expressed in cotton fiber); EP0834566 (a gene which controls the fiber formation mechanism in cotton plant); WO2005/121364 (improving cotton fiber quality by modulating gene expression); WO2008/075364 (improving fiber quality, yield/biomass/vigor and/or abiotic stress tolerance of plants).

WO publication No. 2004/104162 discloses methods of increasing abiotic stress tolerance and/or biomass in plants and plants generated thereby.

WO publication No. 2004/111183 discloses nucleotide sequences for regulating gene expression in plant trichomes and constructs and methods utilizing same.

WO publication No. 2004/081173 discloses novel plant derived regulatory sequences and constructs and methods of using such sequences for directing expression of exogenous polynucleotide sequences in plants.

WO publication No. 2005/121364 discloses polynucleotides and polypeptides involved in plant fiber development and methods of using same for improving fiber quality, yield and/or biomass of a fiber producing plant.

WO publication No. 2007/049275 discloses isolated polypeptides, polynucleotides encoding same, transgenic plants expressing same and methods of using same for increasing fertilizer use efficiency, plant abiotic stress tolerance and biomass.

WO publication No. 2007/020638 discloses methods of increasing abiotic stress tolerance and/or biomass in plants and plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2009/083958 discloses methods of increasing water use efficiency, fertilizer use efficiency, biotic/abiotic stress tolerance, yield and biomass in plant and plants generated thereby.

WO publication No. 2009/141824 discloses isolated polynucleotides and methods using same for increasing plant utility.

WO publication No. 2009/013750 discloses genes, constructs and methods of increasing abiotic stress tolerance, biomass and/or yield in plants generated thereby.

WO publication No. 2010/020941 discloses methods of increasing nitrogen use efficiency, abiotic stress tolerance, yield and biomass in plants and plants generated thereby.

WO publication No. 2010/076756 discloses isolated polynucleotides for increasing abiotic stress tolerance, yield, biomass, growth rate, vigor, oil content, fiber yield, fiber quality, and/or nitrogen use efficiency of a plant.

WO2010/100595 publication discloses isolated polynucleotides and polypeptides, and methods of using same for increasing plant yield and/or agricultural characteristics.

WO publication No. 2010/049897 discloses isolated polynucleotides and polypeptides and methods of using same for increasing plant yield, biomass, growth rate, vigor, oil content, abiotic stress tolerance of plants and nitrogen use efficiency.

WO2010/143138 publication discloses isolated polynucleotides and polypeptides, and methods of using same for increasing nitrogen use efficiency, fertilizer use efficiency, yield, growth rate, vigor, biomass, oil content, abiotic stress tolerance and/or water use efficiency WO publication No. 2011/080674 discloses isolated polynucleotides and polypeptides and methods of using same for increasing plant yield, biomass, growth rate, vigor, oil content, abiotic stress tolerance of plants and nitrogen use efficiency.

WO2011/015985 publication discloses polynucleotides and polypeptides for increasing desirable plant qualities.

WO2011/135527 publication discloses isolated polynucleotides and polypeptides for increasing plant yield and/or agricultural characteristics.

WO2012/028993 publication discloses isolated polynucleotides and polypeptides, and methods of using same for increasing nitrogen use efficiency, yield, growth rate, vigor, biomass, oil content, and/or abiotic stress tolerance.

WO2012/085862 publication discloses isolated polynucleotides and polypeptides, and methods of using same for improving plant properties.

WO2012/150598 publication discloses isolated polynucleotides and polypeptides and methods of using same for increasing plant yield, biomass, growth rate, vigor, oil content, abiotic stress tolerance of plants and nitrogen use efficiency.

WO2013/027223 publication discloses isolated polynucleotides and polypeptides, and methods of using same for increasing plant yield and/or agricultural characteristics.

WO2013/080203 publication discloses isolated polynucleotides and polypeptides, and methods of using same for increasing nitrogen use efficiency, yield, growth rate, vigor, biomass, oil content, and/or abiotic stress tolerance.

WO2013/098819 publication discloses isolated polynucleotides and polypeptides, and methods of using same for increasing yield of plants.

WO2013/128448 publication discloses isolated polynucleotides and polypeptides and methods of using same for increasing plant yield, biomass, growth rate, vigor, oil content, abiotic stress tolerance and nitrogen use efficiency.

WO 2013/179211 publication discloses isolated polynucleotides and polypeptides and methods of using same for increasing plant yield and/or agricultural characteristics.

WO2014/033714 publication discloses isolated polynucleotides, polypeptides and methods of using same for increasing abiotic stress tolerance, biomass and yield of plants.

SUMMARY OF THE INVENTION

According to an aspect of some embodiments of the present invention there is provided a method of increasing yield, harvest index, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising a nucleic acid sequence encoding a polypeptide at least 80% homologous (e.g., identical) to SEQ ID NO: 474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 or 8164, thereby increasing the yield, harvest index, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of increasing yield, harvest index, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising a nucleic acid sequence encoding a polypeptide selected from the group consisting of SEQ ID NOs: 474-643, 645-760, 4806-6390, 6394-6398, 6400-7249, 7251-8134, 8136-8163 and 8164, thereby increasing the yield, harvest index, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of producing a crop comprising growing a crop plant transformed with an exogenous polynucleotide comprising a nucleic acid sequence encoding a polypeptide at least 80% homologous (e.g., identical) to the amino acid sequence selected from the group consisting of SEQ ID NOs: 474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 and 8164, wherein the crop plant is derived from plants which have been transformed with the exogenous polynucleotide and which have been selected for increased yield, increased harvest index, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance as compared to a wild type plant of the same species which is grown under the same growth conditions, and the crop plant having the increased yield, increased harvest index, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance, thereby producing the crop.

According to an aspect of some embodiments of the present invention there is provided a method of increasing yield, harvest index, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising a nucleic acid sequence at least 80% identical to SEQ ID NO: 1-170, 172-267, 269-424, 426-473, 761-2486, 2489-2494, 2496-4803 or 4804, thereby increasing the yield, harvest index, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of increasing yield, harvest index, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising the nucleic acid sequence selected from the group consisting of SEQ ID NOs:1-473, 761-4804 and 4805, thereby increasing the yield, harvest index, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of producing a crop comprising growing a crop plant transformed with an exogenous polynucleotide which comprises a nucleic acid sequence which is at least 80% identical to the nucleic acid sequence selected from the group consisting of SEQ ID NOs:1-170, 172-267, 269-424, 426-473, 761-2486, 2489-2494, 2496-4803 and 4804, wherein the crop plant is derived from plants which have been transformed with the exogenous polynucleotide and which have been selected for increased yield, increase harvest index, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance as compared to a wild type plant of the same species which is grown under the same growth conditions, and the crop plant having the increased yield, increase harvest index, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance, thereby producing the crop.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO:474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 or 8164, wherein the amino acid sequence is capable of increasing yield, harvest index, growth rate, biomass, vigor, oil content, seed yield, fiber yield, fiber quality, fiber length, photosynthetic capacity, nitrogen use efficiency, and/or abiotic stress tolerance of a plant.

According to an aspect of some embodiments of the present invention there is provided an isolated polynucleotide comprising a nucleic acid sequence encoding a polypeptide which comprises the amino acid sequence selected from the group consisting of SEQ ID NOs: 474-643, 645-760, 4806-6390, 6394-6398, 6400-7249, 7251-8134, 8136-8163 and 8164.

According to an aspect of some embodiments of the present invention there is provided an isolated polynucleotide comprising a nucleic acid sequence at least 80% identical to SEQ ID NOs: 1-170, 172-267, 269-424, 426-473, 761-2486, 2489-2494, 2496-4803 and 4804, wherein the nucleic acid sequence is capable of increasing yield, harvest index, growth rate, biomass, vigor, oil content, seed yield, fiber yield, fiber quality, fiber length, photosynthetic capacity, nitrogen use efficiency, and/or abiotic stress tolerance of a plant.

According to an aspect of some embodiments of the present invention there is provided an isolated polynucleotide comprising the nucleic acid sequence selected from the group consisting of SEQ ID NOs: 1-473, 761-4804 and 4805.

According to an aspect of some embodiments of the present invention there is provided a nucleic acid construct comprising the isolated polynucleotide of some embodiments of the invention, and a promoter for directing transcription of the nucleic acid sequence in a host cell.

According to an aspect of some embodiments of the present invention there is provided an isolated polypeptide comprising an amino acid sequence at least 80% homologous to SEQ ID NO: 474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 or 8164, wherein the amino acid sequence is capable of increasing yield, harvest index, growth rate, biomass, vigor, oil content, seed yield, fiber yield, fiber quality, fiber length, photosynthetic capacity, nitrogen use efficiency, and/or abiotic stress tolerance of a plant.

According to an aspect of some embodiments of the present invention there is provided an isolated polypeptide comprising the amino acid sequence selected from the group consisting of SEQ ID NOs: 474-643, 645-760, 4806-6390, 6394-6398, 6400-7249, 7251-8134, 8136-8163 and 8164.

According to an aspect of some embodiments of the present invention there is provided a plant cell exogenously expressing the polynucleotide of some embodiments of the invention, or the nucleic acid construct of some embodiments of the invention.

According to an aspect of some embodiments of the present invention there is provided a plant cell exogenously expressing the polypeptide of some embodiments of the invention.

According to some embodiments of the invention, the nucleic acid sequence encodes an amino acid sequence selected from the group consisting of SEQ ID NOs: 474-643, 645-760, 4806-6390, 6394-6398, 6400-7249, 7251-8134, 8136-8163 and 8164.

According to an aspect of some embodiments of the present invention there is provided a method of selecting a transformed plant having increased yield, harvest index, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, the method comprising:

(a) providing plants transformed with an exogenous polynucleotide encoding a polypeptide comprising an amino acid sequence at least 80% homologous to the amino acid sequence selected from the group consisting of SEQ ID NOs:474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 and 8164, (b) selecting from the plants of step (a) a plant having increased yield, harvest index, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, thereby selecting the plant having the increased yield, harvest index, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

According to an aspect of some embodiments of the present invention there is provided a method of selecting a transformed plant having increased yield, harvest index, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, the method comprising:

(a) providing plants transformed with an exogenous polynucleotide at least 80% identical to the nucleic acid sequence selected from the group consisting of SEQ ID NOs:1-170, 172-267, 269-424, 426-473, 761-2486, 2489-2494, 2496-4803 and 4804, (b) selecting from the plants of step (a) a plant having increased yield, harvest index, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, thereby selecting the plant having the increased yield, harvest index, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

According to some embodiments of the invention, the nucleic acid sequence is selected from the group consisting of SEQ ID NOs: 1-473, 761-4804 and 4805.

According to some embodiments of the invention, the polynucleotide consists of the nucleic acid sequence selected from the group consisting of SEQ ID NOs: 1-473, 761-4804 and 4805.

According to some embodiments of the invention, the nucleic acid sequence encodes the amino acid sequence selected from the group consisting of SEQ ID NOs: 474-643, 645-760, 4806-6390, 6394-6398, 6400-7249, 7251-8134, 8136-8163 and 8164.

According to some embodiments of the invention, the plant cell forms part of a plant.

According to some embodiments of the invention, the method further comprising growing the plant expressing the exogenous polynucleotide under the abiotic stress.

According to some embodiments of the invention, the abiotic stress is selected from the group consisting of salinity, drought, osmotic stress, water deprivation, flood, etiolation, low temperature, high temperature, heavy metal toxicity, anaerobiosis, nutrient deficiency, nitrogen deficiency, nutrient excess, atmospheric pollution and UV irradiation.

According to some embodiments of the invention, the yield comprises seed yield or oil yield.

According to an aspect of some embodiments of the present invention there is provided a transgenic plant comprising the nucleic acid construct of some embodiments of the invention or the plant cell of some embodiments of the invention.

According to some embodiments of the invention, the method further comprising growing the plant expressing the exogenous polynucleotide under nitrogen-limiting conditions.

According to some embodiments of the invention, the promoter is heterologous to the isolated polynucleotide and/or to the host cell.

According to an aspect of some embodiments of the present invention there is provided a method of growing a crop, the method comprising seeding seeds and/or planting plantlets of a plant transformed with the isolated polynucleotide of some embodiments of the invention, or with the nucleic acid construct of some embodiments of the invention, wherein the plant is derived from plants which have been transformed with the exogenous polynucleotide and which have been selected for at least one trait selected from the group consisting of: increased nitrogen use efficiency, increased abiotic stress tolerance, increased biomass, increased growth rate, increased vigor, increased yield, increased harvest index, increased fiber yield, increased fiber quality, increased fiber length, increased photosynthetic capacity, and increased oil content as compared to a non-transformed plant, thereby growing the crop.

According to some embodiments of the invention, the non-transformed plant is a wild type plant of identical genetic background.

According to some embodiments of the invention, the non-transformed plant is a wild type plant of the same species.

According to some embodiments of the invention, the non-transformed plant is grown under identical growth conditions.

According to some embodiments of the invention, the method further comprising selecting a plant having an increased yield, harvest index, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

According to some embodiments of the invention, selecting is performed under non-stress conditions.

According to some embodiments of the invention, selecting is performed under abiotic stress conditions.

According to some embodiments of the invention, selecting is performed under nitrogen limiting conditions.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

FIGS. 9A-B are schematic illustrations of the pEBbVNi tDNA (FIG. 9A) and the pEBbNi tDNA (FIG. 9B) plasmids used in the Brachypodium experiments. pEBbVNi tDNA (FIG. 9A) was used for expression of the isolated polynucleotide sequences of some embodiments of the invention in Brachypodium. pEBbNi tDNA (FIG. 9B) was used for transformation into Brachypodium as a negative control. "RB"=right border; "2LBregion"=2 repeats of left border; "35S"=35S promoter (SEQ ID NO:8202); "NOS ter"=nopaline synthase terminator; "Bar ORF"—BAR open reading frame (GenBank Accession No. JQ293091.1; SEQ ID NO:8203); The isolated polynucleotide sequences of some embodiments of the invention were cloned into the Multiple cloning site of the vector using one or more of the indicated restriction enzyme sites.

DESCRIPTION OF SPECIFIC EMBODIMENTS OF THE INVENTION

Figure 1:
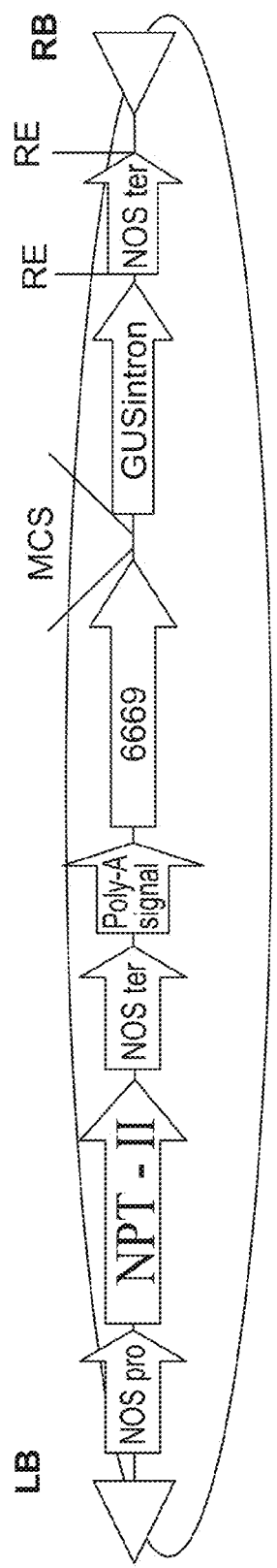
FIG. 1 is a schematic illustration of the modified pGI binary plasmid containing the new At6669 promoter (SEQ ID NO: 8190) and the GUSintron (pQYN 6669) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the vector while replacing the GUSintron reporter gene.
Figure 2:
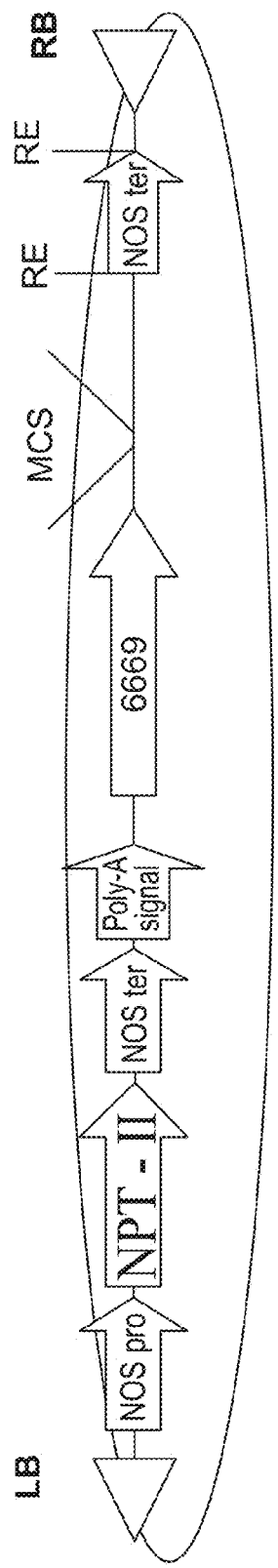
FIG. 2 is a schematic illustration of the modified pGI binary plasmid containing the new At6669 promoter (SEQ ID NO: 8190) (pQFN or pQFNc) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); The isolated polynucleotide sequences of the invention were cloned into the MCS of the vector.
Figure 3A:
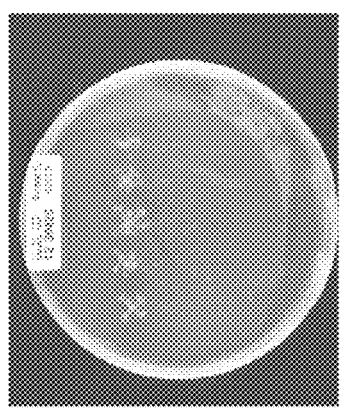
FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG.
Figure 3C:
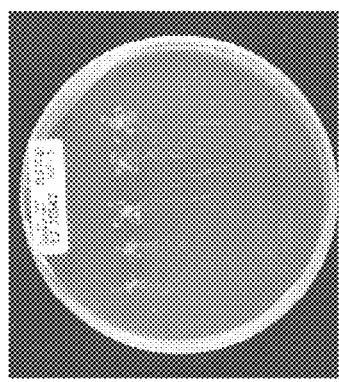
Figure 3E:
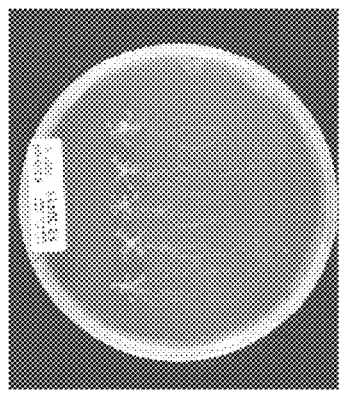
Figure 3B:
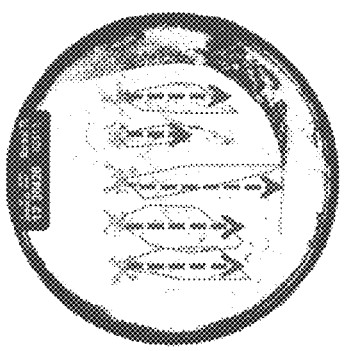
Figure 3D:
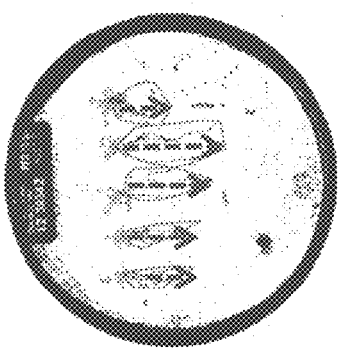
Figure 3F:
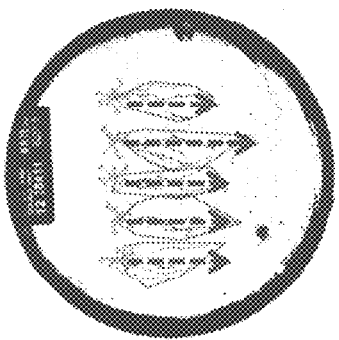
Figure 4:
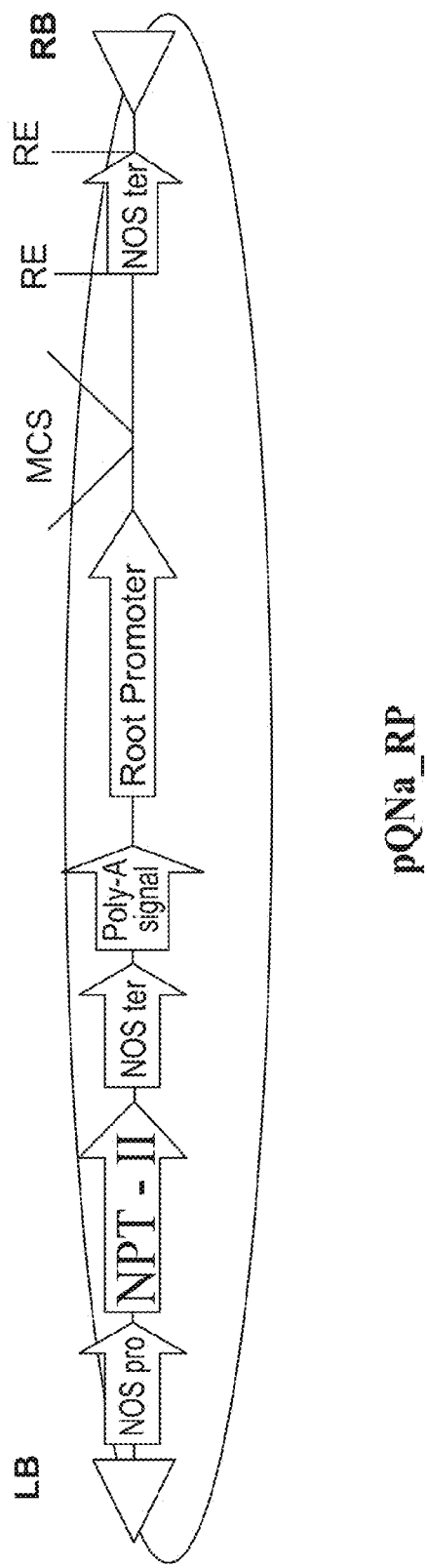
FIG. 4 is a schematic illustration of the modified pGI binary plasmid containing the Root Promoter (pQNa RP) used for expressing the isolated polynucleotide sequences of the invention. RB—T-DNA right border; LB—T-DNA left border; NOS pro=nopaline synthase promoter; NPT-II=neomycin phosphotransferase gene; NOS ter=nopaline synthase terminator; Poly-A signal (polyadenylation signal). The isolated polynucleotide sequences according to some embodiments of the invention were cloned into the MCS (Multiple cloning site) of the vector.
Figure 5:
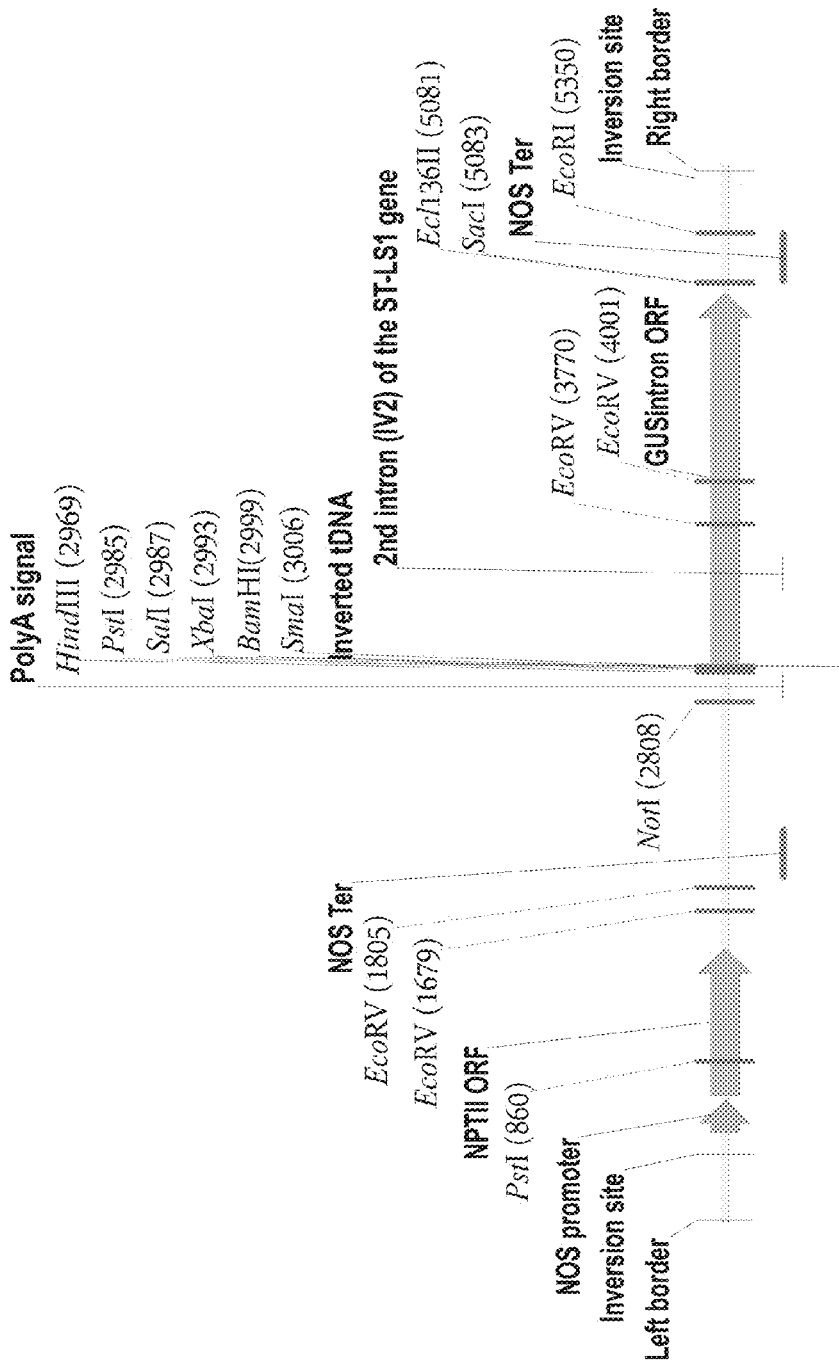
FIG. 5 is a schematic illustration of the pQYN plasmid.
Figure 6:
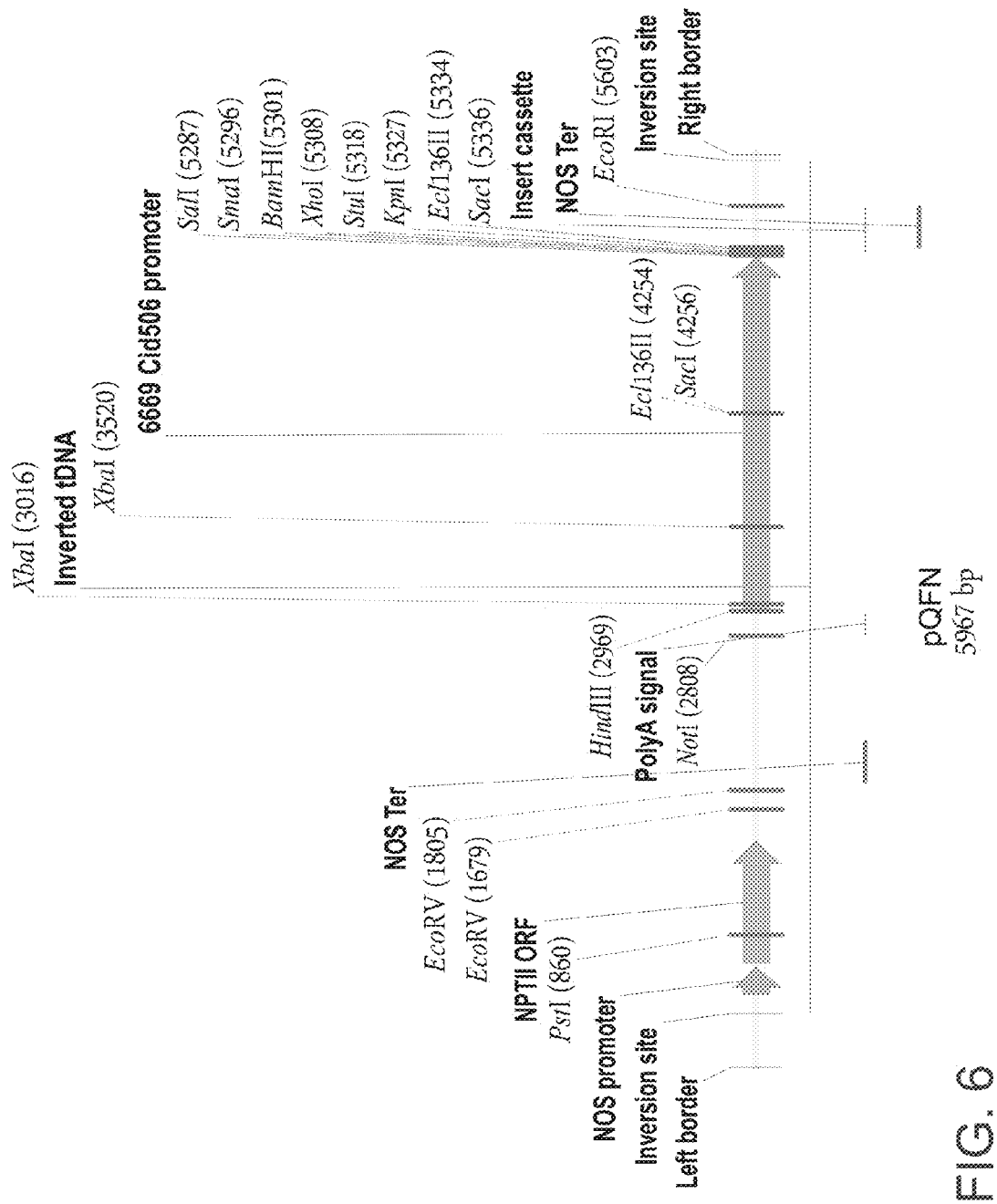
FIG. 6 is a schematic illustration of the pQFN plasmid.
Figure 7:
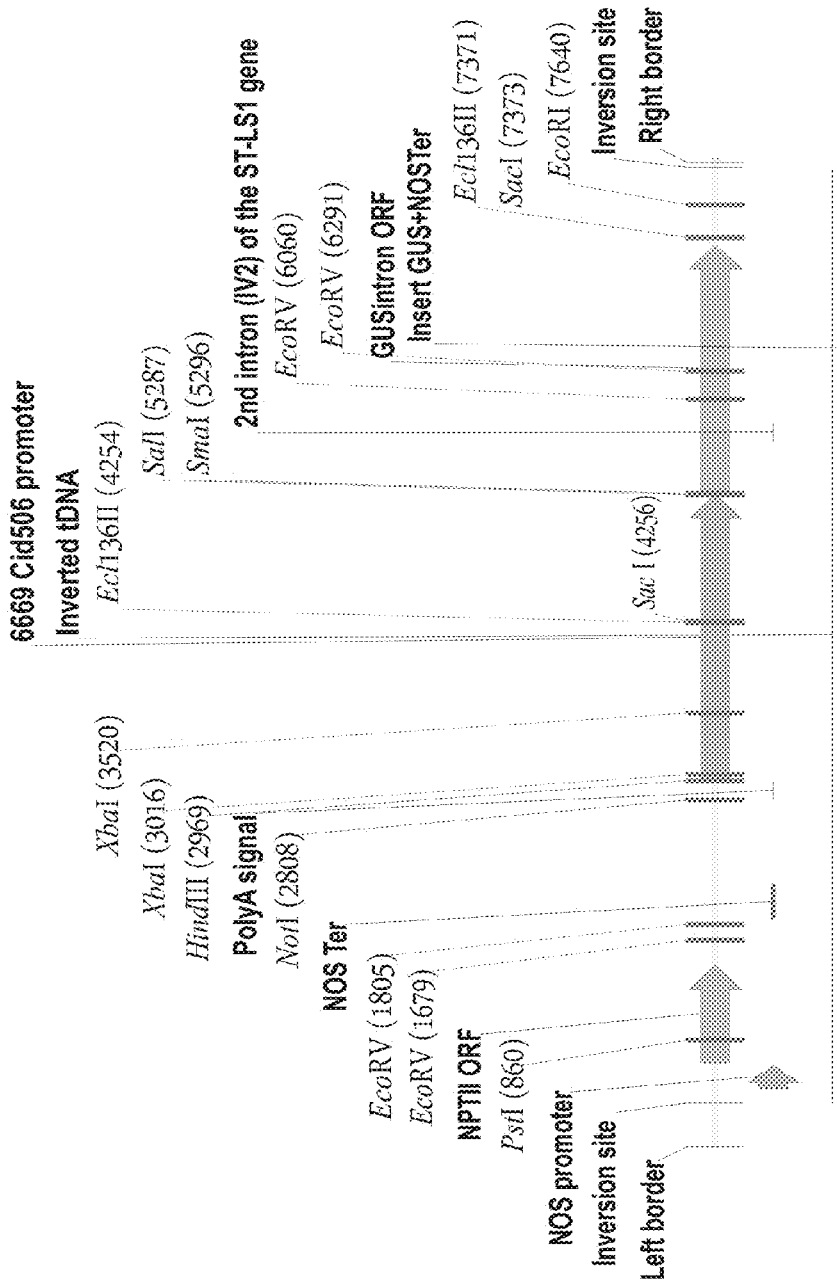
FIG. 7 is a schematic illustration of the pQFYN plasmid.
Figure 8:
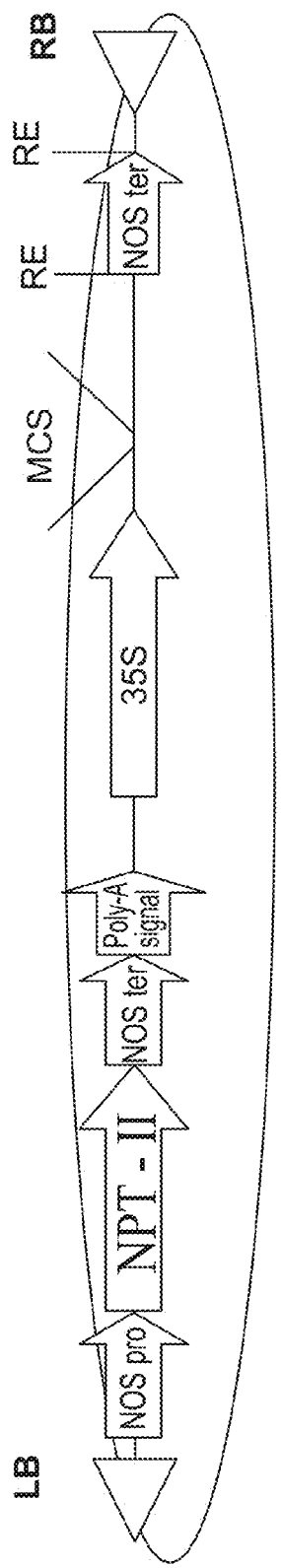
FIG. 8 is a schematic illustration of the modified pGI binary plasmid (pQXNc) used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; RE=any restriction enzyme; Poly-A signal (polyadenylation signal); 35S—the 35S promoter (pqfnc; SEQ ID NO: 8186). The isolated polynucleotide sequences of some embodiments of the invention were cloned into the MCS (Multiple cloning site) of the vector.

The present invention, in some embodiments thereof, relates to isolated polynucleotides and polypeptides, nucleic acid constructs, transgenic cells and transgenic plants comprising same and methods of generating and using same, and, more particularly, but not exclusively, to methods of increasing yield, harvest index, biomass, photosynthetic capacity, growth rate, vigor, oil content, fiber yield, fiber quality abiotic stress tolerance, fertilizer use efficiency (e.g., nitrogen use efficiency) and/or water use efficiency of a plant of a plant.

Thus, as shown in the Examples section which follows, the present inventors have utilized bioinformatics tools to identify polynucleotides which enhance yield (e.g., seed yield, oil yield, oil content), growth rate, biomass, harvest index, photosynthetic capacity, vigor and/or abiotic stress tolerance of a plant. Genes which affect the trait-of-interest were identified based on expression profiles of genes of several Barley, Sorghum, Maize, Brachypodium, Foxtail millet, Soybean and Tomato ecotypes and accessions in various tissues and growth conditions, homology with genes known to affect the trait-of-interest and using digital expression profile in specific tissues and conditions (SEQ ID NOs: 1-473 (polynucleotides), SEQ ID NOs: 474-760 (polypeptides), Table 1, Examples 1 and 3-14 of the Examples section which follows). Homologous (e.g., orthologous) polypeptides and polynucleotides having the same function were also identified (SEQ ID NOs: 761-4805 (polynucleotides), SEQ ID NOs: 4806-8165 (polypeptides), Table 2, Example 2 of the Examples section which follows). Selected genes were cloned into binary vectors (Table 107, Example 15 of the Examples section which follows), and transformed into *agrobacterium* (Example 16 of the Examples section which follows) for generation of transgenic plants (e.g., *Arabidopsis* and Brachypodium transgenic plants, Examples 17-18 of the Examples section which follows) over-expressing the polynucleotides and polypeptides of some embodiments of the invention. Transgenic plants over-expressing the identified polynucleotides were evaluated for the effect of the transgene (exogenous expression of the transgene) under normal or stress conditions in greenhouse seed maturation assays (Examples 19 and 23 of the Examples section which follows), in greenhouse until bolting assays (Example 20 of the Examples section which follows), and in greenhouse until heading assays (Example 22 of the Examples section which follows). These experiments showed significant increases in dry weight, fresh weight, leaf blade area, leaf number, plot coverage, harvest index, seed yield, 1000 seed weight, rosette area, rosette diameter, petiole relative area TP2, petiole relative area TP3, petiole relative area TP4, as well as in growth rate of leaf number, plot coverage and rosette diameter in transgenic plants over-expressing the isolated polynucleotides of some embodiments of the invention as compared to control (native, wild type) under the same growth conditions (Tables 108-115). In addition, seedling analyses were performed to evaluate the T1 and T2 generations of transgenic plants over-expressing the polynucleotides of the invention for increased biomass, root systems for absorbing nitrogen from soil and photosynthetic capacity as compared to control plants (Example 21 of the Examples section which follows, Tables 116-121). These experiments showed significant increases in dry weight, fresh weight, leaf area, roots coverage, roots length, as well as in growth rate of leaf area, roots coverage and root length in transgenic plants over-expressing the isolated polynucleotides of some embodiments of the invention as compared to control (native, wild type) under the same growth conditions (Tables 116-121). Altogether, these results suggest the use of the novel polynucleotides and polypeptides of the invention for increasing yield (including oil yield, seed yield and oil content), harvest index, growth rate, photosynthetic capacity, biomass, vigor, nitrogen use efficiency and/or abiotic stress tolerance of a plant.

Thus, according to an aspect of some embodiments of the invention, there is provided method of increasing oil content, yield, harvest index, growth rate, biomass, vigor, fiber yield, fiber quality, fiber length, photosynthetic capacity, fertilizer use efficiency (e.g., nitrogen use efficiency) and/or abiotic stress tolerance of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 and 8164, thereby increasing the oil content, yield, harvest index, growth rate, biomass, vigor, fiber yield, fiber quality, fiber length, photosynthetic capacity, fertilizer use efficiency (e.g., nitrogen use efficiency) and/or abiotic stress tolerance of the plant.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence, seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ/tissue size per time (can be measured in $cm^2$ per day or cm/day).

As used herein the phrase "photosynthetic capacity" (also known as "$A_{max}$") is a measure of the maximum rate at which leaves are able to fix carbon during photosynthesis. It is typically measured as the amount of carbon dioxide that is fixed per square meter per second, for example as μmol $m^{-2}$ $sec^{-1}$. Plants are able to increase their photosynthetic capacity by several modes of action, such as by increasing the total leaves area (e.g., by increase of leaves area, increase in the number of leaves, and increase in plant's vigor, e.g., the ability of the plant to grow new leaves along time course) as well as by increasing the ability of the plant to efficiently execute carbon fixation in the leaves. Hence, the increase in total leaves area can be used as a reliable measurement parameter for photosynthetic capacity increment.

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand.

Improving early vigor is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (Zea mays L.) hybrids based on Corn Belt germplasm in the European Atlantic.

It should be noted that a plant yield can be determined under stress (e.g., abiotic stress, nitrogen-limiting conditions) and/or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, osmotic stress, water deprivation, drought, flooding, freezing, low or high temperature, heavy metal toxicity, anaerobiosis, nutrient deficiency (e.g., nitrogen deficiency or limited nitrogen), atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related.

Zhu (2002) Ann. Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The *Arabidopsis* rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield.

It should be noted that improved ABST will confer plants with improved vigor also under non-stress conditions, resulting in crops having improved biomass and/or yield e.g., elongated fibers for the cotton industry, higher oil content.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (Kapok, *Ceiba pentandra*), desert willow, creosote bush, winterfat, balsa, kenaf, roselle, jute, sisal abaca, flax, corn, sugar cane, hemp, ramie, kapok, coir, bamboo, spanish moss and *Agave* spp. (e.g. sisal).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow).

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in yield, seed yield, biomass, growth rate, vigor, oil content, seed yield, fiber yield, fiber quality, fiber length, photosynthetic capacity, abiotic stress tolerance, and/or nitrogen use efficiency of a plant as compared to a native plant or a wild type plant [i.e., a plant not modified with the biomolecules (polynucleotide or polypeptides) of the invention, e.g., a non-transformed plant of the same species which is grown under the same (e.g., identical) growth conditions].

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant (e.g., a nucleic acid sequence from a different species) or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention, the exogenous polynucleotide of the invention comprises a nucleic acid sequence encoding a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 and 8164.

Homologous sequences include both orthologous and paralogous sequences. The term "paralogous" relates to gene-duplications within the genome of a species leading to paralogous genes. The term "orthologous" relates to homologous genes in different organisms due to ancestral relationship. Thus, orthologs are evolutionary counterparts derived from a single ancestral gene in the last common ancestor of given two species (Koonin E V and Galperin M Y (Sequence—Evolution—Function: Computational Approaches in Comparative Genomics. Boston: Kluwer Academic; 2003. Chapter 2, Evolutionary Concept in Genetics and Genomics. Available from: ncbi(dot)nlm(dot)nih (dot)gov/books/NBK20255) and therefore have great likelihood of having the same function.

One option to identify orthologues in monocot plant species is by performing a reciprocal blast search. This may be done by a first blast involving blasting the sequence-of-interest against any sequence database, such as the publicly available NCBI database which may be found at: ncbi(dot) nlm(dot)nih(dot)gov. If orthologues in rice were sought, the sequence-of-interest would be blasted against, for example, the 28,469 full-length cDNA clones from Oryza sativa Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [ebi(dot)ac(dot)uk/Tools/clustalw2/index(dot)html], followed by a neighbor-joining tree (wikipedia(dot)org/wiki/ Neighbor-joining) which helps visualizing the clustering.

Homology (e.g., percent homology, sequence identity+ sequence similarity) can be determined using any homology comparison software computing a pairwise sequence alignment.

As used herein, "sequence identity" or "identity" in the context of two nucleic acid or polypeptide sequences includes reference to the residues in the two sequences which are the same when aligned. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are considered to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Henikoff S and Henikoff J G. [Amino acid substitution matrices from protein blocks. Proc. Natl. Acad. Sci. U.S.A. 1992, 89(22): 10915-9].

Identity (e.g., percent homology) can be determined using any homology comparison software, including for example, the BlastN software of the National Center of Biotechnology Information (NCBI) such as by using default parameters.

According to some embodiments of the invention, the identity is a global identity, i.e., an identity over the entire amino acid or nucleic acid sequences of the invention and not over portions thereof.

According to some embodiments of the invention, the term "homology" or "homologous" refers to identity of two or more nucleic acid sequences; or identity of two or more amino acid sequences; or the identity of an amino acid sequence to one or more nucleic acid sequence.

According to some embodiments of the invention, the homology is a global homology, i.e., a homology over the entire amino acid or nucleic acid sequences of the invention and not over portions thereof.

The degree of homology or identity between two or more sequences can be determined using various known sequence comparison tools. Following is a non-limiting description of such tools which can be used along with some embodiments of the invention.

Pairwise global alignment was defined by S. B. Needleman and C. D. Wunsch, "A general method applicable to the search of similarities in the amino acid sequence of two proteins" Journal of Molecular Biology, 1970, pages 443-53, volume 48).

For example, when starting from a polypeptide sequence and comparing to other polypeptide sequences, the EMBOSS-6.0.1 Needleman-Wunsch algorithm (available from emboss(dot)sourceforge(dot)net/apps/cvs/emboss/apps/needle(dot)html) can be used to find the optimum alignment (including gaps) of two sequences along their entire length—a "Global alignment". Default parameters for Needleman-Wunsch algorithm (EMBOSS-6.0.1) include: gapopen=10; gapextend=0.5; datafile=EBLOSUM62; brief=YES.

According to some embodiments of the invention, the parameters used with the EMBOSS-6.0.1 tool (for protein-protein comparison) include: gapopen=8; gapextend=2; datafile=EBLOSUM62; brief=YES.

According to some embodiments of the invention, the threshold used to determine homology using the EMBOSS-6.0.1 Needleman-Wunsch algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting from a polypeptide sequence and comparing to polynucleotide sequences, the OneModel FramePlus algorithm [Halperin, E., Faigler, S. and Gill-More, R. (1999)—FramePlus: aligning DNA to protein sequences. Bioinformatics, 15, 867-873) (available from biocceleration (dot)com/Products(dot)html] can be used with following default parameters: model=frame+_p2n.model mode=local.

According to some embodiments of the invention, the parameters used with the OneModel FramePlus algorithm are model=frame+_p2n.model, mode=qglobal.

According to some embodiments of the invention, the threshold used to determine homology using the OneModel FramePlus algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting with a polynucleotide sequence and comparing to other polynucleotide sequences the EMBOSS-6.0.1 Needleman-Wunsch algorithm (available from emboss(dot)sourceforge(dot)net/apps/cvs/emboss/apps/needle(dot) html) can be used with the following default parameters: (EMBOSS-6.0.1) gapopen=10; gapextend=0.5; datafile=EDNAFULL; brief=YES.

According to some embodiments of the invention, the parameters used with the EMBOSS-6.0.1 Needleman-Wunsch algorithm are gapopen=10; gapextend=0.2; datafile=EDNAFULL; brief=YES.

According to some embodiments of the invention, the threshold used to determine homology using the EMBOSS-6.0.1 Needleman-Wunsch algorithm for comparison of polynucleotides with polynucleotides is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiment, determination of the degree of homology further requires employing the Smith-Waterman algorithm (for protein-protein comparison or nucleotide-nucleotide comparison).

Default parameters for GenCore 6.0 Smith-Waterman algorithm include: model=sw.model.

According to some embodiments of the invention, the threshold used to determine homology using the Smith-Waterman algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiments of the invention, the global homology is performed on sequences which are pre-selected by local homology to the polypeptide or polynucleotide of interest (e.g., 60% identity over 60% of the sequence length), prior to performing the global homology to the polypeptide or polynucleotide of interest (e.g., 80% global homology on the entire sequence). For example, homologous sequences are selected using the BLAST software with the Blastp and tBlastn algorithms as filters for the first stage, and the needle (EMBOSS package) or Frame+ algorithm alignment for the second stage. Local identity (Blast alignments) is defined with a very permissive cut-off—60% Identity on a span of 60% of the sequences lengths because it is used only as a filter for the global alignment stage. In this specific embodiment (when the local identity is used), the default filtering of the Blast package is not utilized (by setting the parameter "-F F").

In the second stage, homologs are defined based on a global identity of at least 80% to the core gene polypeptide sequence.

According to some embodiments of the invention, two distinct forms for finding the optimal global alignment for protein or nucleotide sequences are used:

I. Between Two Proteins (Following the Blastp Filter):
EMBOSS-6.0.1 Needleman-Wunsch algorithm with the following modified parameters:
gapopen=8 gapextend=2. The rest of the parameters are unchanged from the default options listed here:

Standard (Mandatory) qualifiers:
[-asequence] sequence Sequence filename and optional format, or reference (input USA)
[-bsequence] seqall Sequence(s) filename and optional format, or reference (input USA)
- gapopen float [10.0 for any sequence]. The gap open penalty is the score taken away when a gap is created. The best value depends on the choice of comparison matrix. The default value assumes you are using the EBLOSUM62 matrix for protein sequences, and the EDNAFULL matrix for nucleotide sequences. (Floating point number from 1.0 to 100.0)
- gapextend float [0.5 for any sequence]. The gap extension, penalty is added to the standard gap penalty for each base or residue in the gap. This is how long gaps are penalized. Usually you will expect a few long gaps rather than many short gaps, so the gap extension penalty should be lower than the gap penalty. An exception is where one or both sequences are single reads with possible sequencing errors in which case you would expect many single base gaps. You can get this result by setting the gap open penalty to zero (or very low) and using the gap extension penalty to control gap scoring. (Floating point number from 0.0 to 10.0) [-outfile] align [*.needle] Output alignment file name Additional (Optional) Qualifiers:
-datafile matrix [EBLOSUM62 for protein, EDNAFULL for DNA].
This is the scoring matrix file used when comparing sequences. By default it is the file 'EBLOSUM62' (for proteins) or the file 'EDNAFULL' (for nucleic sequences). These files are found in the 'data' directory of the EMBOSS installation.

Advanced (Unprompted) Qualifiers:
-[no]brief Boolean [Y] Brief identity and similarity
Associated Qualifiers:
"-asequence" associated qualifiers
-sbegin1 integer Start of the sequence to be used
-send1 integer End of the sequence to be used
-sreverse1 boolean Reverse (if DNA)
-sask1 boolean Ask for begin/end/reverse
-snucleotide1 boolean Sequence is nucleotide
-sprotein1 boolean Sequence is protein
-slower1 boolean Make lower case
-supper1 boolean Make upper case
-sformat1 string Input sequence format
-sdbname1 string Database name
-sid1 string Entryname
-ufo1 string UFO features
-fformat1 string Features format
-fopenfile1 string Features file name
"-bsequence" associated qualifiers
-sbegin2 integer Start of each sequence to be used
-send2 integer End of each sequence to be used
-sreverse2 boolean Reverse (if DNA)
-sask2 boolean Ask for begin/end/reverse
-snucleotide2 boolean Sequence is nucleotide
-sprotein2 boolean Sequence is protein
-slower2 boolean Make lower case
-supper2 boolean Make upper case
-sformat2 string Input sequence format
-sdbname2 string Database name
-sid2 string Entryname
-ufo2 string UFO features
-fformat2 string Features format
-fopenfile2 string Features file name
"-outfile" associated qualifiers
-aformat3 string Alignment format
-aextension3 string File name extension
-adirectory3 string Output directory
-aname3 string Base file name
-awidth3 integer Alignment width
-aaccshow3 boolean Show accession number in the header
-adesshow3 boolean Show description in the header
-ausashow3 boolean Show the full USA in the alignment
-aglobal3 boolean Show the full sequence in alignment
General Qualifiers:
-auto boolean Turn off prompts
-stdout boolean Write first file to standard output
-filter boolean Read first file from standard input, write first file to standard output
-options Boolean Prompt for standard and additional values
-debug Boolean Write debug output to program.dbg
-verbose Boolean Report some/full command line options
-help boolean Report command line options. More information on associated and general qualifiers can be found with -help -verbose
-warning boolean Report warnings
-error boolean Report errors
-fatal boolean Report fatal errors
-die Boolean Report dying program messages 2. Between a Protein Sequence and a Nucleotide Sequence (Following the Tblastn Filter):

GenCore 6.0 OneModel application utilizing the Frame+ algorithm with the following parameters: model=frame+_p2n. model mode=qglobal—q=protein. sequence—db=nucleotide.sequence. The rest of the parameters are unchanged from the default options:

Usage:
om -model=<model_fname>[-q=]query [-db=]database [options]
-model=<model_fname> Specifies the model that you want to run. All models supplied by Compugen are located in the directory $CGNROOT/models/.
Valid Command Line Parameters:
-dev=<dev_name> Selects the device to be used by the application.
Valid devices are:
   Bic—Bioccelerator (valid for SW, XSW, FRAME_N2P, and FRAME_P2N models).
   xlg—BioXL/G (valid for all models except XSW).
   xlp—BioXL/P (valid for SW, FRAME+_N2P, and FRAME_P2N models).
   xlh—BioXL/H (valid for SW, FRAME+_N2P, and FRAME_P2N models).
   soft—Software device (for all models).
-q=<query> Defines the query set. The query can be a sequence file or a database reference. You can specify a query by its name or by accession number. The format is detected automatically. However, you may specify a format using the -qfmt parameter. If you do not specify a query, the program prompts for one. If the query set is a database reference, an output file is produced for each sequence in the query.
-db=<database name> Chooses the database set. The database set can be a sequence file or a database reference. The database format is detected automatically. However, you may specify a format using -dfmt parameter.
-qacc Add this parameter to the command line if you specify query using accession numbers.
-dacc Add this parameter to the command line if you specify a database using accession numbers.
-dfmt/-qfmt=<format_type> Chooses the database/query format type. Possible formats are:
   fasta—fasta with seq type auto-detected.
   fastap—fasta protein seq.
   fastan—fasta nucleic seq.
   gcg—gcg format, type is auto-detected.
   gcg9seq—gcg9 format, type is auto-detected.
   gcg9seqp—gcg9 format protein seq.
   gcg9seqn—gcg9 format nucleic seq.
   nbrf—nbrf seq, type is auto-detected.
   nbrfp—nbrf protein seq.
   nbrfn—nbrf nucleic seq.
   embl—embl and swissprot format.
   genbank—genbank format (nucleic).
   blast—blast format.
   nbrf gcg—nbrf-gcg seq, type is auto-detected.
   nbrf gcgp—nbrf-gcg protein seq.
   nbrf gcgn—nbrf-gcg nucleic seq.
   raw—raw ascii sequence, type is auto-detected.
   rawp—raw ascii protein sequence.
   rawn—raw ascii nucleic sequence.
   pir—pir codata format, type is auto-detected.
   profile—gcg profile (valid only for -qfmt in SW, XSW, FRAME_P2N, and FRAME+_P2N).
-out=<out_fname> The name of the output file.
-suffix=<name> The output file name suffix.
-gapop=<n> Gap open penalty. This parameter is not valid for FRAME+. For FrameSearch the default is 12.0. For other searches the default is 10.0.
-gapext=<n> Gap extend penalty. This parameter is not valid for FRAME+. For FrameSearch the default is 4.0. For other models: the default for protein searches is 0.05, and the default for nucleic searches is 1.0.

-qgapop=<n> The penalty for opening a gap in the query sequence. The default is 10.0. Valid for XSW.
-qgapext=<n> The penalty for extending a gap in the query sequence. The default is 0.05. Valid for XSW.
-start=<n> The position in the query sequence to begin the search.
-end=<n> The position in the query sequence to stop the search.
-qtrans Performs a translated search, relevant for a nucleic query against a protein database. The nucleic query is translated to six reading frames and a result is given for each frame.
  Valid for SW and XSW.
-dtrans Performs a translated search, relevant for a protein query against a DNA database. Each database entry is translated to six reading frames and a result is given for each frame.
  Valid for SW and XSW.
Note: "-qtrans" and "-dtrans" options are mutually exclusive.
-matrix=<matrix_file> Specifies the comparison matrix to be used in the search. The matrix must be in the BLAST format. If the matrix file is not located in $CGNROOT/tables/matrix, specify the full path as the value of the -matrix parameter.
-trans=<transtab_name> Translation table. The default location for the table is $CGNROOT/tables/trans.
-onestrand Restricts the search to just the top strand of the query/database nucleic sequence.
-list=<n> The maximum size of the output hit list. The default is 50.
-docalign=<n> The number of documentation lines preceding each alignment. The default is 10.
-thr_score=<score_name> The score that places limits on the display of results. Scores that are smaller than -thr_min value or larger than -thr_max value are not shown. Valid options are: quality.
  zscore.
  escore.
-thr_max=<n> The score upper threshold. Results that are larger than -thr_max value are not shown.
-thr_min=<n> The score lower threshold. Results that are lower than -thr_min value are not shown.
-align=<n> The number of alignments reported in the output file.
-noalign Do not display alignment.
Note: "-align" and "-noalign" parameters are mutually exclusive.
-outfmt=<format_name> Specifies the output format type. The default format is PFS.
Possible values are:
  PFS—PFS text format
  FASTA—FASTA text format
  BLAST—BLAST text format
-nonorm Do not perform score normalization.
-norm=<norm_name> Specifies the normalization method. Valid options are:
  log—logarithm normalization.
  std—standard normalization.
  stat—Pearson statistical method.
Note: "-nonorm" and "-norm" parameters cannot be used together.
Note: Parameters -xgapop, -xgapext, -fgapop, -fgapext, -ygapop, -ygapext, -delop, and -delext apply only to FRAME+.
-xgapop=<n> The penalty for opening a gap when inserting a codon (triplet). The default is 12.0.

-xgapext=<n> The penalty for extending a gap when inserting a codon (triplet). The default is 4.0.
-ygapop=<n> The penalty for opening a gap when deleting an amino acid. The default is 12.0.
-ygapext=<n> The penalty for extending a gap when deleting an amino acid. The default is 4.0.
-fgapop=<n> The penalty for opening a gap when inserting a DNA base. The default is 6.0.
-fgapext=<n> The penalty for extending a gap when inserting a DNA base. The default is 7.0.
-delop=<n> The penalty for opening a gap when deleting a DNA base. The default is 6.0.
-delext=<n> The penalty for extending a gap when deleting a DNA base. The default is 7.0.
-silent No screen output is produced.
-host=<host_name> The name of the host on which the server runs. By default, the application uses the host specified in the file $CGNROOT/cgnhosts.
-wait Do not go to the background when the device is busy. This option is not relevant for the Parseq or Soft pseudo device.
-batch Run the job in the background. When this option is specified, the file "$CGNROOT/defaults/batch.defaults" is used for choosing the batch command. If this file does not exist, the command "at now" is used to run the job.
Note: "-batch" and "-wait" parameters are mutually exclusive.
-version Prints the software version number.
-help Displays this help message. To get more specific help type:
  "om -model=<model_fname>-help".

According to some embodiments the homology is a local homology or a local identity.

Local alignments tools include, but are not limited to the BlastP, BlastN, BlastX or TBLASTN software of the National Center of Biotechnology Information (NCBI), FASTA, and the Smith-Waterman algorithm.

A tblastn search allows the comparison between a protein sequence to the six-frame translations of a nucleotide database. It can be a very productive way of finding homologous protein coding regions in unannotated nucleotide sequences such as expressed sequence tags (ESTs) and draft genome records (HTG), located in the BLAST databases est and htgs, respectively.

Default parameters for blastp include: Max target sequences: 100; Expected threshold: $e^{-5}$; Word size: 3; Max matches in a query range: 0; Scoring parameters: Matrix—BLOSUM62; filters and masking: Filter—low complexity regions.

Local alignments tools, which can be used include, but are not limited to, the tBLASTX algorithm, which compares the six-frame conceptual translation products of a nucleotide query sequence (both strands) against a protein sequence database. Default parameters include: Max target sequences: 100; Expected threshold: 10; Word size: 3; Max matches in a query range: 0; Scoring parameters: Matrix—BLOSUM62; filters and masking: Filter—low complexity regions.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 and 8164.

According to some embodiments of the invention, the exogenous polynucleotide of the invention encodes a polypeptide having the amino acid sequence selected from the group consisting of SEQ ID NOs: 474-643, 645-760, 4806-6390, 6394-6398, 6400-7249, 7251-8134, 8136-8163 and 8164.

According to some embodiments of the invention, the method of increasing yield, harvest index, biomass, growth rate, vigor, oil content, fiber yield, fiber quality, fiber length, photosynthetic capacity, abiotic stress tolerance, and/or nitrogen use efficiency of a plant, is effected by expressing within the plant an exogenous polynucleotide comprising a nucleic acid sequence encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 and 8164, thereby increasing the yield, harvest index, biomass, growth rate, vigor, oil content, fiber yield, fiber quality, fiber length, photosynthetic capacity, abiotic stress tolerance, and/or nitrogen use efficiency of the plant.

According to some embodiments of the invention, the exogenous polynucleotide encodes a polypeptide consisting of the amino acid sequence set forth by SEQ ID NO:474-643, 645-760, 4806-6390, 6394-6398, 6400-7249, 7251-8134, 8136-8163 or 8164.

According to an aspect of some embodiments of the invention, the method of increasing yield, harvest index, biomass, growth rate, vigor, oil content, fiber yield, fiber quality, fiber length, photosynthetic capacity, abiotic stress tolerance, and/or nitrogen use efficiency of a plant, is effected by expressing within the plant an exogenous polynucleotide comprising a nucleic acid sequence encoding a polypeptide comprising an amino acid sequence selected from the group consisting of SEQ ID NOs:474-643, 645-760, 4806-6390, 6394-6398, 6400-7249, 7251-8134, 8136-8163 and 8164, thereby increasing the yield, harvest index, biomass, growth rate, vigor, oil content, fiber yield, fiber quality, fiber length, photosynthetic capacity, abiotic stress tolerance, and/or nitrogen use efficiency of the plant.

According to an aspect of some embodiments of the invention, there is provided a method of increasing yield, biomass, growth rate, vigor, oil content, fiber yield, fiber quality, fiber length, photosynthetic capacity, abiotic stress tolerance, and/or nitrogen use efficiency of a plant, comprising expressing within the plant an exogenous polynucleotide comprising a nucleic acid sequence encoding a polypeptide selected from the group consisting of SEQ ID NOs: 474-643, 645-760, 4806-6390, 6394-6398, 6400-7249, 7251-8134, 8136-8163 and 8164, thereby increasing the yield, harvest index, biomass, growth rate, vigor, oil content, fiber yield, fiber quality, fiber length, photosynthetic capacity, abiotic stress tolerance, and/or nitrogen use efficiency of the plant.

According to some embodiments of the invention, the exogenous polynucleotide encodes a polypeptide consisting of the amino acid sequence set forth by SEQ ID NO: 474-643, 645-760, 4806-6390, 6394-6398, 6400-7249, 7251-8134, 8136-8163 or 8164.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-170, 172-267, 269-424, 426-473, 761-2486, 2489-2494, 2496-4803 and 4804.

According to an aspect of some embodiments of the invention, there is provided a method of increasing yield, harvest index, biomass, growth rate, vigor, oil content, fiber yield, fiber quality, fiber length, photosynthetic capacity, abiotic stress tolerance, and/or nitrogen use efficiency of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-170, 172-267, 269-424, 426-473, 761-2486, 2489-2494, 2496-4803 and 4804, thereby increasing the yield, harvest index, biomass, growth rate, vigor, oil content, fiber yield, fiber quality, fiber length, photosynthetic capacity, abiotic stress tolerance, and/or nitrogen use efficiency of the plant.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1-170, 172-267, 269-424, 426-473, 761-2486, 2489-2494, 2496-4803 and 4804.

According to some embodiments of the invention the exogenous polynucleotide is set forth by SEQ ID NO:1-473, 761-4804 or 4805.

According to some embodiments of the invention the method of increasing yield, harvest index, growth rate, biomass, vigor, oil content, seed yield, fiber yield, fiber quality, fiber length, photosynthetic capacity, nitrogen use efficiency, and/or abiotic stress tolerance of a plant further comprising selecting a plant (from the transformed plants) having an increased yield, harvest index, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

It should be noted that selecting a transformed plant having an increased trait as compared to a native (or non-transformed) plant grown under the same growth conditions can be performed by selecting for the trait, e.g., validating the ability of the transformed plant to exhibit the increased trait using well known assays (e.g., seedling analyses, greenhouse assays) as is further described herein below.

According to some embodiments of the invention selecting is performed under non-stress conditions.

According to some embodiments of the invention selecting is performed under abiotic stress conditions.

According to some embodiments of the invention selecting is performed under nitrogen limiting conditions.

According to an aspect of some embodiments of the invention, there is provided a method of selecting a transformed plant having increased yield, harvest index, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, the method comprising:

(a) providing plants transformed with an exogenous polynucleotide encoding a polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (e.g., having sequence similarity or sequence identity) to the amino acid sequence selected from the group consisting of SEQ ID NOs: 474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 and 8164, (b) selecting from the plants of step (a) a plant having increased yield, harvest index, growth rate, biomass, vigor, oil content, seed yield, fiber yield, fiber quality, fiber length, photosynthetic capacity, nitrogen use efficiency, and/or abiotic stress tolerance (e.g., by selecting the plants for the increased trait), thereby selecting the plant having increased yield, harvest index, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

According to an aspect of some embodiments of the invention, there is provided a method of selecting a transformed plant having increased yield, harvest index, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, the method comprising:

(a) providing plants transformed with an exogenous polynucleotide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-170, 172-267, 269-424, 426-473, 761-2486, 2489-2494, 2496-4803 and 4804, (b) selecting from the plants of step (a) a plant having increased yield, harvest index, growth rate, biomass, vigor, oil content, seed yield, fiber yield, fiber quality, fiber length, photosynthetic capacity, nitrogen use efficiency, and/or abiotic stress tolerance, thereby selecting the plant having increased yield, harvest index, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [(Xn−Yn)/ Yn ]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (kazusa(dot)or(dot)jp/ codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in SEQ ID NOs: 220, 268, 473, 1276, 1461, 1743, 2314, 3002, 3068, 3449, 3779, and 4481.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

According to some embodiments of the invention, the exogenous polynucleotide encodes a polypeptide comprising an amino acid sequence at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the amino acid sequence of a naturally occurring plant orthologue of the polypeptide selected from the group consisting of SEQ ID NOs: 474-643, 645-760, 4806-6390, 6394-6398, 6400-6895, 6897-7249, 7251-8134, 8136-8163 and 8164.

According to some embodiments of the invention, the polypeptide comprising an amino acid sequence at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the amino acid sequence of a naturally occurring plant orthologue of the polypeptide selected from the group consisting of SEQ ID NOs: 474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 and 8164.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:1-170, 172-267, 269-424, 426-473, 761-2486, 2489-2494, 2496-4803 and 4804.

According to some embodiments of the invention the nucleic acid sequence is capable of increasing yield, growth rate, biomass, vigor, oil content, seed yield, fiber yield, fiber quality, fiber length, photosynthetic capacity, nitrogen use efficiency, abiotic stress tolerance and/or water use efficiency of a plant.

According to some embodiments of the invention the isolated polynucleotide comprising the nucleic acid sequence selected from the group consisting of SEQ ID NOs:1-473, 761-4804 and 4805.

According to some embodiments of the invention the isolated polynucleotide is set forth by SEQ ID NO:1-473, 761-4804 or 4805.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NO: 474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 or 8164.

According to some embodiments of the invention the amino acid sequence is capable of increasing yield, growth rate, biomass, vigor, oil content, seed yield, fiber yield, fiber quality, fiber length, photosynthetic capacity, nitrogen use efficiency, abiotic stress tolerance and/or water use efficiency of a plant.

The invention provides an isolated polynucleotide comprising a nucleic acid sequence encoding a polypeptide which comprises the amino acid sequence selected from the group consisting of SEQ ID NOs:474-643, 645-760, 4806-6390, 6394-6398, 6400-7249, 7251-8134, 8136-8163 and 8164.

According to an aspect of some embodiments of the invention, there is provided a nucleic acid construct comprising the isolated polynucleotide of the invention, and a promoter for directing transcription of the nucleic acid sequence in a host cell.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NO: 474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 or 8164.

According to some embodiments of the invention, the polypeptide comprising an amino acid sequence selected from the group consisting of SEQ ID NOs:474-643, 645-760, 4806-6390, 6394-6398, 6400-7249, 7251-8134, 8136-8163 and 8164.

According to some embodiments of the invention, the polypeptide is set forth by SEQ ID NO: 474-643, 645-760, 4806-6390, 6394-6398, 6400-7249, 7251-8134, 8136-8163 or 8164.

The invention also encompasses fragments of the above described polypeptides and polypeptides having mutations, such as deletions, insertions or substitutions of one or more amino acids, either naturally occurring or man induced, either randomly or in a targeted fashion.

The term '"plant" as used herein encompasses a whole plant, a grafted plant, ancestor(s) and progeny of the plants and plant parts, including seeds, shoots, stems, roots (including tubers), rootstock, scion, and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis*, *Albizia amara*, *Alsophila tricolor*, *Andropogon* spp., *Arachis* spp, *Areca catechu*, *Astelia fragrans*, *Astragalus cicer*, *Baikiaea plurijuga*, *Betula* spp., *Brassica* spp., *Bruguiera gymnorrhiza*, *Burkea africana*, *Butea frondosa*, *Cadaba farinosa*, *Calliandra* spp, *Camellia sinensis*, *Canna indica*, *Capsicum* spp., *Cassia* spp., *Centroema pubescens*, *Chacoomeles* spp., *Cinnamomum cassia*, *Coffea arabica*, *Colophospermum mopane*, *Coronillia varia*, *Cotoneaster serotina*, *Crataegus* spp., *Cucumis* spp., *Cupressus* spp., *Cyathea dealbata*, *Cydonia oblonga*, *Cryptomeria japonica*, *Cymbopogon* spp., *Cynthea dealbata*, *Cydonia oblonga*, *Dalbergia monetaria*, *Davallia divaricata*, *Desmodium* spp., *Dicksonia squarosa*, *Dibeteropogon amplectens*, *Dioclea* spp, *Dolichos* spp., *Dorycnium rectum*, *Echinochloa pyramidalis*, *Ehraffia* spp., *Eleusine coracana*, *Eragrestis* spp., *Erythrina* spp., *Eucalypfus* spp., *Euclea schimperi*, *Eulalia vi/losa*, *Pagopyrum* spp., *Feijoa sellowlana*, *Fragaria* spp., *Flemingia* spp, *Freycinetia banksli*, *Geranium thunbergii*, *GinAgo biloba*, *Glycine javanica*, *Gliricidia* spp, *Gossypium hirsutum*, *Grevillea* spp., *Guibourtia coleosperma*, *Hedysarum* spp., *Hemaffhia altissima*, *Heteropogon contoffus*, *Hordeum vulgare*, *Hyparrhenia rufa*, *Hypericum erectum*, *Hypeffhelia dissolute*, *Indigo incamata*, *Iris* spp., *Leptarrhena pyrolifolia*, *Lespediza* spp., *Lettuca* spp., *Leucaena leucocephala*, *Loudetia simplex*, *Lotonus bainesli*, *Lotus* spp., *Macrotyloma axillare*, *Malus* spp., *Manihot esculenta*, *Medicago saliva*, *Metasequoia glyptostroboides*, *Musa sapientum*, *Nicotianum* spp., *Onobrychis* spp., *Ornithopus* spp., *Oryza* spp., *Peltophorum africanum*, *Pennisetum* spp., *Persea gratissima*, *Petunia* spp., *Phaseolus* spp., *Phoenix canariensis*, *Phormium cookianum*, *Photinia* spp., *Picea glauca*, *Pinus* spp., *Pisum sativam*, *Podocarpus totara*, *Pogonarthria fleckii*, *Pogonaffhria squarrosa*, *Populus* spp., *Prosopis cineraria*, *Pseudotsuga menziesii*, *Pterolobium stellatum*, *Pyrus communis*, *Quercus* spp., *Rhaphiolepis umbellata*, *Rhopalostylis sapida*, *Rhus natalensis*, *Ribes grossularia*, *Ribes* spp., *Robinia pseudoacacia*, *Rosa* spp., *Rubus* spp., *Salix* spp., *Schyzachyrium sanguineum*, *Sciadopitys vefficillata*, *Sequoia sempervirens*, *Sequoiadendron giganteum*, *Sorghum bicolor*, *Spinacia* spp., *Sporobolus fimbriatus*, *Stiburus alopecuroides*, *Stylosanthos humilis*, *Tadehagi* spp, *Taxodium distichum*, *Themeda triandra*, *Trifolium* spp., *Triticum* spp., *Tsuga heterophylla*, *Vaccinium* spp., *Vicia* spp., *Vitis vinifera*, *Watsonia pyramidata*, *Zantedeschia aethiopica*, *Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, *eucalyptus*, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, *lupinus*, rapeseed, tobacco, poplar and cotton.

According to some embodiments of the invention the plant is a dicotyledonous plant.

According to some embodiments of the invention the plant is a monocotyledonous plant.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of some embodiments of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

As used herein the phrase "heterologous promoter" refers to a promoter from a different species or from the same species but from a different gene locus as of the isolated polynucleotide sequence.

According to some embodiments of the invention, the isolated polynucleotide is heterologous to the plant cell (e.g., the polynucleotide is derived from a different plant species when compared to the plant cell, thus the isolated polynucleotide and the plant cell are not from the same plant species).

Any suitable promoter sequence can be used by the nucleic acid construct of the present invention. Preferably the promoter is a constitutive promoter, a tissue-specific, or an abiotic stress-inducible promoter.

According to some embodiments of the invention, the promoter is a plant promoter, which is suitable for expression of the exogenous polynucleotide in a plant cell.

Suitable promoters for expression in wheat include, but are not limited to, Wheat SPA promoter (SEQ ID NO: 8166; Albanietal, Plant Cell, 9: 171-184, 1997, which is fully incorporated herein by reference), wheat LMW (SEQ ID NO: 8167 (longer LMW promoter), and SEQ ID NO: 8168 (LMW promoter) and HMW glutenin-1 (SEQ ID NO: 8169 (Wheat HMW glutenin-1 longer promoter); and SEQ ID NO: 8170 (Wheat HMW glutenin-1 Promoter); Thomas and Flavell, The Plant Cell 2:1171-1180; Furtado et al., 2009 Plant Biotechnology Journal 7:240-253, each of which is fully incorporated herein by reference), wheat alpha, beta and gamma gliadins [e.g., SEQ ID NO: 8171 (wheat alpha gliadin, B genome, promoter); SEQ ID NO: 8172 (wheat gamma gliadin promoter); EMBO 3:1409-15, 1984, which is fully incorporated herein by reference], wheat TdPR60 [SEQ ID NO:8173 (wheat TdPR60 longer promoter) or SEQ ID NO:8174 (wheat TdPR60 promoter); Kovalchuk et al., Plant Mol Biol 71:81-98, 2009, which is fully incorporated herein by reference], maize Ub1 Promoter [cultivar Nongda 105 (SEQ ID NO:8175); GenBank: DQ141598.1; Taylor et al., Plant Cell Rep 1993 12: 491-495, which is fully incorporated herein by reference; and cultivar B73 (SEQ ID NO:8176); Christensen, A H, et al. Plant Mol. Biol. 18 (4), 675-689 (1992), which is fully incorporated herein by reference]; rice actin 1 (SEQ ID NO:8177; Mc Elroy et al. 1990, The Plant Cell, Vol. 2, 163-171, which is fully incorporated herein by reference), rice GOS2 [SEQ ID NO: 8178 (rice GOS2 longer promoter) and SEQ ID NO: 8179 (rice GOS2 Promoter); De Pater et al. Plant J. 1992; 2: 837-44, which is fully incorporated herein by reference], arabidopsis Pho1 [SEQ ID NO: 8180 (arabidopsis Pho1 Promoter); Hamburger et al., Plant Cell. 2002; 14: 889-902, which is fully incorporated herein by reference], ExpansinB promoters, e.g., rice ExpB5 [SEQ ID NO:8181 (rice ExpB5 longer promoter) and SEQ ID NO: 8182 (rice ExpB5 promoter)] and Barley ExpB1 [SEQ ID NO: 8183 (barley ExpB1 Promoter), Won et al. Mol Cells. 2010; 30:369-76, which is fully incorporated herein by reference], barley SS2 (sucrose synthase 2) [(SEQ ID NO: 8184), Guerin and Carbonero, Plant Physiology May 1997 vol. 114 no. 1 55-62, which is fully incorporated herein by reference], and rice PG5a [SEQ ID NO:8185, U.S. Pat. No. 7,700,835, Nakase et al., Plant Mol Biol. 32:621-30, 1996, each of which is fully incorporated herein by reference].

Suitable constitutive promoters include, for example, CaMV 35S promoter [SEQ ID NO: 8186 (CaMV 35S (QFNC) Promoter); SEQ ID NO: 8187 (PJJ 35S from Brachypodium); SEQ ID NO: 8188 (CaMV 35S (OLD) Promoter) (Odell et al., Nature 313:810-812, 1985)], Arabidopsis At6669 promoter (SEQ ID NO: 8189 (Arabidopsis At6669 (OLD) Promoter); see PCT Publication No. WO04081173A2 or the new At6669 promoter (SEQ ID NO: 8190 (Arabidopsis At6669 (NEW) Promoter)); maize Ub1 Promoter [cultivar Nongda 105 (SEQ ID NO:8175); GenBank: DQ141598.1; Taylor et al., Plant Cell Rep 1993 12: 491-495, which is fully incorporated herein by reference; and cultivar B73 (SEQ ID NO:8176); Christensen, A H, et al. Plant Mol. Biol. 18 (4), 675-689 (1992), which is fully incorporated herein by reference]; rice actin 1 (SEQ ID NO: 8177, McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); rice GOS2 [SEQ ID NO: 8178 (rice GOS2 longer Promoter) and SEQ ID NO: 8179 (rice GOS2 Promoter), de Pater et al, Plant J November; 2(6):837-44, 1992]; RBCS promoter (SEQ ID NO:8191); Rice cyclophilin (Bucholz et al, Plant Mol Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608, 149; 5,608,144; 5,604,121; 5,569,597: 5,466,785; 5,399, 680; 5,268,463; and 5,608,142.

Suitable tissue-specific promoters include, but not limited to, leaf-specific promoters [e.g., AT5G06690 (Thioredoxin) (high expression, SEQ ID NO: 8192), AT5G61520 (At-STP3) (low expression, SEQ ID NO: 8193) described in Buttner et al 2000 Plant, Cell and Environment 23, 175-184, or the promoters described in Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993; as well as *Arabidopsis* STP3 (AT5G61520) promoter (Buttner et al., Plant, Cell and Environment 23:175-184, 2000)], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO: 8194 (*Brassica napus* NAPIN Promoter) from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), rice PG5a (SEQ ID NO: 8185; U.S. Pat. No. 7,700,835), early seed development *Arabidopsis* BAN (AT1G61720) (SEQ ID NO: 8195, US 2009/0031450 A1), late seed development *Arabidopsis* ABI3 (AT3G24650) (SEQ ID NO: 8196 (*Arabidopsis* ABI3 (AT3G24650) longer Promoter) or 8197 (*Arabidopsis* ABI3 (AT3G24650) Promoter)) (Ng et al., Plant Molecular Biology 54: 25-38, 2004), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143).323-32 1990), napA (Stalberg, et al, Planta 199: 515-519, 1996), Wheat SPA (SEQ ID NO:8166; Albanietal, Plant Cell, 9: 171-184, 1997), sunflower oleosin (Cummins, et al., Plant Mol. Biol. 19: 873-876, 1992)], endosperm specific promoters [e.g., wheat LMW (SEQ ID NO: 8167 (Wheat LMW Longer Promoter), and SEQ ID NO: 8168 (Wheat LMW Promoter) and HMW glutenin-1 [(SEQ ID NO: 8169 (Wheat HMW glutenin-1 longer Promoter)); and SEQ ID NO: 8170 (Wheat HMW glutenin-1 Promoter), Thomas and Flavell, The Plant Cell 2:1171-1180, 1990; Mol Gen Genet 216:81-90, 1989; NAR 17:461-2), wheat alpha, beta and gamma gliadins (SEQ ID NO: 8171 (wheat alpha gliadin (B genome) promoter); SEQ ID NO: 8172 (wheat gamma gliadin promoter); EMBO 3:1409-15, 1984), Barley ltr1 promoter, barley B1, C, D hordein (Theor Appl Gen 98:1253-62, 1999; Plant J 4:343-55, 1993; Mol Gen Genet 250:750-60, 1996), Barley DOF (Mena et al, The Plant Journal, 116(1): 53-62, 1998), Biz2 (EP99106056.7), Barley SS2 (SEQ ID NO: 8184 (Barley SS2 Promoter); Guerin and Carbonero Plant Physiology 114: 1 55-62, 1997), wheat Tarp60 (Kovalchuk et al., Plant Mol Biol 71:81-98, 2009), barley D-hordein (D-Hor) and B-hordein (B-Hor) (Agnelo Furtado, Robert J. Henry and Alessandro Pellegrineschi (2009)], Synthetic promoter (Vicente-Carbajosa et al., Plant J. 13: 629-640, 1998), rice prolamin NRP33, rice -globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma et al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen Genet. 217: 240-245; 1989), *Arabidopsis apetala-3* (Tilly et al., Development. 125:1647-57, 1998), *Arabidopsis APETALA* 1 (AT1G69120, AP1) (SEQ ID NO: 8198 (*Arabidopsis* (AT1G69120) *APETALA* 1)) (Hempel et al., Development 124:3845-3853, 1997)], and root promoters [e.g., the ROOTP promoter [SEQ ID NO: 8199]; rice ExpB5 (SEQ ID NO:8182 (rice ExpB5 Promoter); or SEQ ID NO: 8181 (rice ExpB5 longer Promoter)) and barley ExpB1 promoters (SEQ ID NO:8183) (Won et al. Mol. Cells 30: 369-376, 2010); arabidopsis ATTPS-CIN (AT3G25820) promoter (SEQ ID NO: 8200; Chen et al., Plant Phys 135:1956-66, 2004); arabidopsis Phot promoter (SEQ ID NO: 8180, Hamburger et al., Plant Cell. 14: 889-902, 2002), which is also slightly induced by stress].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced from the seedlings to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Taylor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

According to some embodiments, there is provided a method of improving yield, harvest index, growth rate, biomass, vigor, oil content, seed yield, fiber yield, fiber quality, fiber length, photosynthetic capacity, nitrogen use efficiency, water use efficiency and/or abiotic stress tolerance of a grafted plant, the method comprising providing a scion that does not transgenically express a polynucleotide encoding a polypeptide at least 80% homologous to the amino acid sequence selected from the group consisting of SEQ ID NOs: 474-643, 645-760, 4806-6390, 6394-6398, 6400-7249, 7251-8134, 8136-8163 or 8164 and a plant rootstock that transgenically expresses a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs: 474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 and 8164 (e.g., in a constitutive, tissue specific or inducible, e.g., in an abiotic stress responsive manner), thereby improving the nitrogen use efficiency, yield, harvest index, growth rate, biomass, vigor, oil content, seed yield, fiber yield, fiber quality, fiber length, photosynthetic capacity, and/or abiotic stress tolerance of the grafted plant.

In some embodiments, the plant scion is non-transgenic.

Several embodiments relate to a grafted plant exhibiting improved nitrogen use efficiency, yield, harvest index, growth rate, biomass, vigor, oil content, seed yield, fiber yield, fiber quality, fiber length, photosynthetic capacity, and/or abiotic stress tolerance, comprising a scion that does not transgenically express a polynucleotide encoding a polypeptide at least 80% homologous to the amino acid sequence selected from the group consisting of SEQ ID NOs: 474-643, 645-760, 4806-6390, 6394-6398, 6400-7249, 7251-8134, 8136-8163 or 8164, and a plant rootstock that transgenically expresses a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs: 474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 and 8164.

In some embodiments, the plant root stock transgenically expresses a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs: 474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 and 8164 in a stress responsive manner.

According to some embodiments of the invention, the plant root stock transgenically expresses a polynucleotide encoding a polypeptide selected from the group consisting of SEQ ID NOs: 474-643, 645-760, 4806-6390, 6394-6398, 6400-7249, 7251-8134, 8136-8163 and 8164.

According to some embodiments of the invention, the plant root stock transgenically expresses a polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-170, 172-267, 269-424, 426-473, 761-2486, 2489-2494, 2496-4803 and 4804.

According to some embodiments of the invention, the plant root stock transgenically expresses a polynucleotide selected from the group consisting of SEQ ID NOs: 1-473, 761-4804 and 4805.

Since processes which increase yield, growth rate, biomass, vigor, oil content, seed yield, fiber yield, fiber quality, fiber length, photosynthetic capacity, nitrogen use efficiency, water use efficiency and/or abiotic stress tolerance of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on nitrogen use efficiency, fertilizer use efficiency, oil content, yield, seed yield, fiber yield, fiber quality, fiber length, photosynthetic capacity, growth rate, biomass, vigor and/or abiotic stress tolerance.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, osmotic stress, drought, water deprivation, excess of water (e.g., flood, waterlogging), etiolation, low temperature (e.g., cold stress), high temperature, heavy metal toxicity, anaerobiosis, nutrient deficiency (e.g., nitrogen deficiency or nitrogen limitation), nutrient excess, atmospheric pollution and UV irradiation.

According to some embodiments of the invention, the method further comprising growing the plant expressing the exogenous polynucleotide under fertilizer limiting conditions (e.g., nitrogen-limiting conditions). Non-limiting examples include growing the plant on soils with low nitrogen content (40-50% Nitrogen of the content present under normal or optimal conditions), or even under sever nitrogen deficiency (0-10% Nitrogen of the content present under normal or optimal conditions, wherein the normal or optimal conditions include about 6-15 mM Nitrogen, e.g., 6-10 mM Nitrogen).

Thus, the invention encompasses plants exogenously expressing the polynucleotide(s), the nucleic acid constructs and/or polypeptide(s) of the invention.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

Thus, according to an additional embodiment of the present invention, there is provided a method of evaluating a trait of a plant, the method comprising: (a) expressing in a plant or a portion thereof the nucleic acid construct of some embodiments of the invention; and (b) evaluating a trait of a plant as compared to a wild type plant of the same type (e.g., a plant not transformed with the claimed biomolecules); thereby evaluating the trait of the plant.

According to an aspect of some embodiments of the invention there is provided a method of producing a crop comprising growing a crop of a plant expressing an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 and 8164, wherein the plant is derived from a plant (parent plant) that has been transformed to express the exogenous polynucleotide and that has been selected for increased abiotic stress tolerance, increased water use efficiency, increased growth rate, increased vigor, increased biomass, increased oil content, increased yield, increased harvest index, increased seed yield, increased fiber yield, increased fiber quality, increased fiber length, increased photosynthetic capacity, and/or increased fertilizer use efficiency (e.g., increased nitrogen use efficiency) as compared to a control plant, thereby producing the crop.

According to an aspect of some embodiments of the present invention there is provided a method of producing a crop comprising growing a crop plant transformed with an exogenous polynucleotide encoding a polypeptide at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 and 8164, wherein the crop plant is derived from plants which have been transformed with the exogenous polynucleotide and which have been selected for increased abiotic stress tolerance, increased water use efficiency, increased growth rate, increased vigor, increased biomass, increased oil content, increased yield, increased harvest index, increased seed yield, increased fiber yield, increased fiber quality, increased fiber length, increased photosynthetic capacity, and/or increased fertilizer use efficiency (e.g., increased nitrogen use efficiency) as compared to a wild type plant of the same species which is grown under the same growth conditions, and the crop plant having the increased abiotic stress tolerance, increased water use efficiency, increased growth rate, increased vigor, increased biomass, increased oil content, increased yield, increased harvest index, increased seed yield, increased fiber yield, increased fiber quality, increased fiber length, increased photosynthetic capacity, and/or increased fertilizer use efficiency (e.g., increased nitrogen use efficiency), thereby producing the crop.

According to some embodiments of the invention the polypeptide is selected from the group consisting of SEQ ID NOs: 474-643, 645-760, 4806-6390, 6394-6398, 6400-7249, 7251-8134, 8136-8163 and 8164.

According to an aspect of some embodiments of the invention there is provided a method of producing a crop comprising growing a crop of a plant expressing an exogenous polynucleotide which comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-170, 172-267, 269-424, 426-473, 761-2486, 2489-2494, 2496-4803 and 4804, wherein the plant is derived from a plant selected for increased abiotic stress tolerance, increased water use efficiency, increased growth rate, increased vigor, increased biomass, increased oil content, increased yield, increased harvest index, increased seed yield, increased fiber yield, increased fiber quality, increased fiber length, increased photosynthetic capacity, and/or increased fertilizer use efficiency (e.g., increased nitrogen use efficiency) as compared to a control plant, thereby producing the crop.

According to an aspect of some embodiments of the present invention there is provided a method of producing a crop comprising growing a crop plant transformed with an exogenous polynucleotide at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the nucleic acid sequence selected from the group consisting of SEQ ID NOs: 1-170, 172-267, 269-424, 426-473, 761-2486, 2489-2494, 2496-4803 and 4804, wherein the crop plant is derived from plants which have been transformed with the exogenous polynucleotide and which have been selected for increased abiotic stress tolerance, increased water use efficiency, increased growth rate, increased vigor, increased biomass, increased oil content, increased yield, increased harvest index, increased seed yield, increased fiber yield, increased fiber quality, increased fiber length, increased photosynthetic capacity, and/or increased fertilizer use efficiency (e.g., increased nitrogen use efficiency) as compared to a wild type plant of the same species which is grown under the same growth conditions, and the crop plant having the increased abiotic stress tolerance, increased water use efficiency, increased growth rate, increased vigor, increased biomass, increased oil content, increased yield, increased harvest index, increased seed yield, increased fiber yield, increased fiber quality, increased fiber length, increased photosynthetic capacity, and/or increased fertilizer use efficiency (e.g., increased nitrogen use efficiency), thereby producing the crop.

According to some embodiments of the invention the exogenous polynucleotide is selected from the group consisting of SEQ ID NOs: 1-473, 761-4804 and 4805.

According to an aspect of some embodiments of the invention there is provided a method of growing a crop comprising seeding seeds and/or planting plantlets of a plant transformed with the exogenous polynucleotide of the invention, e.g., the polynucleotide which encodes the polypeptide of some embodiments of the invention, wherein the plant is derived from plants which have been transformed with the exogenous polynucleotide and which have been selected for at least one trait selected from the group consisting of increased abiotic stress tolerance, increased water use efficiency, increased growth rate, increased vigor, increased biomass, increased oil content, increased yield, increased harvest index, increased seed yield, increased fiber yield, increased fiber quality, increased fiber length, increased photosynthetic capacity, and/or increased fertilizer use efficiency (e.g., increased nitrogen use efficiency) as compared to a non-transformed plant.

According to some embodiments of the invention the method of growing a crop comprising seeding seeds and/or planting plantlets of a plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 474-643, 645-679, 681-755, 757-760, 4806-6390, 6395-6396, 6401-6895, 6897-7249, 7251-7685, 7687-7693, 7695-7700, 7702-7708, 7710-7796, 7798-7816, 7818, 7820-7837, 7839-7840, 7842-7861, 7863-8134, 8136-8163 or 8164, wherein the plant is derived from plants which have been transformed with the exogenous polynucleotide and which have been selected for at least one trait selected from the group consisting of increased abiotic stress tolerance, increased water use efficiency, increased growth rate, increased vigor, increased biomass, increased oil content, increased yield, increased harvest index, increased seed yield, increased fiber yield, increased fiber quality, increased fiber length, increased photosynthetic capacity, and/or increased fertilizer use efficiency (e.g., increased nitrogen use efficiency) as compared to a non-transformed plant, thereby growing the crop.

According to some embodiments of the invention the polypeptide is selected from the group consisting of SEQ ID NOs: 474-643, 645-760, 4806-6390, 6394-6398, 6400-7249, 7251-8134, 8136-8163 and 8164.

According to some embodiments of the invention the method of growing a crop comprising seeding seeds and/or planting plantlets of a plant transformed with an exogenous polynucleotide comprising the nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 1-170, 172-267, 269-424, 426-473, 761-2486, 2489-2494, 2496-4803 or 4804, wherein the plant is derived from plants which have been transformed with the exogenous polynucleotide and which have been selected for at least one trait selected from the group consisting of increased abiotic stress tolerance, increased water use efficiency, increased growth rate, increased vigor, increased biomass, increased oil content, increased yield, increased harvest index, increased seed yield, increased fiber yield, increased fiber quality, increased fiber length, increased photosynthetic capacity, and/or increased fertilizer use efficiency (e.g., increased nitrogen use efficiency) as compared to a non-transformed plant, thereby growing the crop.

According to some embodiments of the invention the exogenous polynucleotide is selected from the group consisting of SEQ ID NOs: 1-473, 761-4804 and 4805.

The effect of the transgene (the exogenous polynucleotide encoding the polypeptide) on abiotic stress tolerance can be determined using known methods such as detailed below and in the Examples section which follows.

Abiotic stress tolerance—Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought tolerance assay/Osmoticum assay—Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold stress tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat stress tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water use efficiency—can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$RWC=[(FW-DW)/(TW-DW)] \times 100 \qquad \text{Formula I}$$

Fertilizer use efficiency—To analyze whether the transgenic plants are more responsive to fertilizers, plants are grown in agar plates or pots with a limited amount of fertilizer, as described, for example, in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen use efficiency—To analyze whether the transgenic plants (e.g., *Arabidopsis* plants) are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use efficiency assay using plantlets—The assay is done according to Yanagisawa-S. et al. with minor modifications ("Metabolic engineering with Dof1 transcription factor in plants: Improved nitrogen assimilation and growth under low-nitrogen conditions" Proc. Natl. Acad. Sci. USA 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control.

Nitrogen determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination tests—Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant vigor—The plant vigor can be calculated by the increase in growth parameters such as leaf area, fiber length, rosette diameter, plant fresh weight and the like per time.

Growth rate—The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be done by measuring plant biomass produced, rosette area, leaf size or root length per time (can be measured in $cm^2$ per day of leaf area).

Relative growth area can be calculated using Formula II.

Relative growth rate area=Regression coefficient of area along time course.        Formula II:

Thus, the relative growth area rate is in units of area units (e.g., $mm^2/day$ or $cm^2/day$) and the relative length growth rate is in units of length units (e.g., cm/day or mm/day).

For example, RGR can be determined for plant height (Formula III), SPAD (Formula IV), Number of tillers (Formula V), root length (Formula VI), vegetative growth (Formula VII), leaf number (Formula VIII), rosette area (Formula IX), rosette diameter (Formula X), plot coverage (Formula XI), leaf blade area (Formula XII), and leaf area (Formula XIII)

Relative growth rate of Plant height=Regression coefficient of Plant height along time course (measured in cm/day).        Formula III:

Relative growth rate of SPAD=Regression coefficient of SPAD measurements along time course.        Formula IV:

Relative growth rate of Number of tillers=Regression coefficient of Number of tillers along time course (measured in units of "number of tillers/day").        Formula V:

Relative growth rate of root length=Regression coefficient of root length along time course (measured in cm per day).        Formula VI:

Vegetative growth rate analysis—was calculated according to Formula VII below.

Relative growth rate of vegetative growth=Regression coefficient of vegetative dry weight along time course (measured in grams per day).        Formula VII:

Relative growth rate of leaf number=Regression coefficient of leaf number along time course (measured in number per day). Formula VIII:

Relative growth rate of rosette area=Regression coefficient of rosette area along time course (measured in cm² per day). Formula IX:

Relative growth rate of rosette diameter=Regression coefficient of rosette diameter along time course (measured in cm per day). Formula X:

Relative growth rate of plot coverage=Regression coefficient of plot (measured in cm² per day). Formula XI:

Relative growth rate of leaf blade area=Regression coefficient of leaf area along time course (measured in cm² per day). Formula XII:

Relative growth rate of leaf area=Regression coefficient of leaf area along time course (measured in cm² per day). Formula XIII:

1000 Seed Weight=number of seed in sample/sample weight×1000   Formula XIV:

The Harvest Index can be calculated using Formulas XV, XVI, XVII, XVIII and LXV below.

Harvest Index (seed)=Average seed yield per plant/Average dry weight. Formula XV:

Harvest Index (Sorghum)=Average grain dry weight per Head/(Average vegetative dry weight per Head+Average Head dry weight) Formula XVI:

Harvest Index (Maize)=Average grain weight per plant/(Average vegetative dry weight per plant plus Average grain weight per plant) Formula XVII:

Harvest Index (for barley)—The harvest index is calculated using Formula XVIII.

Harvest Index (for barley and wheat)=Average spike dry weight per plant/(Average vegetative dry weight per plant+Average spike dry weight per plant) Formula XVIII:

Following is a non-limited list of additional parameters which can be detected in order to show the effect of the transgene on the desired plant's traits:

Grain circularity=4×3.14 (grain area/perimeter²) Formula XIX:

Internode volume=3.14×(d/2)²×1 Formula XX:

Total dry matter (kg)=Normalized head weight per plant+vegetative dry weight. Formula XXI:

Root/Shoot Ratio=total weight of the root at harvest/total weight of the vegetative portion above ground at harvest. (=RBiH/BiH) Formula XXII:

Ratio of the number of pods per node on main stem at pod set=Total number of pods on main stem/Total number of nodes on main stem. Formula XXIII:

Ratio of total number of seeds in main stem to number of seeds on lateral branches=Total number of seeds on main stem at pod set/Total number of seeds on lateral branches at pod set. Formula XXIV:

Petiole Relative Area=(Petiole area)/Rosette area (measured in %). Formula XXV:

% reproductive tiller percentage=Number of Reproductive tillers/number of tillers)×100. Formula XXVI:

Spikes Index=Average Spikes weight per plant/(Average vegetative dry weight per plant plus Average Spikes weight per plant). Formula XXVII:

Relative growth rate of root coverage=Regression coefficient of root coverage along time course   Formula XXVIII:

Seed Oil yield=Seed yield per plant (gr.)*Oil % in seed. Formula XXIX:

shoot/root Ratio=total weight of the vegetative portion above ground at harvest/total weight of the root at harvest. Formula XXX:

Spikelets Index=Average Spikelets weight per plant/(Average vegetative dry weight per plant plus Average Spikelets weight per plant). Formula XXXI:

% Canopy coverage=(1−(PAR_DOWN/PAR_UP))× 100 measured using AccuPAR Ceptometer Model LP-80. Formula XXXII:

leaf mass fraction=Leaf area/shoot FW. Formula XXXIII:

Relative growth rate based on dry weight=Regression coefficient of dry weight along time course. Formula XXXIV:

Dry matter partitioning (ratio)—At the end of the growing period 6 plants heads as well as the rest of the plot heads were collected, threshed and grains were weighted to obtain grains yield per plot. Dry matter partitioning was calculated by dividing grains yield per plot to vegetative dry weight per plot. Formula XXXV:

1000 grain weight filling rate (gr/day)—The rate of grain filling was calculated by dividing 1000 grain weight by grain fill duration. Formula XXXVI:

Specific leaf area (cm²/gr)—Leaves were scanned to obtain leaf area per plant, and then were dried in an oven to obtain the leaves dry weight. Specific leaf area was calculated by dividing the leaf area by leaf dry weight. Formula XXXVII:

Vegetative dry weight per plant at flowering/water until flowering (gr/lit)—Calculated by dividing vegetative dry weight (excluding roots and reproductive organs) per plant at flowering by the water used for irrigation up to flowering. Formula XXXVIII:

Yield filling rate (gr/day)—The rate of grain filling was calculated by dividing grains Yield by grain fill duration. Formula XXXIX:

Yield per dunam/water until tan (kg/lit)—Calculated by dividing Grains yield per dunam by water used for irrigation until tan. Formula XXXX:

Yield per plant/water until tan (gr/lit)—Calculated by dividing Grains yield per plant by water used for irrigation until tan. Formula XXXXI:

Yield per dunam/water until maturity (gr/lit)—Calculated by dividing grains yield per dunam by the water used for irrigation up to maturity. Formula XXXXII:

Vegetative dry weight per plant/water until maturity (gr/lit): Calculated by dividing vegetative dry weight per plant (excluding roots and reproductive organs) at harvest by the water used for irrigation up to maturity. Formula XXXXIII:

Total dry matter per plant/water until maturity (gr/lit): Calculated by dividing total dry matter at harvest (vegetative and reproductive, excluding roots) per plant by the water used for irrigation up to maturity. Formula XXXXIV:

Total dry matter per plant/water until maturity (gr/lit): Calculated by dividing total dry matter at flowering (vegetative and reproductive, excluding roots) per plant by the water used for irrigation up to flowering. Formula XXXXV:

Heads index (ratio): Average heads weight/(Average vegetative dry weight per plant plus Average heads weight per plant). Formula XXXXVI:

Yield/SPAD (kg/SPAD units)—Calculated by dividing grains yield by average SPAD measurements per plot. Formula XXXXVII:

Stem water content (percentage)—stems were collected and fresh weight (FW) was weighted. Then the stems were oven dry and dry weight (DW) was recorded. Stems dry weight was divided by stems fresh weight, subtracted from 1 and multiplied by 100. Formula XXXXVIII:

Leaf water content (percentage)—Leaves were collected and fresh weight (FW) was weighted. Then the leaves were oven dry and dry weight (DW) was recorded. Leaves dry weight was divided by leaves fresh weight, subtracted from 1 and multiplied by 100. Formula XXXXIX:

stem volume (cm^3)—The average stem volume was calculated by multiplying the average stem length by (3.14*((mean lower and upper stem width)/2)^2). Formula L:

NUE—is the ratio between total grain yield per total nitrogen (applied+content) in soil. Formula LI:

NUpE—Is the ratio between total plant N content per total N (applied+content) in soil. Formula LII:

Total NUtE—Is the ratio between total dry matter per N content of total dry matter. Formula LIII:

Stem density—is the ratio between internode dry weight and internode volume. Formula LIV:

Grain NUtE—Is the ratio between grain yield per N content of total dry matter Formula LV:

N harvest index (Ratio)—Is the ratio between nitrogen content in grain per plant and the nitrogen of whole plant at harvest. Formula LVI:

Biomass production efficiency—is the ratio between plant biomass and total shoot N. Formula LVII:

Harvest index (plot) (ratio)—Average seed yield per plot/Average dry weight per plot. Formula LVIII:

Relative growth rate of petiole relative area—Regression coefficient of petiole realtive area along time course (measured in cm2 per day). Formula LIX:

Yield per spike filling rate (gr/day)—spike filling rate was calculated by dividing grains yield per spike to grain fill duration. Formula LX:

Yield per micro plots filling rate (gr/day)—micro plots fiiling rate was calculated by dividing grains yield per micro plots to grain fill duration. Formula LXI:

Grains yield per hectare [ton/ha]—all spikes per plot were harvested threshed and grains were weighted after sun dry. The resulting value was divided by the number of square meters and multiplied by 10,000 (10,000 square meters=1 hectare). Formula LXII:

Total dry matter (for Maize)=Normalized ear weight per plant+vegetative dry weight. Formula LXIII:

$$\text{Agronomical } NUE = \frac{\text{Yield per plant (Kg.)}^{X\ Nitrogen\ Fertilization} - \text{Yield per plant (Kg.)}^{0\%\ Nitrogen\ Fertilization}}{Fertilizer^X}$$

Formula LXIV

Harvest Index (brachypodium)=Average grain weight/average dry (vegetative+spikelet) weight per plant. Formula LXV:

Harvest Index for Sorghum* (* when the plants were not dried)=FW (fresh weight) Heads/(FW Heads+FW Plants) Formula LXVI:

Grain protein concentration—Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Fiber length—Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (cottoninc (dot) com/ClassificationofCotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods. According to some embodiments of the invention, the oil comprises a seed oil.

According to some embodiments of the invention, the oil comprises a vegetative portion oil (oil of the vegetative portion of the plant).

According to some embodiments of the invention, the plant cell forms a part of a plant.

According to another embodiment of the present invention, there is provided a food or feed comprising the plants or a portion thereof of the present invention.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Experimental and Bioinformatics Methods

RNA extraction—Tissues growing at various growth conditions (as described below) were sampled and RNA was extracted using TRIzol Reagent from Invitrogen [invitrogen (dot)com/content (dot)cfm?pageid=469]. Approximately 30-50 mg of tissue was taken from samples. The weighed tissues were ground using pestle and mortar in liquid nitrogen and resuspended in 500 μl of TRIzol Reagent. To the homogenized lysate, 100 μl of chloroform was added followed by precipitation using isopropanol and two washes with 75% ethanol. The RNA was eluted in 30 μl of RNase-free water. RNA samples were cleaned up using Qiagen's RNeasy minikit clean-up protocol as per the manufacturer's protocol (QIAGEN Inc, Calif. USA). For convenience, each micro-array expression information tissue type has received an expression Set ID.

Correlation analysis—was performed for selected genes according to some embodiments of the invention, in which the characterized parameters (measured parameters according to the correlation IDs) were used as "x axis" for correlation with the tissue transcriptome, which was used as the "Y axis". For each gene and measured parameter a correlation coefficient "R" was calculated (using Pearson correlation) along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) the phenotypic characteristic (e.g., improved yield, growth rate, nitrogen use efficiency, abiotic stress tolerance and the like).

Example 1

Identifying Genes which Improve Yield and Agronomical Important Traits in Plants The present inventors have identified polynucleotides which expression thereof in plants can increase yield, fiber yield, fiber quality, photosynthetic capacity, growth rate, vigor, biomass, oil content, abiotic stress tolerance (ABST), fertilizer use efficiency (FUE) such as nitrogen use efficiency (NUE), and water use efficiency (WUE) of a plant, as follows.

All nucleotide sequence datasets used here were originated from publicly available databases or from performing sequencing using the Solexa technology (e.g. Barley and Sorghum). Sequence data from 100 different plant species was introduced into a single, comprehensive database. Other information on gene expression, protein annotation, enzymes and pathways were also incorporated.

Major databases used include:

Genomes

*Arabidopsis* genome [TAIR genome version 6 (*arabidopsis*(dot)org/)]

Rice genome [IRGSP build 4.0 (rgp(dot)dna(dot)affrc (dot)go(dot)jp/IRGSP/)].

Poplar [*Populus trichocarpa* release 1.1 from JGI (assembly release v1.0) (genome(dot)jgi-psf(dot)org/)]

Brachypodium [JGI 4x assembly, brachpodium(dot)org)]

Soybean [DOE-JGI SCP, version Glyma0 (phytozome (dot)net/)]

Grape [French-Italian Public Consortium for Grapevine Genome Characterization grapevine genome (genoscope(dot)cns(dot)fr/)]

Castobean [TIGR/J Craig Venter Institute 4x assembly [msc(dot)jcvi(dot)org/r *communis*]

Sorghum [DOE-JGI SCP, version Sbil [phytozome(dot) net/)].

Partially assembled genome of Maize [maizesequence (dot)org/]

Expressed EST and mRNA Sequences were Extracted from the Following Databases:

GenBank (ncbi(dot)nlm(dot)nih(dot)gov/dbEST)

RefSeq (ncbi(dot)nlm(dot)nih(dot)gov/RefSeq/).

TAR (arabidopsis(dot)org/).
Protein and pathway databases
Uniprot [uniprot(dot)org/].
AraCyc [arabidopsis(dot)org/biocyc/index(dot)jsp].
ENZYME [expasy(dot)org/enzyme/].
Microarray datasets were downloaded from:
GEO (ncbi(dot)nlm.(dot)nih(dot)gov/geo/)
TAR (Arabidopsis(dot)org/).
Proprietary microarray data (WO2008/122980).
QTL and SNPs information
Gramene [gramene(dot)org/qt1/].
Panzea [panzea(dot)org/index(dot)html].

Database Assembly—was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST clustering and gene assembly—For gene clustering and assembly of organisms with available genome sequence data (arabidopsis, rice, castorbean, grape, brachypodium, poplar, soybean, sorghum) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene annotation—Predicted genes and proteins were annotated as follows:

Blast search [blast(dot)ncbi(dot)nlm(dot)nih(dot)gov/Blast(dot)cgi] against all plant UniProt [uniprot(dot)org/] sequences was performed. Open reading frames of each putative transcript were analyzed and longest ORF with higher number of homologues was selected as predicted protein of the transcript. The predicted proteins were analyzed by InterPro [ebi(dot)ac(dot)uk/interpro/].

Blast against proteins from AraCyc and ENZYME databases was used to map the predicted transcripts to AraCyc pathways.

Predicted proteins from different species were compared using blast algorithm [ncbi(dot)nlm(dot)nih(dot)gov/Blast(dot)cgi] to validate the accuracy of the predicted protein sequence, and for efficient detection of orthologs.

Gene expression profiling—Several data sources were exploited for gene expression profiling, namely microarray data and digital expression profile (see below). According to gene expression profile, a correlation analysis was performed to identify genes which are co-regulated under different development stages and environmental conditions and associated with different phenotypes.

Publicly available microarray datasets were downloaded from TAR and NCBI GEO sites, renormalized, and integrated into the database. Expression profiling is one of the most important resource data for identifying genes important for yield.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomeic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags, that assembled into 67,477 unigenes (32,357 singletons and 35,120 contigs). Analysis of the data obtained against the Cucurbit Genomics Database [icugi(dot)org/] confirmed the accuracy of the sequencing and assembly. Expression patterns of selected genes fitted well their qRT-PCR data.

Overall, 220 genes (SEQ ID NOs: 1-473 for polynucleotides and SEQ ID NOs: 474-760 for polypeptides) were identified to have a major impact on plant yield, growth rate, photosynthetic capacity, vigor, biomass, growth rate, oil content, abiotic stress tolerance, nitrogen use efficiency, water use efficiency and fertilizer use efficiency when expression thereof is increased in plants (e.g., in plants over-expressing the polynucleotides/polypeptides). The identified genes, their curated polynucleotide and polypeptide sequences, as well as their updated sequences according to GenBank database are summarized in Table 1, hereinbelow.

TABLE 1

Identified genes for increasing yield, growth rate, vigor, biomass, growth rate, oil content, abiotic stress tolerance, nitrogen use efficiency, water use efficiency and fertilizer use efficiency of a plant

| Gene Name | Organism/Cluster Name | Polyn. SEQ ID NO: | Polyp. SEQ ID NO: |
|---|---|---|---|
| LYM1010 | barley\|10v2\|BE411105 | 1 | 474 |
| LYM1011 | barley\|10v2\|BE421247 | 2 | 475 |
| LYM1012 | barley\|10v2\|BE456034 | 3 | 476 |
| LYM1013 | barley\|10v2\|BE601902 | 4 | 477 |
| LYM1014 | barley\|10v2\|BF621691 | 5 | 478 |
| LYM1015 | barley\|10v2\|BF625619 | 6 | 479 |
| LYM1016 | barley\|12v1\|AJ303113 | 7 | 480 |
| LYM1017 | barley\|12v1\|AJ460503 | 8 | 481 |
| LYM1018 | barley\|12v1\|AJ462240 | 9 | 482 |
| LYM1019 | barley\|12v1\|AJ462593 | 10 | 483 |
| LYM1020 | barley\|12v1\|AJ465036 | 11 | 484 |
| LYM1021 | barley\|12v1\|AJ472697 | 12 | 485 |
| LYM1022 | barley\|12v1\|AJ476944 | 13 | 486 |
| LYM1023 | barley\|12v1\|AV832509 | 14 | 487 |
| LYM1024 | barley\|12v1\|AV832821 | 15 | 488 |
| LYM1025 | barley\|12v1\|AV833067 | 16 | 489 |
| LYM1026 | barley\|12v1\|AV833535 | 17 | 490 |
| LYM1027 | barley\|12v1\|AV835246 | 18 | 491 |
| LYM1028 | barley\|12v1\|AV836250 | 19 | 492 |
| LYM1029 | barley\|12v1\|AV919419 | 20 | 493 |
| LYM1030 | barley\|12v1\|AV932314 | 21 | 494 |
| LYM1031 | barley\|12v1\|AV932367 | 22 | 495 |
| LYM1032 | barley\|12v1\|AV932518 | 23 | 496 |
| LYM1033 | barley\|12v1\|BE215699 | 24 | 497 |
| LYM1034 | barley\|12v1\|BE412462 | 25 | 498 |
| LYM1035 | barley\|12v1\|BE413472 | 26 | 499 |
| LYM1036 | barley\|12v1\|BE420953 | 27 | 500 |
| LYM1037 | barley\|12v1\|BE420982 | 28 | 501 |
| LYM1038 | barley\|12v1\|BE421696 | 29 | 502 |
| LYM1040 | barley\|12v1\|BE437999 | 30 | 503 |
| LYM1041 | barley\|12v1\|BE438048 | 31 | 504 |
| LYM1042 | barley\|12v1\|BF255185 | 32 | 505 |
| LYM1043 | barley\|12v1\|BF259663 | 33 | 506 |
| LYM1044 | barley\|12v1\|BF617642 | 34 | 507 |
| LYM1046 | barley\|12v1\|BF621200 | 35 | 508 |
| LYM1047 | barley\|12v1\|BF623265 | 36 | 509 |
| LYM1048 | barley\|12v1\|BF624214 | 37 | 510 |
| LYM1049 | barley\|12v1\|BF625372 | 38 | 511 |
| LYM1051 | barley\|12v1\|BG309076 | 39 | 512 |
| LYM1052 | barley\|12v1\|BG414431 | 40 | 513 |
| LYM1053 | barley\|12v1\|BI947802 | 41 | 514 |
| LYM1054 | barley\|12v1\|BI949533 | 42 | 515 |
| LYM1055 | barley\|12v1\|BI949678 | 43 | 516 |
| LYM1056 | barley\|12v1\|BI950318 | 44 | 517 |
| LYM1057 | barley\|12v1\|BI951064 | 45 | 518 |
| LYM1058 | barley\|12v1\|BI951865 | 46 | 519 |
| LYM1059 | barley\|12v1\|BI952771 | 47 | 520 |
| LYM1060 | barley\|12v1\|BI953477 | 48 | 521 |
| LYM1061 | barley\|12v1\|BI953521 | 49 | 522 |
| LYM1062 | barley\|12v1\|BI954539 | 50 | 523 |
| LYM1063 | barley\|12v1\|BI955576 | 51 | 524 |
| LYM1064 | barley\|12v1\|BI956170 | 52 | 525 |
| LYM1065 | barley\|12v1\|BI956211 | 53 | 526 |
| LYM1066 | barley\|12v1\|BJ448998 | 54 | 527 |
| LYM1068 | barley\|12v1\|BJ469847 | 55 | 528 |
| LYM1069 | barley\|12v1\|BLYCPPHSYS | 56 | 529 |
| LYM1070 | barley\|12v1\|BQ465115 | 57 | 530 |
| LYM1071 | barley\|12v1\|BU990128 | 58 | 531 |
| LYM1072 | barley\|12v1\|BU991227 | 59 | 532 |
| LYM1073 | barley\|12v1\|CA023266 | 60 | 533 |
| LYM1074 | barley\|12v1\|CB875234 | 61 | 534 |
| LYM1075 | barley\|12v1\|CX627609 | 62 | 535 |
| LYM1076 | barley\|12v1\|DN160741 | 63 | 536 |
| LYM1078 | brachypodium\|12v1\|BRADI1G20385 | 64 | 537 |
| LYM1079 | brachypodium\|12v1\|BRADI1G23900 | 65 | 538 |
| LYM1082 | brachypodium\|12v1\|BRADI1G69180 | 66 | 539 |
| LYM1084 | brachypodium\|12v1\|BRADI1G78710 | 67 | 540 |
| LYM1085 | brachypodium\|12v1\|BRADI2G15900 | 68 | 541 |
| LYM1086 | brachypodium\|12v1\|BRADI2G21837 | 69 | 542 |
| LYM1087 | brachypodium\|12v1\|BRADI2G26280 | 70 | 543 |
| LYM1088 | brachypodium\|12v1\|BRADI2G41510T2 | 71 | 544 |
| LYM1089 | brachypodium\|12v1\|BRADI2G51480 | 72 | 545 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Organism/Cluster Name | Polyn. SEQ ID NO: | Polyp. SEQ ID NO: |
|---|---|---|---|
| LYM1090 | brachypodium|12v1|BRADI2G56310 | 73 | 546 |
| LYM1091 | brachypodium|12v1|BRADI3G28720 | 74 | 547 |
| LYM1092 | brachypodium|12v1|BRADI3G45820 | 75 | 548 |
| LYM1093 | brachypodium|12v1|BRADI3G55550 | 76 | 549 |
| LYM1094 | brachypodium|12v1|BRADI4G01140 | 77 | 550 |
| LYM1095 | brachypodium|12v1|BRADI4G29320 | 78 | 551 |
| LYM1096 | brachypodium|12v1|BRADI4G29780 | 79 | 552 |
| LYM1097 | brachypodium|12v1|BRADI4G31900T2 | 80 | 553 |
| LYM1098 | brachypodium|12v1|BRADI5G13190 | 81 | 554 |
| LYM1099 | brachypodium|12v1|BRADI5G25760 | 82 | 555 |
| LYM1100 | foxtail_millet|11v3|EC612472 | 83 | 556 |
| LYM1101 | foxtail_millet|11v3|EC612946 | 84 | 557 |
| LYM1102 | foxtail_millet|11v3|GT091058 | 85 | 558 |
| LYM1103 | foxtail_millet|11v3|PHY7SI000771M | 86 | 559 |
| LYM1104 | foxtail_millet|11v3|PHY7SI001398M | 87 | 560 |
| LYM1105 | foxtail_millet|11v3|PHY7SI002608M | 88 | 561 |
| LYM1106 | foxtail_millet|11v3|PHY7SI003001M | 89 | 562 |
| LYM1107 | foxtail_millet|11v3|PHY7SI006370M | 90 | 563 |
| LYM1108 | foxtail_millet|11v3|PHY7SI006690M | 91 | 564 |
| LYM1109 | foxtail_millet|11v3|PHY7SI010388M | 92 | 565 |
| LYM1110 | foxtail_millet|11v3|PHY7SI010853M | 93 | 566 |
| LYM1111 | foxtail_millet|11v3|PHY7SI014287M | 94 | 567 |
| LYM1112 | foxtail_millet|11v3|PHY7SI016985M | 95 | 568 |
| LYM1113 | foxtail_millet|11v3|PHY7SI017913M | 96 | 569 |
| LYM1114 | foxtail_millet|11v3|PHY7SI020310M | 97 | 570 |
| LYM1115 | foxtail_millet|11v3|PHY7SI020693M | 98 | 571 |
| LYM1116 | foxtail_millet|11v3|PHY7SI020984M | 99 | 572 |
| LYM1117 | foxtail_millet|11v3|PHY7SI023427M | 100 | 573 |
| LYM1118 | foxtail_millet|11v3|PHY7SI026065M | 101 | 574 |
| LYM1119 | foxtail_millet|11v3|PHY7SI029337M | 102 | 575 |
| LYM1120 | foxtail_millet|11v3|PHY7SI030030M | 103 | 576 |
| LYM1121 | foxtail_millet|11v3|PHY7SI033845M | 104 | 577 |
| LYM1122 | foxtail_millet|11v3|PHY7SI033950M | 105 | 578 |
| LYM1123 | foxtail_millet|11v3|PHY7SI034443M | 106 | 579 |
| LYM1124 | foxtail_millet|11v3|PHY7SI034927M | 107 | 580 |
| LYM1125 | foxtail_millet|11v3|PHY7SI036157M | 108 | 581 |
| LYM1126 | foxtail_millet|11v3|PHY7SI036407M | 109 | 582 |
| LYM1127 | foxtail_millet|11v3|PHY7SI037176M | 110 | 583 |
| LYM1128 | foxtail_millet|11v3|PHY7SI039767M | 111 | 584 |
| LYM1129 | maize|10v1|AA054811 | 112 | 585 |
| LYM1130 | maize|10v1|AA979759 | 113 | 586 |
| LYM1131 | maize|10v1|AI001351 | 114 | 587 |
| LYM1132 | maize|10v1|AI396444 | 115 | 588 |
| LYM1133 | maize|10v1|AI600333 | 116 | 589 |
| LYM1134 | maize|10v1|AI621954 | 117 | 590 |
| LYM1136 | maize|10v1|AI666204 | 118 | 591 |
| LYM1137 | maize|10v1|AI770430 | 119 | 592 |
| LYM1138 | maize|10v1|AI770478 | 120 | 593 |
| LYM1139 | maize|10v1|AI855153 | 121 | 594 |
| LYM1140 | maize|10v1|AI901707 | 122 | 595 |
| LYM1141 | maize|10v1|AI920541 | 123 | 596 |
| LYM1142 | maize|10v1|AI941641 | 124 | 597 |
| LYM1143 | maize|10v1|AI947474 | 125 | 598 |
| LYM1146 | maize|10v1|AW017808 | 126 | 599 |
| LYM1149 | maize|10v1|AW171826 | 127 | 600 |
| LYM1151 | maize|10v1|AW313252 | 128 | 601 |
| LYM1152 | maize|10v1|AW438140 | 129 | 602 |
| LYM1153 | maize|10v1|AW498006 | 130 | 603 |
| LYM1154 | maize|10v1|AW499246 | 131 | 604 |
| LYM1155 | maize|10v1|AW566480 | 132 | 605 |
| LYM1156 | maize|10v1|AW600668 | 133 | 606 |
| LYM1157 | maize|10v1|BE056858 | 134 | 607 |
| LYM1158 | maize|10v1|BE511433 | 135 | 608 |
| LYM1159 | maize|10v1|BE640016 | 136 | 609 |
| LYM1160 | maize|10v1|BG320172 | 137 | 610 |
| LYM1161 | maize|10v1|BG320248 | 138 | 611 |
| LYM1162 | maize|10v1|BG354201 | 139 | 612 |
| LYM1163 | maize|10v1|BG462317 | 140 | 613 |
| LYM1164 | maize|10v1|BG833142 | 141 | 614 |
| LYM1165 | maize|10v1|BG836953 | 142 | 615 |
| LYM1167 | maize|10v1|BM073386 | 143 | 616 |
| LYM1168 | maize|10v1|BM074116 | 144 | 617 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Organism/Cluster Name | Polyn. SEQ ID NO: | Polyp. SEQ ID NO: |
|---|---|---|---|
| LYM1169 | maize\|10v1\|BM336987 | 145 | 618 |
| LYM1170 | maize\|10v1\|BM379348 | 146 | 619 |
| LYM1171 | maize\|10v1\|BM498926 | 147 | 620 |
| LYM1172 | maize\|10v1\|BQ538346 | 148 | 621 |
| LYM1173 | maize\|10v1\|CA401866 | 149 | 622 |
| LYM1174 | maize\|10v1\|CD433365 | 150 | 623 |
| LYM1175 | maize\|10v1\|CD651832 | 151 | 624 |
| LYM1176 | maize\|10v1\|CD943536 | 152 | 625 |
| LYM1177 | maize\|10v1\|CD964979 | 153 | 626 |
| LYM1178 | maize\|10v1\|CF028527 | 154 | 627 |
| LYM1179 | maize\|10v1\|CF046250 | 155 | 628 |
| LYM1180 | maize\|10v1\|CF244711 | 156 | 629 |
| LYM1181 | maize\|10v1\|T15274 | 157 | 630 |
| LYM1182 | maize\|10v1\|T20342 | 158 | 631 |
| LYM1183 | maize\|10v1\|T20362 | 159 | 632 |
| LYM1184 | maize\|gb170\|AI586584 | 160 | 633 |
| LYM1185 | maize\|gb170\|AI967089 | 161 | 634 |
| LYM1186 | maize\|gb170\|AW267345 | 162 | 635 |
| LYM1187 | maize\|gb170\|CD997839 | 163 | 636 |
| LYM1188 | rice\|11v1\|AU065865 | 164 | 637 |
| LYM1189 | rice\|11v1\|AU093411 | 165 | 638 |
| LYM1190 | rice\|11v1\|AU172407 | 166 | 639 |
| LYM1191 | rice\|11v1\|BI805353 | 167 | 640 |
| LYM1192 | rice\|11v1\|BI806487 | 168 | 641 |
| LYM1193 | rice\|11v1\|BI812921 | 169 | 642 |
| LYM1194 | rice\|11v1\|CA762027 | 170 | 643 |
| LYM1195 | sorghum\|12v1\|AW677825 | 171 | 644 |
| LYM1201 | sorghum\|12v1\|SB01G005360 | 172 | 645 |
| LYM1202 | sorghum\|12v1\|SB01G006060 | 173 | 646 |
| LYM1203 | sorghum\|12v1\|SB01G023320 | 174 | 647 |
| LYM1204 | sorghum\|12v1\|SB01G046820 | 175 | 648 |
| LYM1205 | sorghum\|12v1\|SB02G005630 | 176 | 649 |
| LYM1206 | sorghum\|12v1\|SB02G028130 | 177 | 650 |
| LYM1207 | sorghum\|12v1\|SB03G011260 | 178 | 651 |
| LYM1208 | sorghum\|12v1\|SB03G012430 | 179 | 652 |
| LYM1209 | sorghum\|12v1\|SB03G043920 | 180 | 653 |
| LYM1210 | sorghum\|12v1\|SB06G030260 | 181 | 654 |
| LYM1211 | sorghum\|12v1\|SB09G006520 | 182 | 655 |
| LYM1212 | sorghum\|12v1\|SB09G019550 | 183 | 656 |
| LYM1213 | sorghum\|12v1\|SB09G026150 | 184 | 657 |
| LYM1214 | sorghum\|12v1\|SB10G006840 | 185 | 658 |
| LYM1215 | sorghum\|13v2\|JGIV2SB13002974 | 186 | 659 |
| LYM1216 | soybean\|11v1\|GLYMA03G35460 | 187 | 660 |
| LYM1217 | soybean\|11v1\|GLYMA06G11380 | 188 | 661 |
| LYM1218 | soybean\|11v1\|GLYMA07G03580 | 189 | 662 |
| LYM1219 | soybean\|11v1\|GLYMA08G19950 | 190 | 663 |
| LYM1220 | soybean\|11v1\|GLYMA09G32550 | 191 | 664 |
| LYM1221 | soybean\|11v1\|GLYMA13G09620 | 192 | 665 |
| LYM1222 | soybean\|11v1\|GLYMA13G17510 | 193 | 666 |
| LYM1223 | soybean\|11v1\|GLYMA13G21640 | 194 | 667 |
| LYM1224 | soybean\|11v1\|GLYMA13G39770 | 195 | 668 |
| LYM1225 | soybean\|11v1\|GLYMA18G52430 | 196 | 669 |
| LYM1226 | soybean\|11v1\|GLYMA19G28920 | 197 | 670 |
| LYM1227 | soybean\|11v1\|GLYMA20G36230 | 198 | 671 |
| LYM1228 | tomato\|11v1\|AA824906 | 199 | 672 |
| LYM1229 | tomato\|11v1\|AF153277 | 200 | 673 |
| LYM1230 | tomato\|11v1\|AW034456 | 201 | 674 |
| LYM1231 | tomato\|11v1\|AW617278 | 202 | 675 |
| LYM1232 | tomato\|11v1\|BG136313 | 203 | 676 |
| LYM1233 | tomato\|11v1\|BG734868 | 204 | 677 |
| LYM1234 | barley\|12v1\|BE420804 | 205 | 678 |
| LYM1235 | brachypodium\|12v1\|BRADI1G15290 | 206 | 679 |
| LYM1236 | brachypodium\|12v1\|BRADI5G10880 | 207 | 680 |
| LYM1237 | brachypodium\|12v1\|BRADI5G10920 | 208 | 681 |
| LYM1239 | sorghum\|12v1\|SB01G004200 | 209 | 682 |
| LYM1240 | tomato\|11v1\|AW154852 | 210 | 683 |
| LYM1032_H1 | wheat\|12v3\|CA635514 | 211 | 684 |
| LYM1058_H4 | maize\|10v1\|AI649819 | 212 | 685 |
| LYM1059_H7 | maize\|10v1\|AI977980 | 213 | 686 |
| LYM1064_H5 | rice\|13v2\|BE228289 | 214 | 687 |
| LYM1076_H4 | rice\|11v1\|CA755245 | 215 | 688 |
| LYM1091_H5 | maize\|10v1\|AW056217 | 216 | 689 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Organism/Cluster Name | Polyn. SEQ ID NO: | Polyp. SEQ ID NO: |
|---|---|---|---|
| LYM1101_H3 | sorghum\|12v1\|SB09G025690 | 217 | 690 |
| LYM1105_H2 | sorghum\|12v1\|SB03G036770 | 218 | 691 |
| LYM1164_H1 | sorghum\|12v1\|SB02G009120 | 219 | 692 |
| LYM1196 | sorghum\|12v1\|CF480531 | 220 | — |
| LYM1019 | barley\|12v1\|AJ462593 | 221 | 483 |
| LYM1024 | barley\|12v1\|AV832821 | 223 | 488 |
| LYM1030 | barley\|12v1\|AV932314 | 225 | 494 |
| LYM1033 | barley\|12v1\|BE215699 | 226 | 497 |
| LYM1037 | barley\|12v1\|BE420982 | 227 | 501 |
| LYM1046 | barley\|12v1\|BF621200 | 228 | 508 |
| LYM1057 | barley\|12v1\|BI951064 | 230 | 518 |
| LYM1060 | barley\|12v1\|BI953477 | 231 | 521 |
| LYM1066 | barley\|12v1\|BJ448998 | 232 | 527 |
| LYM1078 | brachypodium\|12v1\|BRADI1G20385 | 235 | 537 |
| LYM1082 | brachypodium\|12v1\|BRADI1G69180 | 236 | 539 |
| LYM1086 | brachypodium\|12v1\|BRADI2G21837 | 238 | 542 |
| LYM1088 | brachypodium\|12v1\|BRADI2G41510T2 | 239 | 544 |
| LYM1096 | brachypodium\|12v1\|BRADI4G29780 | 240 | 552 |
| LYM1106 | foxtail_millet\|11v3\|PHY7SI003001M | 242 | 562 |
| LYM1107 | foxtail_millet\|11v3\|PHY7SI006370M | 243 | 563 |
| LYM1113 | foxtail_millet\|11v3\|PHY7SI017913M | 244 | 569 |
| LYM1126 | foxtail_millet\|11v3\|PHY7SI036407M | 247 | 582 |
| LYM1155 | maize\|10v1\|AW566480 | 251 | 605 |
| LYM1193 | rice\|11v1\|BI812921 | 255 | 642 |
| LYM1205 | sorghum\|12v1\|SB02G005630 | 256 | 649 |
| LYM1226 | soybean\|11v1\|GLYMA19G28920 | 262 | 670 |
| LYM1228 | tomato\|11v1\|AA824906 | 263 | 672 |
| LYM1076_H4 | rice\|11v1\|CA755245 | 266 | 688 |
| LYM1091_H5 | maize\|10v1\|AW056217 | 267 | 689 |
| LYM1022 | barley\|12v1\|AJ476944 | 222 | 693 |
| LYM1029 | barley\|12v1\|AV919419 | 224 | 694 |
| LYM1052 | barley\|12v1\|BG414431 | 229 | 695 |
| LYM1071 | barley\|12v1\|BU990128 | 233 | 696 |
| LYM1074 | barley\|12v1\|CB875234 | 234 | 697 |
| LYM1085 | brachypodium\|12v1\|BRADI2G15900 | 237 | 698 |
| LYM1098 | brachypodium\|12v1\|BRADI5G13190 | 241 | 699 |
| LYM1119 | foxtail_millet\|11v3\|PHY7SI029337M | 245 | 700 |
| LYM1125 | foxtail_millet\|11v3\|PHY7SI036157M | 246 | 701 |
| LYM1138 | maize\|10v1\|AI770478 | 248 | 702 |
| LYM1140 | maize\|10v1\|AI901707 | 249 | 703 |
| LYM1142 | maize\|10v1\|AI941641 | 250 | 704 |
| LYM1163 | maize\|10v1\|BG462317 | 252 | 705 |
| LYM1177 | maize\|10v1\|CD964979 | 253 | 706 |
| LYM1186 | maize\|gb170\|AW267345 | 254 | 707 |
| LYM1208 | sorghum\|12v1\|SB03G012430 | 257 | 708 |
| LYM1214 | sorghum\|12v1\|SB10G006840 | 258 | 709 |
| LYM1215 | sorghum\|12v1\|SB12V1CRP024405 | 259 | 710 |
| LYM1221 | soybean\|11v1\|GLYMA13G09620 | 260 | 711 |
| LYM1222 | soybean\|11v1\|GLYMA13G17510 | 261 | 712 |
| LYM1234 | barley\|12v1\|BE420804 | 264 | 713 |
| LYM1064_H5 | rice\|11v1\|BE228289 | 265 | 714 |
| LYM1195 | sorghum\|12v1\|AW677825 | 268 | — |
| LYM1010 | barley\|10v2\|BE411105 | 269 | 474 |
| LYM1011 | barley\|10v2\|BE421247 | 270 | 475 |
| LYM1012 | barley\|10v2\|BE456034 | 271 | 476 |
| LYM1014 | barley\|10v2\|BF621691 | 273 | 478 |
| LYM1015 | barley\|10v2\|BF625619 | 274 | 479 |
| LYM1016 | barley\|12v1\|AJ303113 | 275 | 480 |
| LYM1017 | barley\|12v1\|AJ460503 | 276 | 481 |
| LYM1019 | barley\|12v1\|AJ462593 | 278 | 483 |
| LYM1021 | barley\|12v1\|AJ472697 | 280 | 485 |
| LYM1024 | barley\|12v1\|AV832821 | 283 | 488 |
| LYM1025 | barley\|12v1\|AV833067 | 284 | 489 |
| LYM1026 | barley\|12v1\|AV833535 | 285 | 490 |
| LYM1027 | barley\|12v1\|AV835246 | 286 | 491 |
| LYM1028 | barley\|12v1\|AV836250 | 287 | 492 |
| LYM1029 | barley\|12v1\|AV919419 | 288 | 493 |
| LYM1033 | barley\|12v1\|BE215699 | 290 | 497 |
| LYM1035 | barley\|12v1\|BE413472 | 292 | 499 |
| LYM1036 | barley\|12v1\|BE420953 | 293 | 500 |
| LYM1037 | barley\|12v1\|BE420982 | 294 | 501 |
| LYM1038 | barley\|12v1\|BE421696 | 295 | 502 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Organism/Cluster Name | Polyn. SEQ ID NO: | Polyp. SEQ ID NO: |
|---|---|---|---|
| LYM1040 | barley\|12v1\|BE437999 | 296 | 503 |
| LYM1041 | barley\|12v1\|BE438048 | 297 | 504 |
| LYM1042 | barley\|12v1\|BF255185 | 298 | 505 |
| LYM1043 | barley\|12v1\|BF259663 | 299 | 506 |
| LYM1044 | barley\|12v1\|BF617642 | 300 | 507 |
| LYM1046 | barley\|12v1\|BF621200 | 301 | 508 |
| LYM1047 | barley\|12v1\|BF623265 | 302 | 509 |
| LYM1049 | barley\|12v1\|BF625372 | 303 | 511 |
| LYM1054 | barley\|12v1\|BI949533 | 307 | 515 |
| LYM1055 | barley\|12v1\|BI949678 | 308 | 516 |
| LYM1056 | barley\|12v1\|BI950318 | 309 | 517 |
| LYM1057 | barley\|12v1\|BI951064 | 310 | 518 |
| LYM1060 | barley\|12v1\|BI953477 | 311 | 521 |
| LYM1061 | barley\|12v1\|BI953521 | 312 | 522 |
| LYM1062 | barley\|12v1\|BI954539 | 313 | 523 |
| LYM1063 | barley\|12v1\|BI955576 | 314 | 524 |
| LYM1065 | barley\|12v1\|BI956211 | 315 | 526 |
| LYM1066 | barley\|12v1\|BJ448998 | 316 | 527 |
| LYM1068 | barley\|12v1\|BJ469847 | 317 | 528 |
| LYM1069 | barley\|12v1\|BLYCPPHSYS | 318 | 529 |
| LYM1072 | barley\|12v1\|BU991227 | 321 | 532 |
| LYM1073 | barley\|12v1\|CA023266 | 322 | 533 |
| LYM1074 | barley\|12v1\|CB875234 | 323 | 534 |
| LYM1079 | brachypodium\|12v1\|BRADI1G23900 | 326 | 538 |
| LYM1082 | brachypodium\|12v1\|BRADI1G69180 | 327 | 539 |
| LYM1084 | brachypodium\|12v1\|BRADI1G78710 | 328 | 540 |
| LYM1087 | brachypodium\|12v1\|BRADI2G26280 | 331 | 543 |
| LYM1088 | brachypodium\|12v1\|BRADI2G41510T2 | 332 | 544 |
| LYM1089 | brachypodium\|12v1\|BRADI2G51480 | 333 | 545 |
| LYM1092 | brachypodium\|12v1\|BRADI3G45820 | 335 | 548 |
| LYM1093 | brachypodium\|12v1\|BRADI3G55550 | 336 | 549 |
| LYM1095 | brachypodium\|12v1\|BRADI4G29320 | 338 | 551 |
| LYM1096 | brachypodium\|12v1\|BRADI4G29780 | 339 | 552 |
| LYM1097 | brachypodium\|12v1\|BRADI4G31900T2 | 340 | 553 |
| LYM1099 | brachypodium\|12v1\|BRADI5G25760 | 341 | 555 |
| LYM1100 | foxtail_millet\|11v3\|EC612472 | 342 | 556 |
| LYM1102 | foxtail_millet\|11v3\|GT091058 | 343 | 558 |
| LYM1103 | foxtail_millet\|11v3\|PHY7SI000771M | 344 | 559 |
| LYM1104 | foxtail_millet\|11v3\|PHY7SI001398M | 345 | 560 |
| LYM1106 | foxtail_millet\|11v3\|PHY7SI003001M | 346 | 562 |
| LYM1107 | foxtail_millet\|11v3\|PHY7SI006370M | 347 | 563 |
| LYM1108 | foxtail_millet\|11v3\|PHY7SI006690M | 348 | 564 |
| LYM1109 | foxtail_millet\|11v3\|PHY7SI010388M | 349 | 565 |
| LYM1110 | foxtail_millet\|11v3\|PHY7SI010853M | 350 | 566 |
| LYM1112 | foxtail_millet\|11v3\|PHY7SI016985M | 352 | 568 |
| LYM1113 | foxtail_millet\|11v3\|PHY7SI017913M | 353 | 569 |
| LYM1114 | foxtail_millet\|11v3\|PHY7SI020310M | 354 | 570 |
| LYM1115 | foxtail_millet\|11v3\|PHY7SI020693M | 355 | 571 |
| LYM1116 | foxtail_millet\|11v3\|PHY7SI020984M | 356 | 572 |
| LYM1117 | foxtail_millet\|11v3\|PHY7SI023427M | 357 | 573 |
| LYM1118 | foxtail_millet\|11v3\|PHY7SI026065M | 358 | 574 |
| LYM1120 | foxtail_millet\|11v3\|PHY7SI030030M | 359 | 576 |
| LYM1121 | foxtail_millet\|11v3\|PHY7SI033845M | 360 | 577 |
| LYM1122 | foxtail_millet\|11v3\|PHY7SI033950M | 361 | 578 |
| LYM1124 | foxtail_millet\|11v3\|PHY7SI034927M | 363 | 580 |
| LYM1126 | foxtail_millet\|11v3\|PHY7SI036407M | 365 | 582 |
| LYM1128 | foxtail_millet\|11v3\|PHY7SI039767M | 367 | 584 |
| LYM1129 | maize\|10v1\|AA054811 | 368 | 585 |
| LYM1132 | maize\|10v1\|AI396444 | 371 | 588 |
| LYM1133 | maize\|10v1\|AI600333 | 372 | 589 |
| LYM1134 | maize\|10v1\|AI621954 | 373 | 590 |
| LYM1136 | maize\|10v1\|AI666204 | 374 | 591 |
| LYM1137 | maize\|10v1\|AI770430 | 375 | 592 |
| LYM1138 | maize\|10v1\|AI770478 | 376 | 593 |
| LYM1139 | maize\|10v1\|AI855153 | 377 | 594 |
| LYM1140 | maize\|10v1\|AI901707 | 378 | 595 |
| LYM1141 | maize\|10v1\|AI920541 | 379 | 596 |
| LYM1146 | maize\|10v1\|AW017808 | 382 | 599 |
| LYM1149 | maize\|10v1\|AW171826 | 383 | 600 |
| LYM1151 | maize\|10v1\|AW313252 | 384 | 601 |
| LYM1152 | maize\|10v1\|AW438140 | 385 | 602 |
| LYM1153 | maize\|10v1\|AW498006 | 386 | 603 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Organism/Cluster Name | Polyn. SEQ ID NO: | Polyp. SEQ ID NO: |
|---|---|---|---|
| LYM1154 | maize\|10v1\|AW499246 | 387 | 604 |
| LYM1155 | maize\|10v1\|AW566480 | 388 | 605 |
| LYM1156 | maize\|10v1\|AW600668 | 389 | 606 |
| LYM1157 | maize\|10v1\|BE056858 | 390 | 607 |
| LYM1159 | maize\|10v1\|BE640016 | 392 | 609 |
| LYM1160 | maize\|10v1\|BG320172 | 393 | 610 |
| LYM1161 | maize\|10v1\|BG320248 | 394 | 611 |
| LYM1163 | maize\|10v1\|BG462317 | 395 | 613 |
| LYM1165 | maize\|10v1\|BG836953 | 396 | 615 |
| LYM1169 | maize\|10v1\|BM336987 | 399 | 618 |
| LYM1170 | maize\|10v1\|BM379348 | 400 | 619 |
| LYM1172 | maize\|10v1\|BQ538346 | 402 | 621 |
| LYM1174 | maize\|10v1\|CD433365 | 404 | 623 |
| LYM1175 | maize\|10v1\|CD651832 | 405 | 624 |
| LYM1178 | maize\|10v1\|CF028527 | 408 | 627 |
| LYM1179 | maize\|10v1\|CF046250 | 409 | 628 |
| LYM1180 | maize\|10v1\|CF244711 | 410 | 629 |
| LYM1181 | maize\|10v1\|T15274 | 411 | 630 |
| LYM1182 | maize\|10v1\|T20342 | 412 | 631 |
| LYM1183 | maize\|10v1\|T20362 | 413 | 632 |
| LYM1188 | rice\|11v1\|AU065865 | 418 | 637 |
| LYM1189 | rice\|11v1\|AU093411 | 419 | 638 |
| LYM1190 | rice\|11v1\|AU172407 | 420 | 639 |
| LYM1191 | rice\|11v1\|BI805353 | 421 | 640 |
| LYM1192 | rice\|11v1\|BI806487 | 422 | 641 |
| LYM1193 | rice\|11v1\|BIS12921 | 423 | 642 |
| LYM1194 | rice\|11v1\|CA762027 | 424 | 643 |
| LYM1195 | sorghum\|12v1\|AW677825 | 425 | 644 |
| LYM1201 | sorghum\|12v1\|SB01G005360 | 426 | 645 |
| LYM1202 | sorghum\|12v1\|SB01G006060 | 427 | 646 |
| LYM1206 | sorghum\|12v1\|SB02G028130 | 431 | 650 |
| LYM1207 | sorghum\|12v1\|SB03G011260 | 432 | 651 |
| LYM1208 | sorghum\|12v1\|SB03G012430 | 433 | 652 |
| LYM1209 | sorghum\|12v1\|SB03G043920 | 434 | 653 |
| LYM1210 | sorghum\|12v1\|SB06G030260 | 435 | 654 |
| LYM1211 | sorghum\|12v1\|SB09G006520 | 436 | 655 |
| LYM1212 | sorghum\|12v1\|SB09G019550 | 437 | 656 |
| LYM1213 | sorghum\|12v1\|SB09G026150 | 438 | 657 |
| LYM1214 | sorghum\|12v1\|SB10G006840 | 439 | 658 |
| LYM1215 | sorghum\|13v2\|JGIV2SB13002974 | 440 | 659 |
| LYM1216 | soybean\|11v1\|GLYMA03G35460 | 441 | 660 |
| LYM1217 | soybean\|11v1\|GLYMA06G11380 | 442 | 661 |
| LYM1218 | soybean\|11v1\|GLYMA07G03580 | 443 | 662 |
| LYM1219 | soybean\|11v1\|GLYMA08G19950 | 444 | 663 |
| LYM1220 | soybean\|11v1\|GLYMA09G32550 | 445 | 664 |
| LYM1221 | soybean\|11v1\|GLYMA13G09620 | 446 | 665 |
| LYM1223 | soybean\|11v1\|GLYMA13G21640 | 447 | 667 |
| LYM1224 | soybean\|11v1\|GLYMA13G39770 | 448 | 668 |
| LYM1225 | soybean\|11v1\|GLYMA18G52430 | 449 | 669 |
| LYM1226 | soybean\|11v1\|GLYMA19G28920 | 450 | 670 |
| LYM1227 | soybean\|11v1\|GLYMA20G36230 | 451 | 671 |
| LYM1228 | tomato\|11v1\|AA824906 | 452 | 672 |
| LYM1229 | tomato\|11v1\|AF153277 | 453 | 673 |
| LYM1230 | tomato\|11v1\|AW034456 | 454 | 674 |
| LYM1232 | tomato\|11v1\|BG136313 | 456 | 676 |
| LYM1233 | tomato\|11v1\|BG734868 | 457 | 677 |
| LYM1234 | barley\|12v1\|BE420804 | 458 | 678 |
| LYM1235 | brachypodium\|12v1\|BRADI1G15290 | 459 | 679 |
| LYM1239 | sorghum\|12v1\|SB01G004200 | 462 | 682 |
| LYM1058_H4 | maize\|10v1\|AI649819 | 465 | 685 |
| LYM1059_H7 | maize\|10v1\|AI977980 | 466 | 686 |
| LYM1064_H5 | rice\|13v2\|BE228289 | 467 | 687 |
| LYM1076_H4 | rice\|11v1\|CA755245 | 468 | 688 |
| LYM1091_H5 | maize\|10v1\|AW056217 | 469 | 689 |
| LYM1101_H3 | sorghum\|12v1\|SB09G025690 | 470 | 690 |
| LYM1105_H2 | sorghum\|12v1\|SB03G036770 | 471 | 691 |
| LYM1013 | barley\|10v2\|BE601902 | 272 | 715 |
| LYM1018 | barley\|12v1\|AJ462240 | 277 | 716 |
| LYM1020 | barley\|12v1\|AJ465036 | 279 | 717 |
| LYM1022 | barley\|12v1\|AJ476944 | 281 | 718 |
| LYM1023 | barley\|12v1\|AV832509 | 282 | 719 |
| LYM1030 | barley\|12v1\|AV932314 | 289 | 720 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Organism/Cluster Name | Polyn. SEQ ID NO: | Polyp. SEQ ID NO: |
|---|---|---|---|
| LYM1034 | barley\|12v1\|BE412462 | 291 | 721 |
| LYM1051 | barley\|12v1\|BG309076 | 304 | 722 |
| LYM1052 | barley\|12v1\|BG414431 | 305 | 723 |
| LYM1053 | barley\|12v1\|BI947802 | 306 | 724 |
| LYM1070 | barley\|12v1\|BQ465115 | 319 | 725 |
| LYM1071 | barley\|12v1\|BU990128 | 320 | 726 |
| LYM1075 | barley\|12v1\|CX627609 | 324 | 727 |
| LYM1078 | brachypodium\|12v1\|BRADI1G20385 | 325 | 728 |
| LYM1085 | brachypodium\|12v1\|BRADI2G15900 | 329 | 729 |
| LYM1086 | brachypodium\|12v1\|BRADI2G21837 | 330 | 730 |
| LYM1090 | brachypodium\|12v1\|BRADI2G56310 | 334 | 731 |
| LYM1094 | brachypodium\|12v1\|BRADI4G01140 | 337 | 732 |
| LYM1111 | foxtail_millet\|11v3\|PHY7SI014287M | 351 | 733 |
| LYM1123 | foxtail_millet\|11v3\|PHY7SI034443M | 362 | 734 |
| LYM1125 | foxtail_millet\|11v3\|PHY7SI036157M | 364 | 735 |
| LYM1127 | foxtail_millet\|11v3\|PHY7SI037176M | 366 | 736 |
| LYM1130 | maize\|10v1\|AA979759 | 369 | 737 |
| LYM1131 | maize\|10v1\|AI001351 | 370 | 738 |
| LYM1142 | maize\|10v1\|AI941641 | 380 | 739 |
| LYM1143 | maize\|10v1\|AI947474 | 381 | 740 |
| LYM1158 | maize\|10v1\|BE511433 | 391 | 741 |
| LYM1167 | maize\|10v1\|BM073386 | 397 | 742 |
| LYM1168 | maize\|10v1\|BM074116 | 398 | 743 |
| LYM1171 | maize\|10v1\|BM498926 | 401 | 744 |
| LYM1173 | maize\|10v1\|CA401866 | 403 | 745 |
| LYM1176 | maize\|10v1\|CD943536 | 406 | 746 |
| LYM1177 | maize\|10v1\|CD964979 | 407 | 747 |
| LYM1184 | maize\|gb170\|AI586584 | 414 | 748 |
| LYM1185 | maize\|gb170\|AI967089 | 415 | 749 |
| LYM1186 | maize\|gb170\|AW267345 | 416 | 750 |
| LYM1187 | maize\|gb170\|CD997839 | 417 | 751 |
| LYM1203 | sorghum\|12v1\|SB01G023320 | 428 | 752 |
| LYM1204 | sorghum\|12v1\|SB01G046820 | 429 | 753 |
| LYM1205 | sorghum\|12v1\|SB02G005630 | 430 | 754 |
| LYM1231 | tomato\|11v1\|AW617278 | 455 | 755 |
| LYM1236 | brachypodium\|12v1\|BRADI5G10880 | 460 | 756 |
| LYM1237 | brachypodium\|12v1\|BRADI5G10920 | 461 | 757 |
| LYM1240 | tomato\|11v1\|AW154852 | 463 | 758 |
| LYM1032_H1 | wheat\|12v3\|CA635514 | 464 | 759 |
| LYM1164_H1 | sorghum\|12v1\|SB02G009120 | 472 | 760 |
| LYM1196 | sorghum\|12v1\|CF480531 | 473 | — |

Provided are the identified genes, their annotation, organism and polynucleotide and polypeptide sequence identifiers, "polyn." = polynucleotide; "polyp." = polypeptide. Core genes SEQ ID NOs: 1-220 (polynucleotides) and 474-692 (polypeptides); variants and curated sequences SEQ ID NOs: 221-268 (polynucleotides); cloned sequences SEQ ID NOs: 269-473 (polynucleotides).

Example 2

Identification of Homologous Sequences that Increase Yield, Fiber Yield, Fiber Quality, Growth Rate, Biomass, Photosynthetic Capacity, Oil Content, Vigor, ABST, and/or NUE of a Plant The concepts of orthology and paralogy have recently been applied to functional characterizations and classifications on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

To further investigate and identify putative orthologs of the genes affecting plant yield, oil yield, oil content, seed yield, growth rate, photosynthetic capacity, vigor, biomass, abiotic stress tolerance, and fertilizer use efficiency (FUE) genes and/or nitrogen use efficiency, all sequences were aligned using the BLAST (Basic Local Alignment Search Tool). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level -identical amino acids in the protein domains and similarity in expression profiles.

The search and identification of homologous genes involves the screening of sequence information available, for example, in public databases such as the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST programs. There are five implementations of BLAST, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST algorithm calculates percent sequence identity and performs a statistical analysis of the similarity between the two sequences. The software for performing BLAST analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (ortholog) or a family of similar genes and those genes will provide the same preferred phenotype as the genes presented here. Advantageously, these family members may be useful in the methods of the invention. Example of other plants are included here but not limited to, barley (*Hordeum vulgare*), Arabidopsis (*Arabidopsis thaliana*), maize (*Zea mays*), cotton (*Gossypium*), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*), Wheat (*Triticum aestivum*).

The above-mentioned analyses for sequence homology can be carried out on a full-length sequence, but may also be based on a comparison of certain regions such as conserved domains. The identification of such domains, would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (biochem(dot)ucl(dot)ac(dot)uk/bsm/dbbrowser/protocol/prodomqry(dot)html), PR (pir(dot)Georgetown(dot)edu/) or Pfam (sanger(dot)ac(dot)uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution tables are well known in the art (see for example Creighton (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes described in Table 1 (Example 1 above) were identified from the databases using BLAST software with the Blastp and tBlastn algorithms as filters for the first stage, and the needle (EMBOSS package) or Frame+ algorithm alignment for the second stage. Local identity (Blast alignments) was defined with a very permissive cutoff—60% Identity on a span of 60% of the sequences lengths because it is used only as a filter for the global alignment stage. The default filtering of the Blast package was not utilized (by setting the parameter "-F F").

In the second stage, homologues were defined based on a global identity of at least 80% to the core gene polypeptide sequence. Two distinct forms for finding the optimal global alignment for protein or nucleotide sequences were used in this application:

1. Between two proteins (following the blastp filter): EMBOSS-6.0.1 Needleman-Wunsch algorithm with the following modified parameters: gapopen=8 gapextend=2. The rest of the parameters were unchanged from the default options described hereinabove.

2. Between a protein sequence and a nucleotide sequence (following the tblastn filter): GenCore 6.0 OneModel application utilizing the Frame+algorithm with the following parameters: model=frame+_p2n.model mode=qglobal -q=protein. sequence -db=nucleotide.sequence. The rest of the parameters are unchanged from the default options described hereinabove.

The query polypeptide sequences were SEQ ID NOs: 474-760 (which are encoded by the polynucleotides SEQ ID NOs:1-473, shown in Table 1 above) and the identified orthologous and homologous sequences having at least 80% global sequence identity are provided in Table 2, below. These homologous genes are expected to increase plant yield, harvest index, seed yield, oil yield, oil content, photosynthetic capacity, growth rate, fiber yield, fiber quality, biomass, vigor, ABST and/or NUE of a plant.

TABLE 2

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 761 | wheat\|12v3\|CA499808 | 4806 | 474 | 97.7 | globlastp |
| 762 | wheat\|12v3\|BE471040 | 4807 | 474 | 97.4 | globlastp |
| 763 | rye\|12v1\|DRR001012.106525XX1 | 4808 | 474 | 96.62 | glotblastn |
| 764 | leymus\|gb166\|EG374745_P1 | 4809 | 474 | 96.2 | globlastp |
| 765 | brachypodium\|12v1\|BRADI1G24110_P1 | 4810 | 474 | 92.5 | globlastp |
| 766 | oat\|11v1\|CN817559_P1 | 4811 | 474 | 89.1 | globlastp |
| 767 | rice\|11v1\|BE229056 | 4812 | 474 | 81.7 | globlastp |
| 768 | switchgrass\|12v1\|GD046483_P1 | 4813 | 474 | 81.2 | globlastp |
| 769 | switchgrass\|12v1\|FE625606_P1 | 4814 | 474 | 81.2 | globlastp |
| 770 | fescue\|gb161\|CK802813_P1 | 4815 | 474 | 81.1 | globlastp |
| 771 | maize\|10v1\|W21719_P1 | 4816 | 474 | 80.8 | globlastp |
| 772 | sorghum\|12v1\|SB07G001230 | 4817 | 474 | 80.8 | globlastp |
| 773 | switchgrass\|gb167\|FE625606 | 4818 | 474 | 80.8 | globlastp |
| 774 | wheat\|12v3\|BE429597 | 4819 | 475 | 94.8 | globlastp |
| 775 | rye\|12v1\|DRR001012.100511 | 4820 | 475 | 92.8 | globlastp |
| 776 | brachypodium\|12v1\|BRADI2G01570_P1 | 4821 | 475 | 90.5 | globlastp |
| 777 | rye\|12v1\|DRR001012.163009 | 4822 | 475 | 88.4 | globlastp |
| 778 | foxtail_millet\|11v3\|PHY7SI002189M_P1 | 4823 | 475 | 84.8 | globlastp |
| 779 | sorghum\|12v1\|SB03G007820 | 4824 | 475 | 83.9 | globlastp |
| 780 | millet\|10v1\|EVO454PM004211_P1 | 4825 | 475 | 83.6 | globlastp |
| 781 | switchgrass\|12v1\|FL889709_P1 | 4826 | 475 | 83.3 | globlastp |
| 782 | maize\|10v1\|AI855205_P1 | 4827 | 475 | 80.8 | globlastp |
| 783 | wheat\|12v3\|BE418079 | 4828 | 476 | 95 | globlastp |
| 784 | wheat\|12v3\|BE425779 | 4829 | 476 | 94.6 | globlastp |
| 785 | pseudoroegneria\|gb167\|FF345940 | 4830 | 476 | 93.9 | globlastp |
| 786 | leymus\|gb166\|EG390364_P1 | 4831 | 476 | 92.8 | globlastp |
| 787 | rye\|12v1\|DRR001012.168093 | 4832 | 476 | 92.5 | globlastp |
| 788 | oat\|11v1\|CN818992_P1 | 4833 | 476 | 92.1 | globlastp |
| 789 | brachypodium\|12v1\|BRADI2G19260_P1 | 4834 | 476 | 89.3 | globlastp |
| 790 | foxtail_millet\|11v3\|PHY7SI030773M_P1 | 4835 | 476 | 81 | globlastp |
| 791 | rice\|11v1\|BI118706 | 4836 | 476 | 80.2 | globlastp |
| 792 | switchgrass\|12v1\|DN145241_T1 | 4837 | 476 | 80.14 | glotblastn |
| 793 | brachypodium\|12v1\|BRADI4G43490_P1 | 4838 | 477 | 85.1 | globlastp |
| 794 | brachypodium\|12v1\|SRR031799.357353_P1 | 4839 | 477 | 80.6 | globlastp |
| 795 | pseudoroegneria\|gb167\|FF343086 | 4840 | 478 | 93.9 | globlastp |
| 796 | wheat\|12v3\|CA602363 | 4841 | 478 | 93.2 | globlastp |
| 797 | leymus\|gb166\|EG390333_P1 | 4842 | 478 | 92.8 | globlastp |
| 798 | rye\|12v1\|BF145224 | 4843 | 478 | 92.8 | globlastp |
| 799 | rye\|12v1\|DRR001012.851131 | 4844 | 478 | 89.1 | globlastp |
| 800 | oat\|11v1\|GO588158_P1 | 4845 | 478 | 84.6 | globlastp |
| 801 | brachypodium\|12v1\|BRADI5G16540_P1 | 4846 | 478 | 81.7 | globlastp |
| 802 | rye\|12v1\|DRR001012.15709 | 4847 | 479 | 99.5 | globlastp |
| 803 | wheat\|12v3\|CA485262 | 4848 | 479 | 99.3 | globlastp |
| 804 | wheat\|12v3\|CA682154 | 4849 | 479 | 99.3 | globlastp |
| 805 | wheat\|12v3\|CA679154 | 4850 | 479 | 98.85 | glotblastn |
| 806 | wheat\|12v3\|SRR073321X228577D1 | 4851 | 479 | 98.8 | globlastp |
| 807 | oat\|11v1\|GO581612_P1 | 4852 | 479 | 96.1 | globlastp |
| 808 | wheat\|12v3\|SRR400820X1013688D1 | 4853 | 479 | 94.7 | globlastp |
| 809 | wheat\|12v3\|BJ232559 | 4854 | 479 | 92.4 | globlastp |
| 810 | brachypodium\|12v1\|BRADI2G50850_P1 | 4855 | 479 | 91.8 | globlastp |
| 811 | rice\|11v1\|AA753241 | 4856 | 479 | 90.3 | globlastp |
| 812 | maize\|10v1\|AI714639_P1 | 4857 | 479 | 89.2 | globlastp |
| 813 | foxtail_millet\|11v3\|PHY7SI001397M_P1 | 4858 | 479 | 88.8 | globlastp |
| 814 | sorghum\|12v1\|SB03G035520 | 4859 | 479 | 88.7 | globlastp |
| 815 | switchgrass\|12v1\|FL970432_P1 | 4860 | 479 | 88.3 | globlastp |
| 816 | switchgrass\|gb167\|FL970431 | 4861 | 479 | 88.3 | globlastp |
| 817 | millet\|10v1\|EVO454PM046432_P1 | 4862 | 479 | 88.1 | globlastp |
| 818 | switchgrass\|12v1\|FL970431_P1 | 4863 | 479 | 87.9 | globlastp |
| 819 | barley\|12v1\|BQ464462_T1 | 4864 | 479 | 87.3 | glotblastn |
| 820 | millet\|10v1\|EVO454PM000736_P1 | 4865 | 479 | 86.8 | globlastp |
| 821 | sorghum\|12v1\|SB03G035510 | 4866 | 479 | 85.7 | globlastp |
| 822 | maize\|10v1\|AW091497_P1 | 4867 | 479 | 84.9 | globlastp |
| 823 | switchgrass\|gb167\|DN150274 | 4868 | 479 | 84.4 | globlastp |
| 824 | oil_palm\|11v1\|EL694748_T1 | 4869 | 479 | 83.49 | glotblastn |
| 825 | monkeyflower\|10v1\|GR041261 | 4870 | 479 | 82.99 | glotblastn |
| 826 | monkeyflower\|12v1\|SRR037227.103684_T1 | 4870 | 479 | 82.99 | glotblastn |
| 827 | phalaenopsis\|11v1\|CK857490_T1 | 4871 | 479 | 82.99 | glotblastn |
| 828 | grape\|11v1\|GSVIVT01000140001_T1 | 4872 | 479 | 82.95 | glotblastn |
| 829 | clementine\|11v1\|CB293265_T1 | 4873 | 479 | 82.76 | glotblastn |
| 830 | cotton\|11v1\|CO073391_T1 | 4874 | 479 | 82.76 | glotblastn |
| 831 | gossypium_raimondii\|12v1\|DW507026_T1 | 4874 | 479 | 82.76 | glotblastn |
| 832 | tragopogon\|10v1\|SRR020205S0003654 | 4875 | 479 | 82.76 | glotblastn |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 833 | oil_palm\|11v1\|EL691912_T1 | 4876 | 479 | 82.57 | glotblastn |
| 834 | cirsium\|11v1\|SRR346952.1002551_T1 | 4877 | 479 | 82.53 | glotblastn |
| 835 | cirsium\|11v1\|SRR346952.1002760_T1 | 4878 | 479 | 82.53 | glotblastn |
| 836 | euphorbia\|11v1\|SRR098678X103708_T1 | 4879 | 479 | 82.53 | glotblastn |
| 837 | soybean\|11v1\|GLYMA17G17530 | 4880 | 479 | 82.53 | glotblastn |
| 838 | soybean\|12v1\|GLYMA17G17530_T1 | 4880 | 479 | 82.53 | glotblastn |
| 839 | banana\|12v1\|FF561873_P1 | 4881 | 479 | 82.3 | globlastp |
| 840 | flaveria\|11v1\|SRR149241.195133_T1 | 4882 | 479 | 82.3 | glotblastn |
| 841 | lotus\|09v1\|AW720090_T1 | 4883 | 479 | 82.3 | glotblastn |
| 842 | sunflower\|12v1\|EE626878 | 4884 | 479 | 82.3 | glotblastn |
| 843 | valeriana\|11v1\|SRR099039X103437 | 4885 | 479 | 82.3 | glotblastn |
| 844 | grape\|11v1\|GSVIVT01000137001_T1 | 4886 | 479 | 82.26 | glotblastn |
| 845 | poplar\|13v1\|BI122805_T1 | 4887 | 479 | 82.26 | glotblastn |
| 846 | phalaenopsis\|11v1\|SRR125771.1108919_T1 | 4888 | 479 | 82.11 | glotblastn |
| 847 | ambrosia\|11v1\|SRR346935.119908_T1 | 4889 | 479 | 82.07 | glotblastn |
| 848 | arnica\|11v1\|SRR099034X132803_T1 | 4890 | 479 | 82.07 | glotblastn |
| 849 | artemisia\|10v1\|EY037648_T1 | 4891 | 479 | 82.07 | glotblastn |
| 850 | kiwi\|gb166\|FG431561_T1 | 4892 | 479 | 82.07 | glotblastn |
| 851 | sunflower\|12v1\|DY950884 | 4893 | 479 | 82.07 | glotblastn |
| 852 | poplar\|10v1\|BI122805 | 4894 | 479 | 82.03 | glotblastn |
| 853 | centaurea\|11v1\|SRR346938.10437_T1 | 4895 | 479 | 81.84 | glotblastn |
| 854 | ambrosia\|11v1\|GW917919_T1 | 4896 | 479 | 81.84 | glotblastn |
| 855 | amsonia\|11v1\|SRR098688X106652_T1 | 4897 | 479 | 81.84 | glotblastn |
| 856 | cannabis\|12v1\|SOLX00011991_T1 | 4898 | 479 | 81.84 | glotblastn |
| 857 | cassava\|09v1\|JGICASSAVA227VALIDM1_T1 | 4899 | 479 | 81.84 | glotblastn |
| 858 | flaveria\|11v1\|SRR149229.142682_T1 | 4900 | 479 | 81.84 | glotblastn |
| 859 | sesame\|12v1\|BU669477 | 4901 | 479 | 81.84 | glotblastn |
| 860 | solanum_phureja\|09v1\|SPHBG126754 | 4902 | 479 | 81.84 | glotblastn |
| 861 | tomato\|11v1\|BG126754 | 4903 | 479 | 81.84 | glotblastn |
| 862 | centaurea\|11v1\|EH711693_T1 | 4904 | 479 | 81.84 | glotblastn |
| 863 | centaurea\|11v1\|EH715630_T1 | 4905 | 479 | 81.61 | glotblastn |
| 864 | chestnut\|gb170\|SRR006295S0010685_T1 | 4906 | 479 | 81.61 | glotblastn |
| 865 | lettuce\|12v1\|DW067582_T1 | 4907 | 479 | 81.61 | glotblastn |
| 866 | oak\|10v1\|CU656079_T1 | 4908 | 479 | 81.61 | glotblastn |
| 867 | grape\|11v1\|GSVIVT01000135001_T1 | 4909 | 479 | 81.57 | glotblastn |
| 868 | cirsium\|11v1\|SRR346952.103401_P1 | 4910 | 479 | 81.4 | globlastp |
| 869 | oil_palm\|11v1\|GH636063_P1 | 4911 | 479 | 81.4 | globlastp |
| 870 | flaveria\|11v1\|SRR149229.114389_P1 | 4912 | 479 | 81.3 | globlastp |
| 871 | castorbean\|12v1\|EE255507_T1 | 4913 | 479 | 81.15 | glotblastn |
| 872 | centaurea\|gb166\|EH711693 | 4914 | 479 | 81.15 | glotblastn |
| 873 | nasturtium\|11v1\|SRR032559.69640_T1 | 4915 | 479 | 81.15 | glotblastn |
| 874 | phyla\|11v2\|SRR099035X104507_T1 | 4916 | 479 | 80.96 | glotblastn |
| 875 | prunus_mume\|13v1\|BU046122_T1 | 4917 | 479 | 80.92 | glotblastn |
| 876 | arabidopsis_lyrata\|09v1\|JGIAL024200_T1 | 4918 | 479 | 80.92 | glotblastn |
| 877 | arabidopsis\|10v1\|AT4G37550_T1 | 4919 | 479 | 80.92 | glotblastn |
| 878 | flaveria\|11v1\|SRR149229.100158_T1 | 4920 | 479 | 80.92 | glotblastn |
| 879 | orobanche\|10v1\|SRR023189S0081920_T1 | 4921 | 479 | 80.92 | glotblastn |
| 880 | prunus\|10v1\|BU046122 | 4922 | 479 | 80.92 | glotblastn |
| 881 | strawberry\|11v1\|GT149889 | 4923 | 479 | 80.92 | glotblastn |
| 882 | thellungiella_halophilum\|11v1\|EHJGI11015175 | 4924 | 479 | 80.92 | glotblastn |
| 883 | tripterygium\|11v1\|SRR098677X100344 | 4925 | 479 | 80.92 | glotblastn |
| 884 | triphysaria\|10v1\|EY165587 | 4926 | 479 | 80.78 | glotblastn |
| 885 | olea\|13v1\|SRR014463X1545D1_T1 | 4927 | 479 | 80.69 | glotblastn |
| 886 | eucalyptus\|11v2\|ES592558_T1 | 4928 | 479 | 80.69 | glotblastn |
| 887 | fagopyrum\|11v1\|SRR063703X115411_T1 | 4929 | 479 | 80.69 | glotblastn |
| 888 | fraxinus\|11v1\|SRR058827.100115_T1 | 4930 | 479 | 80.69 | glotblastn |
| 889 | medicago\|12v1\|AI974567_T1 | 4931 | 479 | 80.69 | glotblastn |
| 890 | vinca\|11v1\|SRR098690X122826 | 4932 | 479 | 80.69 | glotblastn |
| 891 | bean\|12v2\|SRR001335.439347_T1 | 4933 | 479 | 80.55 | glotblastn |
| 892 | bean\|12v1\|SRR001335.439347 | 4934 | 479 | 80.55 | glotblastn |
| 893 | olea\|13v1\|SRR014463X33113D1_T1 | 4935 | 479 | 80.46 | glotblastn |
| 894 | b_rapa\|11v1\|CX192056_T1 | 4936 | 479 | 80.46 | glotblastn |
| 895 | cichorium\|gb171\|EH675254_T1 | 4937 | 479 | 80.46 | glotblastn |
| 896 | pigeonpea\|11v1\|SRR054580X10637_T1 | 4938 | 479 | 80.46 | glotblastn |
| 897 | cacao\|10v1\|CU496860_P1 | 4939 | 479 | 80.3 | globlastp |
| 898 | catharanthus\|11v1\|EG560157_T1 | 4940 | 479 | 80.23 | glotblastn |
| 899 | fraxinus\|11v1\|SRR058827.112715_T1 | 4941 | 479 | 80.23 | glotblastn |
| 900 | aquilegia\|10v2\|DR918379_T1 | 4942 | 479 | 80 | glotblastn |
| 901 | wheat\|12v3\|BE604622 | 4943 | 480 | 97.6 | globlastp |
| 902 | wheat\|12v3\|BJ304531 | 4944 | 480 | 95.2 | globlastp |
| 903 | brachypodium\|12v1\|BRADI2G46650_P1 | 4945 | 480 | 93.1 | globlastp |
| 904 | foxtail_millet\|11v3\|PHY7SI001146M_P1 | 4946 | 480 | 86.8 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 905 | maize\|10v1\|AW573435_P1 | 4947 | 480 | 85.7 | globlastp |
| 906 | sorghum\|12v1\|SB03G044340 | 4948 | 480 | 85.7 | globlastp |
| 907 | rice\|11v1\|BM421243 | 4949 | 480 | 85.5 | globlastp |
| 908 | switchgrass\|gb167\|FL698463 | 4950 | 480 | 85.5 | globlastp |
| 909 | switchgrass\|12v1\|FL860465_P1 | 4951 | 480 | 85.1 | globlastp |
| 910 | rice\|11v1\|CA762920 | 4952 | 480 | 84.2 | globlastp |
| 911 | sugarcane\|10v1\|CA120633 | 4953 | 480 | 83 | globlastp |
| 912 | maize\|10v1\|CD528010_P1 | 4954 | 480 | 81.6 | globlastp |
| 913 | rye\|12v1\|DRR001012.223257 | 4955 | 481 | 96.3 | globlastp |
| 914 | wheat\|12v3\|CA719595 | 4956 | 481 | 96.3 | globlastp |
| 915 | wheat\|12v3\|CA723603 | 4957 | 481 | 96.3 | globlastp |
| 916 | wheat\|12v3\|CJ828308 | 4958 | 481 | 95.3 | globlastp |
| 917 | fescue\|gb161\|DT689385_P1 | 4959 | 481 | 83.2 | globlastp |
| 918 | oat\|11v1\|GR322552_P1 | 4960 | 481 | 83.2 | globlastp |
| 919 | brachypodium\|12v1\|BRADI1G78480_P1 | 4961 | 483 | 94.1 | globlastp |
| 920 | rye\|12v1\|DRR001013.132893 | 4962 | 483 | 93.4 | globlastp |
| 921 | wheat\|12v3\|BE418676 | 4963 | 483 | 92.7 | globlastp |
| 922 | foxtail_millet\|11v3\|PHY7SI036404M_P1 | 4964 | 483 | 91.1 | globlastp |
| 923 | switchgrass\|12v1\|FL977110_P1 | 4965 | 483 | 90.1 | globlastp |
| 924 | sorghum\|12v1\|SB01G050510 | 4966 | 483 | 90.1 | globlastp |
| 925 | rice\|11v1\|CB211325 | 4967 | 483 | 89.44 | glotblastn |
| 926 | millet\|10v1\|EVO454PM170482_P1 | 4968 | 483 | 89.4 | globlastp |
| 927 | maize\|10v1\|BM075301_P1 | 4969 | 483 | 88.4 | globlastp |
| 928 | rye\|12v1\|DRR001012.14520 | 4970 | 483 | 84.7 | globlastp |
| 929 | rye\|12v1\|DRR001012.142059 | 4971 | 484 | 96.6 | globlastp |
| 930 | brachypodium\|12v1\|BRADI2G18260_P1 | 4972 | 484 | 90.4 | globlastp |
| 931 | sorghum\|12v1\|SB09G026970 | 4973 | 484 | 87.5 | globlastp |
| 932 | maize\|10v1\|AI941555_P1 | 4974 | 484 | 87 | globlastp |
| 933 | rice\|11v1\|AU175084 | 4975 | 484 | 87 | globlastp |
| 934 | foxtail_millet\|11v3\|PHY7SI021450M_P1 | 4976 | 484 | 86.9 | globlastp |
| 935 | switchgrass\|12v1\|FE601175_P1 | 4977 | 484 | 86.6 | globlastp |
| 936 | switchgrass\|gb167\|FE601175 | 4978 | 484 | 86.4 | glotblastn |
| 937 | wheat\|12v3\|BG263512 | 4979 | 484 | 84 | globlastp |
| 938 | rye\|12v1\|DRR001012.107856 | 4980 | 485 | 95.4 | globlastp |
| 939 | wheat\|12v3\|CD939313 | 4981 | 485 | 95.1 | globlastp |
| 940 | leymus\|gb166\|EG376968_P1 | 4982 | 485 | 92.8 | globlastp |
| 941 | rye\|12v1\|DRR001012.156292 | 4983 | 488 | 86.83 | glotblastn |
| 942 | rye\|12v1\|DRR001012.109545 | 4984 | 489 | 98.65 | glotblastn |
| 943 | rye\|12v1\|DRR001012.188810 | 4985 | 489 | 98.6 | globlastp |
| 944 | wheat\|12v3\|BI751390 | 4986 | 489 | 98.3 | globlastp |
| 945 | rye\|12v1\|DRR001017.1135370 | 4987 | 489 | 97.97 | glotblastn |
| 946 | brachypodium\|12v1\|BRADI3G34090_P1 | 4988 | 489 | 92.2 | globlastp |
| 947 | sorghum\|12v1\|SB01G028320 | 4989 | 489 | 89.9 | globlastp |
| 948 | maize\|10v1\|T14791_P1 | 4990 | 489 | 88.9 | globlastp |
| 949 | sugarcane\|10v1\|CA145253 | 4991 | 489 | 88.9 | globlastp |
| 950 | switchgrass\|gb167\|DN142883 | 4992 | 489 | 88.2 | globlastp |
| 951 | foxtail_millet\|11v3\|PHY7SI039140M_T1 | 4993 | 489 | 88.18 | glotblastn |
| 952 | switchgrass\|12v1\|DN142883_P1 | 4994 | 489 | 87.5 | globlastp |
| 953 | switchgrass\|12v1\|FE644344_P1 | 4995 | 489 | 87.5 | globlastp |
| 954 | switchgrass\|gb167\|FE644344 | 4995 | 489 | 87.5 | globlastp |
| 955 | switchgrass\|12v1\|FL734512_P1 | 4996 | 489 | 87.2 | globlastp |
| 956 | rice\|11v1\|AA752933 | 4997 | 489 | 86.49 | glotblastn |
| 957 | lovegrass\|gb167\|EH185476_T1 | 4998 | 489 | 86.15 | glotblastn |
| 958 | switchgrass\|12v1\|JG798954_P1 | 4999 | 489 | 86.1 | globlastp |
| 959 | wheat\|12v3\|BE398714 | 5000 | 490 | 89.6 | globlastp |
| 960 | rye\|12v1\|DRR001012.170848 | 5001 | 490 | 88.83 | glotblastn |
| 961 | rye\|12v1\|DRR001012.197116 | 5002 | 490 | 80.6 | globlastp |
| 962 | rye\|12v1\|DRR001012.201741 | 5003 | 491 | 97 | globlastp |
| 963 | wheat\|12v3\|CB307700 | 5004 | 491 | 92.1 | globlastp |
| 964 | brachypodium\|12v1\|BRADI2G08826_T1 | 5005 | 491 | 87.19 | glotblastn |
| 965 | foxtail_millet\|11v3\|PHY7SI000654M_P1 | 5006 | 491 | 86.2 | globlastp |
| 966 | switchgrass\|12v1\|FL717129_P1 | 5007 | 491 | 86 | globlastp |
| 967 | rice\|11v1\|AA749673 | 5008 | 491 | 85.8 | globlastp |
| 968 | maize\|10v1\|AI941513_P1 | 5009 | 491 | 85.6 | globlastp |
| 969 | sorghum\|12v1\|SB03G009530 | 5010 | 491 | 85.02 | glotblastn |
| 970 | wheat\|12v3\|BE442783 | 5011 | 492 | 96.9 | globlastp |
| 971 | wheat\|12v3\|CA655313 | 5012 | 492 | 96.9 | globlastp |
| 972 | wheat\|12v3\|BE445444 | 5013 | 492 | 96.4 | globlastp |
| 973 | rye\|12v1\|DRR001012.125087 | 5014 | 492 | 95.8 | globlastp |
| 974 | rye\|12v1\|DRR001013.112923 | 5015 | 492 | 95.3 | globlastp |
| 975 | rye\|12v1\|DRR001012.119920 | 5016 | 492 | 94.3 | globlastp |
| 976 | oat\|11v1\|GR313287_P1 | 5017 | 492 | 86.5 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 977 | brachypodium\|12v1\|BRADI1G74470T2_P1 | 5018 | 492 | 84.4 | globlastp |
| 978 | wheat\|12v3\|BM138140 | 5019 | 492 | 80.6 | globlastp |
| 979 | rye\|12v1\|BE494195 | 5020 | 493 | 93.3 | globlastp |
| 980 | wheat\|12v3\|CV771141 | 5021 | 493 | 93.3 | globlastp |
| 981 | leymus\|gb166\|EG377531_P1 | 5022 | 493 | 86.4 | globlastp |
| 982 | brachypodium\|12v1\|BRADI3G60477_P1 | 5023 | 494 | 85.1 | globlastp |
| 983 | wheat\|12v3\|SRR043323X104913D1 | 5024 | 494 | 82.4 | globlastp |
| 984 | wheat\|12v3\|SRR400820X153277D1 | 5025 | 495 | 83.58 | glotblastn |
| 985 | rye\|12v1\|DRR001012.487346 | 5026 | 496 | 95.92 | glotblastn |
| 986 | rye\|12v1\|DRR001012.145383 | 5027 | 496 | 94.9 | glotblastn |
| 987 | oat\|11v1\|SRR020741.10036_T1 | 5028 | 496 | 80.61 | glotblastn |
| 988 | oat\|11v1\|GR322199_T1 | 5029 | 496 | 80.58 | glotblastn |
| 989 | wheat\|12v3\|BE591963 | 5030 | 497 | 89.3 | globlastp |
| 990 | rye\|12v1\|DRR001012.422030 | 5031 | 497 | 84.2 | globlastp |
| 991 | rye\|12v1\|DRR001012.48982 | 5032 | 499 | 84.1 | globlastp |
| 992 | rye\|12v1\|DRR001013.302579 | 5033 | 499 | 81 | globlastp |
| 993 | leymus\|gb166\|CN466083_P1 | 5034 | 500 | 89.6 | globlastp |
| 994 | oat\|11v1\|CN817359_P1 | 5035 | 500 | 88.9 | globlastp |
| 995 | wheat\|12v3\|BM135926 | 5036 | 500 | 88.4 | globlastp |
| 996 | rye\|12v1\|DRR001012.123874 | 5037 | 500 | 85.6 | globlastp |
| 997 | wheat\|12v3\|BE500186 | 5038 | 500 | 85.6 | globlastp |
| 998 | wheat\|12v3\|CA608058 | 5039 | 500 | 85 | globlastp |
| 999 | pseudoroegneria\|gb167\|FF357563 | 5040 | 500 | 84.9 | globlastp |
| 1000 | rye\|12v1\|DRR001012.109036 | 5041 | 500 | 84.9 | globlastp |
| 1001 | wheat\|12v3\|BG904763 | 5042 | 500 | 84.2 | globlastp |
| 1002 | barley\|12v1\|BF267122_T1 | 5043 | 500 | 82.39 | glotblastn |
| 1003 | pseudoroegneria\|gb167\|FF340148 | 501 | 501 | 100 | globlastp |
| 1004 | rye\|12v1\|BE495303 | 5044 | 501 | 99.5 | globlastp |
| 1005 | leymus\|gb166\|CD808585_P1 | 5045 | 501 | 99.1 | globlastp |
| 1006 | wheat\|12v3\|BE490039 | 5046 | 501 | 99.1 | globlastp |
| 1007 | oat\|11v1\|CN819069_P1 | 5047 | 501 | 92.9 | globlastp |
| 1008 | oat\|11v1\|GR317596_P1 | 5048 | 501 | 92.9 | globlastp |
| 1009 | brachypodium\|12v1\|BRADI3G56270_P1 | 5049 | 501 | 88 | globlastp |
| 1010 | rice\|11v1\|CB209869 | 5050 | 501 | 84.2 | globlastp |
| 1011 | rice\|11v1\|AA751912 | 5051 | 501 | 84.19 | glotblastn |
| 1012 | switchgrass\|12v1\|DN145682_T1 | 5052 | 501 | 83.72 | glotblastn |
| 1013 | foxtail_millet\|11v3\|EC613604_P1 | 5053 | 501 | 83.6 | globlastp |
| 1014 | millet\|10v1\|CD724620_P1 | 5054 | 501 | 83.2 | globlastp |
| 1015 | switchgrass\|12v1\|DN147859_T1 | 5055 | 501 | 81.48 | glotblastn |
| 1016 | maize\|10v1\|AI649499_T1 | 5056 | 501 | 80.56 | glotblastn |
| 1017 | sorghum\|12v1\|SB01G039270 | 5057 | 501 | 80.1 | globlastp |
| 1018 | wheat\|12v3\|BE404363 | 5058 | 502 | 97.7 | globlastp |
| 1019 | leymus\|gb166\|EG374806_P1 | 5059 | 502 | 97.1 | globlastp |
| 1020 | rye\|12v1\|DRR001012.120122 | 5060 | 502 | 97.1 | globlastp |
| 1021 | oat\|11v1\|GR325303_P1 | 5061 | 502 | 91.7 | globlastp |
| 1022 | brachypodium\|12v1\|BRADI5G08820_P1 | 5062 | 502 | 91.6 | globlastp |
| 1023 | rice\|11v1\|AA751818 | 5063 | 502 | 85.67 | Glotblastn |
| 1024 | maize\|10v1\|AI966987_P1 | 5064 | 502 | 84.2 | Globlastp |
| 1025 | rice\|11v1\|OSCRP090660 | 5065 | 502 | 84.1 | Globlastp |
| 1026 | sorghum\|12v1\|SB06G015130 | 5066 | 502 | 83.2 | Globlastp |
| 1027 | switchgrass\|12v1\|DN145555_P1 | 5067 | 502 | 82.9 | Globlastp |
| 1028 | switchgrass\|gb167\|DN145555 | 5067 | 502 | 82.9 | Globlastp |
| 1029 | fescue\|gb161\|DT679565_P1 | 5068 | 502 | 82.8 | Globlastp |
| 1030 | rye\|12v1\|DRR001012.32271 | 5069 | 503 | 97.7 | Globlastp |
| 1031 | brachypodium\|12v1\|BRADI3G30430_P1 | 5070 | 503 | 89 | Globlastp |
| 1032 | wheat\|12v3\|BE497566 | 5071 | 504 | 95.4 | Globlastp |
| 1033 | rye\|12v1\|DRR001012.134437 | 5072 | 504 | 90.8 | Globlastp |
| 1034 | leymus\|gb166\|CN465858_T1 | 5073 | 504 | 88.99 | Glotblastn |
| 1035 | barley\|12v1\|AV933428_P1 | 5074 | 504 | 84.9 | Globlastp |
| 1036 | wheat\|12v3\|BE399416 | 5075 | 505 | 96.3 | Globlastp |
| 1037 | leymus\|gb166\|EG395011_P1 | 5076 | 505 | 95.1 | Globlastp |
| 1038 | rye\|12v1\|BG263885 | 5077 | 505 | 95.1 | Globlastp |
| 1039 | fescue\|gb161\|DT698771_P1 | 5078 | 505 | 87.9 | Globlastp |
| 1040 | brachypodium\|12v1\|BRADI3G58930_P1 | 5079 | 505 | 83.5 | Globlastp |
| 1041 | wheat\|12v3\|AL827317 | 5080 | 506 | 92.1 | Globlastp |
| 1042 | wheat\|12v3\|BF473064 | 5081 | 506 | 91.6 | Globlastp |
| 1043 | rye\|12v1\|DRR001012.215178 | 5082 | 506 | 83.5 | Globlastp |
| 1044 | wheat\|12v3\|BE399655 | 5083 | 507 | 96 | Globlastp |
| 1045 | brachypodium\|12v1\|BRADI3G46360_P1 | 5084 | 507 | 88.4 | Globlastp |
| 1046 | wheat\|12v3\|BE425895 | 5085 | 508 | 95.8 | Globlastp |
| 1047 | pseudoroegneria\|gb167\|FF363929 | 5086 | 508 | 95.5 | Globlastp |
| 1048 | rye\|12v1\|DRR001012.165033 | 5087 | 508 | 86.8 | Globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 1049 | wheat|12v3|BE405019 | 5088 | 509 | 86.4 | Globlastp |
| 1050 | pseudoroegneria|gb167|FF357680 | 511 | 511 | 100 | Globlastp |
| 1051 | rye|12v1|BE587317 | 511 | 511 | 100 | Globlastp |
| 1052 | rye|12v1|DRR001012.134892 | 511 | 511 | 100 | Globlastp |
| 1053 | wheat|12v3|CA679261 | 5089 | 511 | 98.7 | Globlastp |
| 1054 | brachypodium|12v1|BRADI3G29610_P1 | 5090 | 511 | 90.7 | Globlastp |
| 1055 | brachypodium|12v1|BRADI3G47027_P1 | 5091 | 511 | 89.3 | Globlastp |
| 1056 | banana|12v1|FL660779_P1 | 5092 | 511 | 86.7 | Globlastp |
| 1057 | cirsium|11v1|SRR346952.108326_P1 | 5093 | 511 | 86.7 | Globlastp |
| 1058 | cynara|gb167|GE581359_P1 | 5094 | 511 | 86.7 | Globlastp |
| 1059 | onion|12v1|SRR073446X115892D1_P1 | 5095 | 511 | 86.7 | Globlastp |
| 1060 | salvia|10v1|FE537265 | 5096 | 511 | 86.7 | Globlastp |
| 1061 | zostera|12v1|SRR057351X135209D1_T1 | 5097 | 511 | 85.33 | glotblastn |
| 1062 | centaurea|11v1|EH741216_P1 | 5098 | 511 | 85.3 | Globlastp |
| 1063 | centaurea|11v1|SRR346938.147584_P1 | 5098 | 511 | 85.3 | Globlastp |
| 1064 | cassava|09v1|DV441272_P1 | 5099 | 511 | 85.3 | Globlastp |
| 1065 | centaurea|gb166|EH741216 | 5098 | 511 | 85.3 | Globlastp |
| 1066 | cirsium|11v1|SRR346952.1098629_P1 | 5098 | 511 | 85.3 | Globlastp |
| 1067 | grape|11v1|GSVIVT01037255001_P1 | 5100 | 511 | 85.3 | Globlastp |
| 1068 | oat|11v1|SRR020741.138429_P1 | 5101 | 511 | 85.3 | Globlastp |
| 1069 | onion|12v1|SRR073446X108711D1_P1 | 5102 | 511 | 85.3 | Globlastp |
| 1070 | poplar|10v1|BU809023 | 5103 | 511 | 85.3 | Globlastp |
| 1071 | poplar|13v1|BU809023_P1 | 5103 | 511 | 85.3 | Globlastp |
| 1072 | salvia|10v1|CV167583 | 5104 | 511 | 85.3 | Globlastp |
| 1073 | senecio|gb170|SRR006592S0012274 | 5105 | 511 | 85.3 | Globlastp |
| 1074 | nicotiana_benthamiana|12v1|EB695973_P1 | 5106 | 511 | 84 | Globlastp |
| 1075 | castorbean|11v1|EG681425 | 5107 | 511 | 84 | Globlastp |
| 1076 | castorbean|12v1|EG681425_P1 | 5107 | 511 | 84 | Globlastp |
| 1077 | chickpea|11v1|GR408157 | 5108 | 511 | 84 | Globlastp |
| 1078 | chickpea|13v2|GR395617_P1 | 5108 | 511 | 84 | Globlastp |
| 1079 | cirsium|11v1|SRR349641.247032XX2_P1 | 5109 | 511 | 84 | Globlastp |
| 1080 | cotton|11v1|BF277946_P1 | 5110 | 511 | 84 | Globlastp |
| 1081 | cucurbita|11v1|SRR091276X103592_P1 | 5111 | 511 | 84 | Globlastp |
| 1082 | euonymus|11v1|SRR070038X178196_P1 | 5112 | 511 | 84 | Globlastp |
| 1083 | euphorbia|11v1|BP954160_P1 | 5110 | 511 | 84 | Globlastp |
| 1084 | euphorbia|11v1|DV116401_P1 | 5110 | 511 | 84 | Globlastp |
| 1085 | gossypium_raimondii|12v1|BF277946_P1 | 5110 | 511 | 84 | Globlastp |
| 1086 | maize|10v1|AI737075_P1 | 5113 | 511 | 84 | Globlastp |
| 1087 | melon|10v1|AM715730_P1 | 5111 | 511 | 84 | Globlastp |
| 1088 | momordica|10v1|SRR071315S0054114_P1 | 5111 | 511 | 84 | Globlastp |
| 1089 | phalaenopsis|11v1|SRR125771.1779447_P1 | 5114 | 511 | 84 | Globlastp |
| 1090 | pigeonpea|11v1|SRR054580X150846_P1 | 5115 | 511 | 84 | Globlastp |
| 1091 | plantago|11v2|SRR066373X101918_P1 | 5116 | 511 | 84 | Globlastp |
| 1092 | potato|10v1|CV494926_P1 | 5117 | 511 | 84 | Globlastp |
| 1093 | solanum_phureja|09v1|SPHAW618453 | 5117 | 511 | 84 | Globlastp |
| 1094 | sorghum|12v1|SB06G030830 | 5118 | 511 | 84 | Globlastp |
| 1095 | soybean|11v1|BF008960 | 5115 | 511 | 84 | Globlastp |
| 1096 | soybean|12v1|GLYMA18G14801_P1 | 5115 | 511 | 84 | Globlastp |
| 1097 | spurge|gb161|DV116401 | 5119 | 511 | 84 | Glotblastn |
| 1098 | tamarix|gb166|EG972492 | 5120 | 511 | 84 | glotblastn |
| 1099 | thellungiella_halophilum|11v1|EHJGI11003893 | 5121 | 511 | 84 | Globlastp |
| 1100 | thellungiella_halophilum|11v1|EHJGI11022828 | 5122 | 511 | 84 | Globlastp |
| 1101 | tobacco|gb162|EB432772 | 5123 | 511 | 84 | Glotblastn |
| 1102 | triphysaria|10v1|EY010916 | 5124 | 511 | 84 | Globlastp |
| 1103 | tripterygium|11v1|SRR098677X192105 | 5112 | 511 | 84 | Globlastp |
| 1104 | watermelon|11v1|AM715730 | 5111 | 511 | 84 | Globlastp |
| 1105 | zostera|10v1|SRR057351S0135210 | 5125 | 511 | 83.1 | Globlastp |
| 1106 | monkeyflower|12v1|MGJGI014705_P1 | 5126 | 511 | 82.7 | Globlastp |
| 1107 | olea|13v1|SRR014463X24477D1_P1 | 5127 | 511 | 82.7 | Globlastp |
| 1108 | arabidopsis_lyrata|09v1|JGIAL009222_P1 | 5128 | 511 | 82.7 | Globlastp |
| 1109 | arnica|11v1|SRR099034X107477_P1 | 5129 | 511 | 82.7 | Globlastp |
| 1110 | blueberry|12v1|SRR353282X15243D1_P1 | 5130 | 511 | 82.7 | Globlastp |
| 1111 | bruguiera|gb166|BP943731_P1 | 5131 | 511 | 82.7 | Globlastp |
| 1112 | chestnut|gb170|SRR006295S0035613_P1 | 5132 | 511 | 82.7 | Globlastp |
| 1113 | cleome_gynandra|10v1|SRR015532S0004228_P1 | 5133 | 511 | 82.7 | Globlastp |
| 1114 | cleome_spinosa|10v1|SRR015531S0064405_P1 | 5134 | 511 | 82.7 | Globlastp |
| 1115 | dandelion|10v1|GO663576_P1 | 5129 | 511 | 82.7 | Globlastp |
| 1116 | eggplant|10v1|FS052665_P1 | 5135 | 511 | 82.7 | Globlastp |
| 1117 | euonymus|11v1|SRR070038X152626_P1 | 5136 | 511 | 82.7 | Globlastp |
| 1118 | fagopyrum|11v1|SRR063689X103716_P1 | 5137 | 511 | 82.7 | Globlastp |
| 1119 | fagopyrum|11v1|SRR063703X119295_P1 | 5137 | 511 | 82.7 | Globlastp |
| 1120 | flax|11v1|JG091613_P1 | 5130 | 511 | 82.7 | Globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 1121 | fraxinus\|11v1\|FR644589_P1 | 5138 | 511 | 82.7 | Globlastp |
| 1122 | gossypium_raimondii\|12v1\|DW502606_P1 | 5139 | 511 | 82.7 | Globlastp |
| 1123 | hornbeam\|12v1\|SRR364455.120956_P1 | 5140 | 511 | 82.7 | Globlastp |
| 1124 | lettuce\|12v1\|DW071404_P1 | 5129 | 511 | 82.7 | Globlastp |
| 1125 | lotus\|09v1\|AV416961_P1 | 5141 | 511 | 82.7 | Globlastp |
| 1126 | medicago\|12v1\|AL380692_P1 | 5142 | 511 | 82.7 | Globlastp |
| 1127 | monkeyflower\|10v1\|DV207687 | 5126 | 511 | 82.7 | Globlastp |
| 1128 | nasturtium\|11v1\|GH164582_P1 | 5143 | 511 | 82.7 | Globlastp |
| 1129 | oak\|10v1\|FP071413_P1 | 5144 | 511 | 82.7 | Globlastp |
| 1130 | orobanche\|10v1\|SRR023189S0030303_P1 | 5145 | 511 | 82.7 | Globlastp |
| 1131 | papaya\|gb165\|EX279093_P1 | 5133 | 511 | 82.7 | Globlastp |
| 1132 | plantago\|11v2\|SRR066373X112048_P1 | 5146 | 511 | 82.7 | globlastp |
| 1133 | poplar\|10v1\|BU874698 | 5147 | 511 | 82.7 | Globlastp |
| 1134 | poplar\|13v1\|BU874698_P1 | 5147 | 511 | 82.7 | Globlastp |
| 1135 | sarracenia\|11v1\|SRR192669.107084 | 5148 | 511 | 82.7 | Globlastp |
| 1136 | scabiosa\|11v1\|SRR063723X100953 | 5129 | 511 | 82.7 | Globlastp |
| 1137 | silene\|11v1\|GH291901 | 5149 | 511 | 82.7 | Globlastp |
| 1138 | soybean\|11v1\|CA935603 | 5150 | 511 | 82.7 | Globlastp |
| 1139 | soybean\|12v1\|GLYMA08G41416_P1 | 5150 | 511 | 82.7 | Globlastp |
| 1140 | primula\|11v1\|SRR098679X19709_T1 | 5151 | 511 | 82.67 | Glotblastn |
| 1141 | ambrosia\|11v1\|SRR346943.121702_T1 | 5152 | 511 | 81.33 | Glotblastn |
| 1142 | cotton\|11v1\|SRR032878.248337_T1 | 5153 | 511 | 81.33 | Glotblastn |
| 1143 | ginseng\|10v1\|GR873365_T1 | 5154 | 511 | 81.33 | Glotblastn |
| 1144 | antirrhinum\|gb166\|AJ787817_P1 | 5155 | 511 | 81.3 | Globlastp |
| 1145 | beet\|12v1\|FG345630_P1 | 5156 | 511 | 81.3 | Globlastp |
| 1146 | cacao\|10v1\|CU569368_P1 | 5157 | 511 | 81.3 | Globlastp |
| 1147 | catharanthus\|11v1\|EG557286_P1 | 5158 | 511 | 81.3 | Globlastp |
| 1148 | chelidonium\|11v1\|SRR084752X8369_P1 | 5159 | 511 | 81.3 | Globlastp |
| 1149 | clementine\|11v1\|CK702142_P1 | 5160 | 511 | 81.3 | Globlastp |
| 1150 | cowpea\|12v1\|FF540483_P1 | 5161 | 511 | 81.3 | Globlastp |
| 1151 | curcuma\|10v1\|DY383002_P1 | 5162 | 511 | 81.3 | Globlastp |
| 1152 | epimedium\|11v1\|SRR013502.16811_P1 | 5163 | 511 | 81.3 | Globlastp |
| 1153 | flaveria\|11v1\|SRR149229.461290_P1 | 5164 | 511 | 81.3 | Globlastp |
| 1154 | flaveria\|11v1\|SRR149232.110155_P1 | 5164 | 511 | 81.3 | Globlastp |
| 1155 | flax\|11v1\|EU829659_P1 | 5165 | 511 | 81.3 | Globlastp |
| 1156 | flax\|11v1\|JG089166_P1 | 5165 | 511 | 81.3 | Globlastp |
| 1157 | humulus\|11v1\|EX520119_P1 | 5166 | 511 | 81.3 | Globlastp |
| 1158 | ipomoea_batatas\|10v1\|DC880518_P1 | 5167 | 511 | 81.3 | Globlastp |
| 1159 | maize\|10v1\|CD661850_P1 | 5168 | 511 | 81.3 | Globlastp |
| 1160 | oil_palm\|11v1\|CN601090_P1 | 5169 | 511 | 81.3 | Globlastp |
| 1161 | oil_palm\|11v1\|SRR190698.136067XX1_P1 | 5170 | 511 | 81.3 | Globlastp |
| 1162 | orange\|11v1\|CK702142_P1 | 5160 | 511 | 81.3 | Globlastp |
| 1163 | phyla\|11v2\|SRR099035X101881_P1 | 5171 | 511 | 81.3 | Globlastp |
| 1164 | poplar\|10v1\|BU809431 | 5172 | 511 | 81.3 | Globlastp |
| 1165 | poplar\|13v1\|BU809431_P1 | 5172 | 511 | 81.3 | Globlastp |
| 1166 | switchgrass\|12v1\|FE600473_P1 | 5173 | 511 | 81.3 | Globlastp |
| 1167 | switchgrass\|gb167\|FE600473 | 5173 | 511 | 81.3 | Globlastp |
| 1168 | switchgrass\|12v1\|FL701472_P1 | 5173 | 511 | 81.3 | Globlastp |
| 1169 | switchgrass\|gb167\|FL701472 | 5173 | 511 | 81.3 | Globlastp |
| 1170 | vinca\|11v1\|SRR098690X375698 | 5174 | 511 | 81.3 | Globlastp |
| 1171 | artemisia\|10v1\|SRR019254S0003868_T1 | 5175 | 511 | 80.52 | Glotblastn |
| 1172 | amsonia\|11v1\|SRR098688X208040_P1 | 5176 | 511 | 80 | Globlastp |
| 1173 | b_rapa\|11v1\|CV433672_P1 | 5177 | 511 | 80 | Globlastp |
| 1174 | beech\|11v1\|SRR006294.13815_P1 | 5178 | 511 | 80 | Globlastp |
| 1175 | canola\|11v1\|CN726675_P1 | 5179 | 511 | 80 | globlastp |
| 1176 | cichorium\|gb171\|FL671379_T1 | 5180 | 511 | 80 | Glotblastn |
| 1177 | eucalyptus\|11v2\|SRR001658X14353_P1 | 5181 | 511 | 80 | Globlastp |
| 1178 | flaveria\|11v1\|SRR149229.202694_T1 | 5182 | 511 | 80 | Glotblastn |
| 1179 | foxtail_millet\|11v3\|PHY7SI039204M_P1 | 5183 | 511 | 80 | Globlastp |
| 1180 | pepper\|12v1\|CA517896_P1 | 5184 | 511 | 80 | Globlastp |
| 1181 | poppy\|11v1\|SRR030259.127410_P1 | 5185 | 511 | 80 | Globlastp |
| 1182 | potato\|10v1\|BE922508_P1 | 5186 | 511 | 80 | Globlastp |
| 1183 | sesame\|12v1\|SESI12V1376997 | 5187 | 511 | 80 | Globlastp |
| 1184 | solanum_phureja\|09v1\|SPHBG129993 | 5186 | 511 | 80 | Globlastp |
| 1185 | tabernaemontana\|11v1\|SRR098689X13920 | 5188 | 511 | 80 | Glotblastn |
| 1186 | tomato\|11v1\|BG129993 | 5186 | 511 | 80 | Globlastp |
| 1187 | valeriana\|11v1\|SRR099039X104290 | 5189 | 511 | 80 | Globlastp |
| 1188 | rye\|12v1\|DRR001012.108965 | 5190 | 512 | 87.6 | Globlastp |
| 1189 | rye\|12v1\|DRR001012.212453 | 5191 | 512 | 86.2 | Glotblastn |
| 1190 | rye\|12v1\|DRR001012.185511 | 5192 | 512 | 83.23 | Glotblastn |
| 1191 | rye\|12v1\|DRR001012.357671 | 5193 | 514 | 94.5 | Globlastp |
| 1192 | rye\|12v1\|DRR001017.1001245 | 5194 | 514 | 93.2 | Globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 1193 | wheat\|12v3\|BI480402 | 5195 | 514 | 92.9 | Globlastp |
| 1194 | leymus\|gb166\|CD808617_P1 | 5196 | 514 | 92.6 | Globlastp |
| 1195 | brachypodium\|12v1\|BRADI5G16650_P1 | 5197 | 514 | 87.1 | Globlastp |
| 1196 | rye\|12v1\|DRR001012.224308 | 5198 | 515 | 95.9 | Globlastp |
| 1197 | wheat\|12v3\|BE500638 | 5199 | 515 | 95.1 | Globlastp |
| 1198 | wheat\|12v3\|CA712416 | 5199 | 515 | 95.1 | Globlastp |
| 1199 | brachypodium\|12v1\|BRADI3G30240_P1 | 5200 | 515 | 91.4 | Globlastp |
| 1200 | switchgrass\|12v1\|FL727897_P1 | 5201 | 515 | 88.8 | Globlastp |
| 1201 | foxtail_millet\|11v3\|EC612469_P1 | 5202 | 515 | 88.1 | Globlastp |
| 1202 | millet\|10v1\|EVO454PM146186_P1 | 5203 | 515 | 86.9 | Globlastp |
| 1203 | switchgrass\|gb167\|FL727897 | 5204 | 515 | 86.57 | Glotblastn |
| 1204 | rice\|11v1\|AA751692 | 5205 | 515 | 86.3 | Globlastp |
| 1205 | sorghum\|12v1\|SB01G017780 | 5206 | 515 | 86.2 | Globlastp |
| 1206 | maize\|10v1\|BQ635767_P1 | 5207 | 515 | 84 | Globlastp |
| 1207 | switchgrass\|12v1\|JG795801_P1 | 5208 | 515 | 80.8 | Globlastp |
| 1208 | rye\|12v1\|BE705431 | 5209 | 516 | 92.2 | Globlastp |
| 1209 | wheat\|12v3\|BE418793 | 5210 | 516 | 90.8 | Globlastp |
| 1210 | pseudoroegneria\|gb167\|FF365512 | 5211 | 516 | 87.4 | Globlastp |
| 1211 | oat\|11v1\|CN818599_P1 | 5212 | 516 | 80.6 | Globlastp |
| 1212 | pseudoroegneria\|gb167\|FF345820 | 5213 | 517 | 97 | Globlastp |
| 1213 | wheat\|12v3\|BG906143 | 5214 | 517 | 94 | Globlastp |
| 1214 | rye\|12v1\|DRR001012.123313 | 5215 | 517 | 93.2 | Globlastp |
| 1215 | wheat\|12v3\|CD863564 | 5216 | 517 | 93.2 | Globlastp |
| 1216 | rye\|12v1\|DRR001012.232649 | 5217 | 517 | 91 | Globlastp |
| 1217 | brachypodium\|12v1\|BRADI5G16380_P1 | 5218 | 517 | 82.7 | globlastp |
| 1218 | oat\|11v1\|SRR020741.108378_P1 | 5219 | 517 | 82.7 | Globlastp |
| 1219 | wheat\|12v3\|AL818554 | 5220 | 518 | 94.9 | Globlastp |
| 1220 | rye\|12v1\|DRR001013.158969 | 5221 | 518 | 93.57 | Glotblastn |
| 1221 | brachypodium\|12v1\|BRADI1G10060_P1 | 5222 | 518 | 84.9 | Globlastp |
| 1222 | wheat\|12v3\|BE401071 | 5223 | 519 | 98.1 | Globlastp |
| 1223 | oat\|11v1\|GR321425_P1 | 5224 | 519 | 94.3 | Globlastp |
| 1224 | brachypodium\|12v1\|BRADI2G56960_P1 | 5225 | 519 | 87.7 | Globlastp |
| 1225 | foxtail_millet\|11v3\|PHY7SI002920M_P1 | 5226 | 519 | 82.9 | Globlastp |
| 1226 | rye\|12v1\|DRR001012.106997 | 5227 | 519 | 82.8 | Globlastp |
| 1227 | sorghum\|12v1\|SB03G041820 | 5228 | 519 | 82 | Globlastp |
| 1228 | switchgrass\|12v1\|DN148669_P1 | 5229 | 519 | 81.8 | Globlastp |
| 1229 | rice\|11v1\|BE228600 | 5230 | 519 | 80.8 | Globlastp |
| 1230 | wheat\|12v3\|BE471009 | 5231 | 520 | 98.7 | Globlastp |
| 1231 | brachypodium\|12v1\|BRADI2G52920_P1 | 5232 | 520 | 93.6 | Globlastp |
| 1232 | rice\|11v1\|BM419199 | 5233 | 520 | 92.3 | Globlastp |
| 1233 | rye\|12v1\|DRR001012.242488 | 5234 | 520 | 92.3 | Globlastp |
| 1234 | switchgrass\|12v1\|GD020803_P1 | 5235 | 520 | 92.1 | Globlastp |
| 1235 | foxtail_millet\|11v3\|PHY7SI000692M_P1 | 5236 | 520 | 91.9 | Globlastp |
| 1236 | sorghum\|12v1\|SB03G037610 | 5237 | 520 | 91.7 | Globlastp |
| 1237 | switchgrass\|12v1\|FL762530_P1 | 5238 | 520 | 91.5 | Globlastp |
| 1238 | rye\|12v1\|DRR001012.170719 | 5239 | 521 | 93.6 | Globlastp |
| 1239 | rye\|12v1\|DRR001012.332063 | 5240 | 521 | 92.7 | Globlastp |
| 1240 | wheat\|12v3\|BQ838669 | 5241 | 521 | 92.2 | Globlastp |
| 1241 | wheat\|12v3\|BE604841 | 5242 | 521 | 91.3 | Globlastp |
| 1242 | wheat\|12v3\|CA499090 | 5243 | 521 | 91.27 | Glotblastn |
| 1243 | brachypodium\|12v1\|BRADI4G18990_P1 | 5244 | 521 | 80.9 | Globlastp |
| 1244 | wheat\|12v3\|BE398791 | 5245 | 522 | 91.39 | Glotblastn |
| 1245 | wheat\|12v3\|CA501681 | 5246 | 522 | 90.73 | Glotblastn |
| 1246 | rye\|12v1\|DRR001012.104069 | 5247 | 522 | 90.7 | Globlastp |
| 1247 | rye\|12v1\|DRR001012.201893 | 5248 | 522 | 87.8 | Globlastp |
| 1248 | oat\|11v1\|GO589461_T1 | 5249 | 523 | 94.23 | Glotblastn |
| 1249 | wheat\|12v3\|BQ242398 | 5250 | 523 | 93.4 | Globlastp |
| 1250 | rye\|12v1\|DRR001012.144328 | 5251 | 523 | 91.2 | Globlastp |
| 1251 | switchgrass\|12v1\|FE647391_P1 | 5252 | 523 | 87.9 | Globlastp |
| 1252 | sorghum\|12v1\|SB02G038400 | 5253 | 523 | 87.1 | Globlastp |
| 1253 | cenchrus\|gb166\|EB660107_P1 | 5254 | 523 | 86 | Globlastp |
| 1254 | sugarcane\|10v1\|BU103051 | 5255 | 523 | 85.71 | Glotblastn |
| 1255 | maize\|10v1\|AI901319_P1 | 5256 | 523 | 85.7 | Globlastp |
| 1256 | brachypodium\|12v1\|BRADI1G22510T2_T1 | 5257 | 523 | 84.34 | glotblastn |
| 1257 | leymus\|gb166\|CD808969_P1 | 5258 | 524 | 94.2 | Globlastp |
| 1258 | rye\|12v1\|BF145403 | 5259 | 524 | 93.8 | Globlastp |
| 1259 | wheat\|12v3\|BE497921 | 5260 | 524 | 93.8 | Globlastp |
| 1260 | wheat\|12v3\|BE499980 | 5261 | 524 | 93.4 | Globlastp |
| 1261 | pseudoroegneria\|gb167\|FF343777 | 5262 | 524 | 93.3 | Globlastp |
| 1262 | rye\|12v1\|DRR001012.120114 | 5263 | 524 | 93.3 | Globlastp |
| 1263 | wheat\|12v3\|CA659640 | 5264 | 524 | 93.3 | Globlastp |
| 1264 | wheat\|12v3\|BE400339 | 5265 | 524 | 92.9 | Globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 1265 | wheat|12v3|SRR043326X33530D1 | 5266 | 524 | 90.91 | Glotblastn |
| 1266 | oat|11v1|CN816389_P1 | 5267 | 524 | 88.8 | Globlastp |
| 1267 | oat|11v1|GR353761_P1 | 5268 | 524 | 88.8 | Globlastp |
| 1268 | barley|12v1|BF621527_P1 | 5269 | 524 | 87.5 | Globlastp |
| 1269 | rye|12v1|DRR001012.110990 | 5270 | 524 | 87.5 | Globlastp |
| 1270 | rye|12v1|DRR001012.408028 | 5271 | 524 | 87.5 | Globlastp |
| 1271 | oat|11v1|CN820431_P1 | 5272 | 524 | 87.1 | Globlastp |
| 1272 | oat|11v1|CN821230_P1 | 5273 | 524 | 87.1 | Globlastp |
| 1273 | wheat|12v3|BE606497 | 5274 | 524 | 87.1 | Globlastp |
| 1274 | rye|12v1|DRR001012.189460 | 5275 | 524 | 86.7 | Globlastp |
| 1275 | wheat|12v3|CA647190 | 5276 | 524 | 86.7 | Globlastp |
| 1276 | rye|12v1|DRR001017.1023470 | — | 524 | 86.67 | Glotblastn |
| 1277 | lolium|10v1|AU249832_T1 | 5277 | 524 | 86.25 | Glotblastn |
| 1278 | oat|11v1|GR330569_T1 | 5278 | 524 | 86.25 | Glotblastn |
| 1279 | brachypodium|12v1|BRADI2G26040_P1 | 5279 | 524 | 86.2 | Globlastp |
| 1280 | oat|11v1|CN821538XX2_P1 | 5280 | 524 | 86.2 | Globlastp |
| 1281 | rice|11v1|BM419373 | 5281 | 524 | 83.8 | Globlastp |
| 1282 | switchgrass|12v1|DN143316_P1 | 5282 | 524 | 81.7 | Globlastp |
| 1283 | switchgrass|gb167|DN143316 | 5282 | 524 | 81.7 | Globlastp |
| 1284 | switchgrass|gb167|DN140861 | 5283 | 524 | 80.4 | Globlastp |
| 1285 | brachypodium|12v1|BRADI2G26050_P1 | 5284 | 524 | 80 | Globlastp |
| 1286 | rye|12v1|DRR001012.109115 | 5285 | 525 | 97.9 | Globlastp |
| 1287 | wheat|12v3|BE405752 | 5286 | 525 | 95.1 | Globlastp |
| 1288 | brachypodium|12v1|BRADI1G66220_P1 | 5287 | 525 | 93.7 | Globlastp |
| 1289 | oat|11v1|CN817185_T1 | 5288 | 525 | 92.33 | Glotblastn |
| 1290 | switchgrass|12v1|DN141372_P1 | 5289 | 525 | 90.6 | Globlastp |
| 1291 | foxtail_millet|11v3|PHY7SI034514M_P1 | 5290 | 525 | 90.3 | Globlastp |
| 1292 | switchgrass|12v1|FL810949_P1 | 5291 | 525 | 90.1 | Globlastp |
| 1293 | maize|10v1|CD986980_P1 | 5292 | 525 | 88.9 | Globlastp |
| 1294 | maize|10v1|CD970103_P1 | 5293 | 525 | 88.2 | Globlastp |
| 1295 | sorghum|12v1|SB01G039040 | 5294 | 525 | 88.2 | Globlastp |
| 1296 | rye|12v1|BE587213 | 5295 | 525 | 82.9 | Globlastp |
| 1297 | wheat|12v3|BE401045 | 5296 | 526 | 99.1 | Globlastp |
| 1298 | rye|12v1|BF146231 | 5297 | 526 | 98.4 | globlastp |
| 1299 | rye|12v1|DRR001012.131820 | 5298 | 526 | 98.3 | Globlastp |
| 1300 | wheat|12v3|CA610861 | 5299 | 526 | 98.27 | Glotblastn |
| 1301 | rye|12v1|BE495644 | 5300 | 526 | 97.1 | Globlastp |
| 1302 | wheat|12v3|BU100178 | 5301 | 526 | 95.8 | Globlastp |
| 1303 | rye|12v1|DRR001012.100172 | 5302 | 526 | 90.1 | Globlastp |
| 1304 | brachypodium|12v1|BRADI1G34700_P1 | 5303 | 526 | 89 | Globlastp |
| 1305 | switchgrass|12v1|FL729730_P1 | 5304 | 526 | 85.9 | Globlastp |
| 1306 | switchgrass|12v1|FE607339_P1 | 5305 | 526 | 85.7 | Globlastp |
| 1307 | foxtail_millet|11v3|EC612518_P1 | 5306 | 526 | 85.6 | Globlastp |
| 1308 | millet|10v1|EVO454PM003124_P1 | 5307 | 526 | 85.3 | Globlastp |
| 1309 | rice|11v1|AF177392 | 5308 | 526 | 85.2 | Globlastp |
| 1310 | sorghum|12v1|SB10G029400 | 5309 | 526 | 85.2 | Globlastp |
| 1311 | maize|10v1|AI622260_P1 | 5310 | 526 | 85 | Globlastp |
| 1312 | maize|10v1|AW066502_P1 | 5311 | 526 | 83.4 | Globlastp |
| 1313 | switchgrass|gb167|FE607339 | 5312 | 526 | 83.1 | Globlastp |
| 1314 | sugarcane|10v1|CA074388 | 5313 | 526 | 80.21 | Glotblastn |
| 1315 | wheat|12v3|BE497581 | 5314 | 527 | 98.3 | Globlastp |
| 1316 | rye|12v1|DRR001013.119954 | 5315 | 527 | 93.2 | Globlastp |
| 1317 | pseudoroegneria|gb167|FF363407 | 5316 | 527 | 91.5 | Globlastp |
| 1318 | rye|12v1|DRR001012.195564 | 5317 | 527 | 87 | Globlastp |
| 1319 | oat|11v1|GR314800_P1 | 5318 | 527 | 84.7 | Globlastp |
| 1320 | wheat|12v3|CA659082 | 5319 | 528 | 86.9 | Globlastp |
| 1321 | wheat|12v3|BE399087 | 5320 | 528 | 85.9 | Globlastp |
| 1322 | rye|12v1|DRR001012.133312 | 5321 | 528 | 85.1 | Globlastp |
| 1323 | cotton|11v1|BM360081_P1 | 529 | 529 | 100 | Globlastp |
| 1324 | leymus|gb166|CD808644_P1 | 5322 | 529 | 98.5 | Globlastp |
| 1325 | pseudoroegneria|gb167|FF343068 | 5322 | 529 | 98.5 | Globlastp |
| 1326 | fescue|gb161|DT682777_P1 | 5323 | 529 | 96.2 | Globlastp |
| 1327 | lolium|10v1|AU247068_P1 | 5323 | 529 | 96.2 | Globlastp |
| 1328 | lolium|10v1|AU248778_P1 | 5323 | 529 | 96.2 | Globlastp |
| 1329 | lolium|10v1|ES700148_P1 | 5323 | 529 | 96.2 | Globlastp |
| 1330 | oat|11v1|CN817547_P1 | 5324 | 529 | 96.2 | Globlastp |
| 1331 | rye|12v1|BE495991 | 5325 | 529 | 96.2 | Globlastp |
| 1332 | wheat|12v3|BE213292 | 5326 | 529 | 94.7 | Globlastp |
| 1333 | wheat|12v3|BE489656 | 5326 | 529 | 94.7 | Globlastp |
| 1334 | wheat|12v3|BE591409 | 5327 | 529 | 94.7 | Globlastp |
| 1335 | wheat|12v3|BF484348 | 5327 | 529 | 94.7 | Globlastp |
| 1336 | wheat|12v3|BG313200 | 5327 | 529 | 94.7 | Globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 1337 | wheat|12v3|CA622060 | 5326 | 529 | 94.7 | Globlastp |
| 1338 | wheat|12v3|BE401177 | 5328 | 529 | 93.9 | Globlastp |
| 1339 | wheat|12v3|BQ902651 | 5328 | 529 | 93.9 | Globlastp |
| 1340 | wheat|12v3|CA598071 | 5328 | 529 | 93.9 | Globlastp |
| 1341 | rye|12v1|BE704517 | 5329 | 529 | 92.4 | Globlastp |
| 1342 | rice|11v1|BE228794 | 5330 | 529 | 91 | Globlastp |
| 1343 | brachypodium|12v1|BRADI1G58350_P1 | 5331 | 529 | 89.6 | globlastp |
| 1344 | sorghum|12v1|SB02G002960 | 5332 | 529 | 87.2 | Globlastp |
| 1345 | sugarcane|10v1|BQ534985 | 5333 | 529 | 87.2 | Globlastp |
| 1346 | wheat|12v3|AL809977 | 5334 | 529 | 87.02 | Glotblastn |
| 1347 | maize|10v1|T12694_P1 | 5335 | 529 | 85.3 | Globlastp |
| 1348 | lovegrass|gb167|DN480912_P1 | 5336 | 529 | 85 | Globlastp |
| 1349 | wheat|12v3|ERR125556X287344D1 | 5337 | 529 | 84.21 | Glotblastn |
| 1350 | switchgrass|12v1|DN145166_T1 | 5338 | 529 | 82.71 | Glotblastn |
| 1351 | cynodon|10v1|ES294536_P1 | 5339 | 529 | 82.1 | Globlastp |
| 1352 | switchgrass|gb167|DN145166 | 5340 | 529 | 81.8 | Globlastp |
| 1353 | switchgrass|gb167|FL733379 | 5340 | 529 | 81.8 | Globlastp |
| 1354 | rye|12v1|DRR001012.213569 | 5341 | 530 | 96.1 | Globlastp |
| 1355 | brachypodium|12v1|BRADI3G47827_P1 | 5342 | 530 | 86.7 | Globlastp |
| 1356 | wheat|12v3|CD871072 | 5343 | 532 | 97.7 | Globlastp |
| 1357 | wheat|12v3|BF474530XX1 | 5344 | 532 | 97.5 | Globlastp |
| 1358 | wheat|12v3|BE400686 | 5345 | 532 | 89.6 | Globlastp |
| 1359 | brachypodium|12v1|BRADI1G11010_P1 | 5346 | 532 | 87.8 | Globlastp |
| 1360 | rice|11v1|AU085903 | 5347 | 532 | 84 | Globlastp |
| 1361 | switchgrass|12v1|FL993073_P1 | 5348 | 532 | 83.9 | Globlastp |
| 1362 | foxtail_millet|11v3|PHY7SI035418M_P1 | 5349 | 532 | 83.1 | Globlastp |
| 1363 | switchgrass|12v1|HO255276_P1 | 5350 | 532 | 82.9 | Globlastp |
| 1364 | sorghum|12v1|SB01G010740 | 5351 | 532 | 82.2 | Globlastp |
| 1365 | maize|10v1|GFXAF466646X7_P1 | 5352 | 532 | 80.6 | Globlastp |
| 1366 | millet|10v1|EVO454PM107234_P1 | 5353 | 532 | 80.3 | Globlastp |
| 1367 | rye|12v1|DRR001012.488024 | 5354 | 533 | 84.7 | Globlastp |
| 1368 | pseudoroegneria|gb167|FF343480 | 5355 | 534 | 95.7 | Globlastp |
| 1369 | wheat|12v3|BE427624 | 5356 | 534 | 95.1 | Globlastp |
| 1370 | brachypodium|12v1|BRADI4G07630_P1 | 5357 | 534 | 85.5 | Globlastp |
| 1371 | leymus|gb166|EG385219_P1 | 5358 | 534 | 83.7 | Globlastp |
| 1372 | wheat|12v3|BE497169 | 5359 | 536 | 91.8 | Globlastp |
| 1373 | brachypodium|12v1|BRADI1G29260_P1 | 5360 | 536 | 88.9 | Globlastp |
| 1374 | rye|12v1|DRR001012.198573 | 5361 | 536 | 88.2 | Globlastp |
| 1375 | maize|10v1|CD435598_P1 | 5362 | 536 | 82.8 | Globlastp |
| 1376 | switchgrass|12v1|FE648909_P1 | 5363 | 536 | 81.9 | Globlastp |
| 1377 | switchgrass|12v1|JG772911_P1 | 5364 | 536 | 81.9 | Globlastp |
| 1378 | sorghum|12v1|SB04G008410 | 5365 | 536 | 81.9 | Globlastp |
| 1379 | foxtail_millet|11v3|PHY7SI017733M_P1 | 5366 | 536 | 81.7 | Globlastp |
| 1380 | oat|11v1|CN816172_P1 | 5367 | 538 | 90.5 | Globlastp |
| 1381 | leymus|gb166|EG375497_P1 | 5368 | 538 | 88 | Globlastp |
| 1382 | rye|12v1|DRR001012.178125 | 5369 | 538 | 87.6 | Globlastp |
| 1383 | rye|12v1|DRR001012.109571 | 5370 | 538 | 87.5 | globlastp |
| 1384 | wheat|12v3|BG906668 | 5371 | 538 | 87.3 | Globlastp |
| 1385 | rice|11v1|BI305275 | 5372 | 538 | 85.4 | Globlastp |
| 1386 | foxtail_millet|11v3|PHY7SI030372M_P1 | 5373 | 538 | 84.6 | Globlastp |
| 1387 | sugarcane|10v1|CA093845 | 5374 | 538 | 84.4 | Globlastp |
| 1388 | switchgrass|gb167|FL843236 | 5375 | 538 | 84.3 | Globlastp |
| 1389 | sorghum|12v1|SB02G037160 | 5376 | 538 | 83.7 | Globlastp |
| 1390 | switchgrass|gb167|FE599488 | 5377 | 538 | 83.4 | Globlastp |
| 1391 | switchgrass|12v1|FE599488_P1 | 5377 | 538 | 83.4 | Globlastp |
| 1392 | pseudoroegneria|gb167|FF360233 | 5378 | 538 | 80.92 | Glotblastn |
| 1393 | maize|10v1|AW018052_P1 | 5379 | 538 | 80.7 | Globlastp |
| 1394 | oat|11v1|GR329271_P1 | 5380 | 539 | 88.7 | Globlastp |
| 1395 | wheat|12v3|CA698473 | 5381 | 539 | 87.2 | Globlastp |
| 1396 | leymus|gb166|EG376445_P1 | 5382 | 540 | 82.4 | Globlastp |
| 1397 | barley|12v1|BI956005_P1 | 5383 | 540 | 81.7 | Globlastp |
| 1398 | wheat|12v3|CA486000 | 5384 | 540 | 81.3 | Globlastp |
| 1399 | wheat|12v3|CJ730962 | 5385 | 540 | 81.3 | Globlastp |
| 1400 | rye|12v1|DRR001012.193999 | 5386 | 542 | 83.76 | Glotblastn |
| 1401 | wheat|12v3|CN011800 | 5387 | 542 | 83.76 | Glotblastn |
| 1402 | wheat|12v3|BE498036 | 5388 | 542 | 81.7 | Globlastp |
| 1403 | fescue|gb161|DT679740_P1 | 5389 | 545 | 93.9 | Globlastp |
| 1404 | fescue|gb161|DT691334_P1 | 5390 | 545 | 93.9 | Globlastp |
| 1405 | lolium|10v1|AU246445_P1 | 5390 | 545 | 93.9 | Globlastp |
| 1406 | rye|12v1|BE705421 | 5391 | 545 | 93.9 | Globlastp |
| 1407 | rye|12v1|DRR001012.255916 | 5391 | 545 | 93.9 | Globlastp |
| 1408 | wheat|12v3|BE213321 | 5392 | 545 | 93.13 | Glotblastn |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 1409 | wheat\|12v3\|CA485361 | 5393 | 545 | 93.13 | Glotblastn |
| 1410 | rye\|12v1\|BE494174 | 5394 | 545 | 93.1 | Globlastp |
| 1411 | rye\|12v1\|BE704951 | 5394 | 545 | 93.1 | Globlastp |
| 1412 | rye\|12v1\|DRR001012.111099 | 5395 | 545 | 93.1 | Globlastp |
| 1413 | rye\|12v1\|DRR001012.177842 | 5395 | 545 | 93.1 | Globlastp |
| 1414 | wheat\|12v3\|BE425717 | 5394 | 545 | 93.1 | Globlastp |
| 1415 | leymus\|gb166\|CD808577_P1 | 5396 | 545 | 92.4 | Globlastp |
| 1416 | oat\|11v1\|CN818813_P1 | 5397 | 545 | 92.4 | Globlastp |
| 1417 | oat\|11v1\|GR318139_P1 | 5397 | 545 | 92.4 | Globlastp |
| 1418 | pseudoroegneria\|gb167\|FF350411 | 5398 | 545 | 92.4 | Globlastp |
| 1419 | wheat\|12v3\|BE213279 | 5399 | 545 | 92.4 | Globlastp |
| 1420 | wheat\|12v3\|BE490342 | 5400 | 545 | 92.4 | Globlastp |
| 1421 | wheat\|12v3\|BQ172432 | 5401 | 545 | 90.8 | Globlastp |
| 1422 | foxtail_millet\|11v3\|PHY7SI003335M_P1 | 5402 | 545 | 86.3 | Globlastp |
| 1423 | switchgrass\|12v1\|DN147511_P1 | 5403 | 545 | 85.5 | Globlastp |
| 1424 | lovegrass\|gb167\|DN480881_P1 | 5404 | 545 | 84.7 | Globlastp |
| 1425 | sorghum\|12v1\|SB03G036090 | 5405 | 545 | 84.7 | Globlastp |
| 1426 | millet\|10v1\|EVO454PM000328_P1 | 5406 | 545 | 84.1 | Globlastp |
| 1427 | maize\|10v1\|AA979823_P1 | 5407 | 545 | 83.2 | Globlastp |
| 1428 | sugarcane\|10v1\|BQ533710 | 5408 | 545 | 83.2 | globlastp |
| 1429 | cynodon\|10v1\|ES292620_P1 | 5409 | 545 | 80.9 | Globlastp |
| 1430 | rye\|12v1\|DRR001012.203718 | 5410 | 546 | 82.1 | Globlastp |
| 1431 | barley\|12v1\|AK362455_P1 | 5411 | 546 | 82 | Globlastp |
| 1432 | rye\|12v1\|DRR001012.364636XX2 | 5412 | 547 | 91.5 | Globlastp |
| 1433 | wheat\|12v3\|BG906134 | 5413 | 547 | 85.3 | Globlastp |
| 1434 | sorghum\|12v1\|SB01G019390 | 5414 | 547 | 84.9 | Globlastp |
| 1435 | switchgrass\|12v1\|FL796929_P1 | 5415 | 547 | 84.2 | Globlastp |
| 1436 | foxtail_millet\|11v3\|PHY7SI035447M_P1 | 5416 | 547 | 83.6 | Globlastp |
| 1437 | maize\|10v1\|AW062079_T1 | 5417 | 547 | 82.5 | Glotblastn |
| 1438 | switchgrass\|12v1\|HO311456_T1 | 5418 | 547 | 82.22 | Glotblastn |
| 1439 | wheat\|12v3\|BE422609 | 5419 | 548 | 88.8 | Globlastp |
| 1440 | rye\|12v1\|DRR001012.103563 | 5420 | 548 | 87.9 | Globlastp |
| 1441 | switchgrass\|12v1\|FL743281_P1 | 5421 | 548 | 86.3 | Globlastp |
| 1442 | rice\|11v1\|BE228296 | 5422 | 548 | 85.1 | Globlastp |
| 1443 | switchgrass\|gb167\|FL690808 | 5423 | 548 | 84.76 | Glotblastn |
| 1444 | switchgrass\|12v1\|FL690808_P1 | 5424 | 548 | 84.3 | Globlastp |
| 1445 | sorghum\|12v1\|SB04G022720 | 5425 | 548 | 83.9 | Globlastp |
| 1446 | sugarcane\|10v1\|CA070574 | 5426 | 548 | 83.5 | Globlastp |
| 1447 | foxtail_millet\|11v3\|PHY7SI017131M_P1 | 5427 | 548 | 82.6 | Globlastp |
| 1448 | maize\|10v1\|AI396326_P1 | 5428 | 548 | 81.5 | Globlastp |
| 1449 | maize\|10v1\|AW181177_P1 | 5429 | 548 | 81 | Globlastp |
| 1450 | barley\|12v1\|AJ467829_P1 | 5430 | 549 | 85.7 | Globlastp |
| 1451 | rye\|12v1\|DRR001012.319825 | 5431 | 549 | 84.09 | Glotblastn |
| 1452 | rice\|11v1\|AU070649 | 5432 | 549 | 81.5 | Globlastp |
| 1453 | switchgrass\|12v1\|FE634937_P1 | 5433 | 551 | 86.3 | Globlastp |
| 1454 | switchgrass\|gb167\|FE634937 | 5433 | 551 | 86.3 | Globlastp |
| 1455 | switchgrass\|12v1\|FL763870_P1 | 5434 | 551 | 84.8 | Globlastp |
| 1456 | switchgrass\|gb167\|FL763870 | 5435 | 551 | 84.3 | Globlastp |
| 1457 | oat\|11v1\|GR316278_P1 | 5436 | 551 | 83.3 | Globlastp |
| 1458 | foxtail_millet\|11v3\|PHY7SI031243M_P1 | 5437 | 551 | 82.7 | globlastp |
| 1459 | sorghum\|12v1\|SB02G023570 | 5438 | 551 | 82.7 | globlastp |
| 1460 | wheat\|12v3\|BQ171089_P1 | 5439 | 551 | 82.2 | globlastp |
| 1461 | wheat\|12v3\|BQ171089 | — | 551 | 82.2 | globlastp |
| 1462 | wheat\|12v3\|CA661505 | 5440 | 551 | 82.18 | glotblastn |
| 1463 | foxtail_millet\|11v3\|SIPRD087399_T1 | 5441 | 551 | 81.77 | glotblastn |
| 1464 | maize\|10v1\|BM428903_P1 | 5442 | 551 | 81.5 | globlastp |
| 1465 | maize\|10v1\|W21661_P1 | 5443 | 551 | 81.2 | globlastp |
| 1466 | wheat\|12v3\|CA623670 | 5444 | 552 | 87.35 | glotblastn |
| 1467 | rye\|12v1\|DRR001012.157917 | 5445 | 552 | 86.62 | glotblastn |
| 1468 | barley\|12v1\|BE454565_T1 | 5446 | 552 | 86.38 | glotblastn |
| 1469 | leymus\|gb166\|CD809177_P1 | 5447 | 552 | 86.2 | globlastp |
| 1470 | oat\|11v1\|GR317195_P1 | 5448 | 552 | 86.2 | globlastp |
| 1471 | pseudoroegneria\|gb167\|FF347096 | 5449 | 552 | 85.92 | glotblastn |
| 1472 | wheat\|12v3\|CA623873 | 5450 | 552 | 83.8 | glotblastn |
| 1473 | rye\|12v1\|BE495785 | 5451 | 553 | 95.7 | globlastp |
| 1474 | rye\|12v1\|DRR001012.134593 | 5451 | 553 | 95.7 | globlastp |
| 1475 | rye\|12v1\|DRR001012.147680 | 5451 | 553 | 95.7 | globlastp |
| 1476 | wheat\|12v3\|BE422943 | 5451 | 553 | 95.7 | globlastp |
| 1477 | oat\|11v1\|GO590320_P1 | 5452 | 553 | 92.3 | globlastp |
| 1478 | foxtail_millet\|11v3\|PHY7SI031452M_P1 | 5453 | 553 | 92.2 | globlastp |
| 1479 | maize\|10v1\|W21718_P1 | 5454 | 553 | 90.8 | globlastp |
| 1480 | millet\|10v1\|EVO454PM017015_P1 | 5455 | 553 | 90.8 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 1481 | sorghum\|12v1\|SB02G026370 | 5454 | 553 | 90.8 | globlastp |
| 1482 | sugarcane\|10v1\|CA128222 | 5454 | 553 | 90.8 | globlastp |
| 1483 | switchgrass\|12v1\|FL774162_P1 | 5456 | 553 | 90.8 | globlastp |
| 1484 | switchgrass\|gb167\|FL774162 | 5456 | 553 | 90.8 | globlastp |
| 1485 | switchgrass\|12v1\|FL795215_P1 | 5457 | 553 | 90.8 | globlastp |
| 1486 | switchgrass\|gb167\|FL795215 | 5457 | 553 | 90.8 | globlastp |
| 1487 | fescue\|gb161\|DT692951_T1 | 5458 | 553 | 90.14 | glotblastn |
| 1488 | cenchrus\|gb166\|EB658601_P1 | 5459 | 553 | 90.1 | globlastp |
| 1489 | rice\|11v1\|BE040870 | 5460 | 553 | 90.1 | globlastp |
| 1490 | lovegrass\|gb167\|EH186261_P1 | 5461 | 553 | 88.7 | globlastp |
| 1491 | onion\|12v1\|SRR073446X183856D1_P1 | 5462 | 553 | 83.1 | globlastp |
| 1492 | oil_palm\|11v1\|SRR190698.156092_P1 | 5463 | 553 | 82.3 | globlastp |
| 1493 | banana\|12v1\|MAGEN2012032091_P1 | 5464 | 553 | 81.6 | globlastp |
| 1494 | oil_palm\|11v1\|SRR190698.146249_P1 | 5465 | 553 | 81.6 | globlastp |
| 1495 | pineapple\|10v1\|CO731184_P1 | 5466 | 553 | 80.3 | globlastp |
| 1496 | wheat\|12v3\|CA688346 | 5467 | 554 | 89 | globlastp |
| 1497 | wheat\|12v3\|SRR400820X1243828D1 | 5468 | 554 | 88.34 | glotblastn |
| 1498 | brachypodium\|12v1\|BRADI3G28640_T1 | 5469 | 554 | 88.2 | glotblastn |
| 1499 | foxtail_millet\|11v3\|PHY7SI033896M_P1 | 5470 | 554 | 87.8 | globlastp |
| 1500 | rye\|12v1\|DRR001012.220311 | 5471 | 554 | 86.4 | globlastp |
| 1501 | wheat\|12v3\|BQ842364 | 5472 | 554 | 86.4 | globlastp |
| 1502 | rye\|12v1\|DRR001012.134897 | 5473 | 554 | 85.4 | globlastp |
| 1503 | rice\|11v1\|CA762958 | 5474 | 554 | 83.3 | globlastp |
| 1504 | rice\|11v1\|CF323676 | 5475 | 554 | 82.9 | globlastp |
| 1505 | wheat\|12v3\|BJ228061 | 5476 | 554 | 82.8 | globlastp |
| 1506 | sorghum\|12v1\|CN141557 | 5477 | 554 | 81.6 | globlastp |
| 1507 | foxtail_millet\|11v3\|PHY7SI033895M_P1 | 5478 | 554 | 81.5 | globlastp |
| 1508 | switchgrass\|12v1\|FL705693_P1 | 5479 | 554 | 81.1 | globlastp |
| 1509 | switchgrass\|12v1\|DN150555_P1 | 5480 | 554 | 81 | globlastp |
| 1510 | foxtail_millet\|11v3\|PHY7SI000061M_P1 | 5481 | 554 | 80.9 | globlastp |
| 1511 | maize\|10v1\|AI973421_P1 | 5482 | 554 | 80.8 | globlastp |
| 1512 | sorghum\|12v1\|SB06G031310_P1 | 5483 | 554 | 80.7 | globlastp |
| 1513 | switchgrass\|gb167\|FL725227 | 5484 | 556 | 94.92 | glotblastn |
| 1514 | switchgrass\|12v1\|FL725227_P1 | 5485 | 556 | 94.9 | globlastp |
| 1515 | switchgrass\|12v1\|FL786219_P1 | 5486 | 556 | 94.1 | globlastp |
| 1516 | sorghum\|12v1\|SB02G011240 | 5487 | 556 | 93.9 | globlastp |
| 1517 | maize\|10v1\|AW191437_P1 | 5488 | 556 | 92.9 | globlastp |
| 1518 | rice\|11v1\|BM038990 | 5489 | 556 | 86.7 | globlastp |
| 1519 | rye\|12v1\|DRR001012.113915 | 5490 | 556 | 85.9 | globlastp |
| 1520 | rye\|12v1\|DRR001012.149120 | 5491 | 556 | 85.9 | globlastp |
| 1521 | brachypodium\|12v1\|BRADI4G38070_P1 | 5492 | 556 | 85.4 | globlastp |
| 1522 | wheat\|12v3\|BE415805 | 5493 | 556 | 85 | globlastp |
| 1523 | switchgrass\|12v1\|FL885636_P1 | 5494 | 557 | 91.9 | globlastp |
| 1524 | sugarcane\|10v1\|CA093115 | 5495 | 557 | 88.5 | globlastp |
| 1525 | switchgrass\|gb167\|FL885636 | 5496 | 557 | 87.86 | glotblastn |
| 1526 | millet\|10v1\|EVO454PM001855_T1 | 5497 | 557 | 85.68 | glotblastn |
| 1527 | maize\|10v1\|AA979989_P1 | 5498 | 557 | 85 | globlastp |
| 1528 | sorghum\|12v1\|SB09G025680 | 5499 | 557 | 82.6 | globlastp |
| 1529 | brachypodium\|12v1\|BRADI2G19700_P1 | 5500 | 557 | 81.3 | globlastp |
| 1530 | rice\|11v1\|AA754000 | 5501 | 557 | 81.3 | globlastp |
| 1531 | pseudoroegneria\|gb167\|FF359838 | 5502 | 557 | 81 | globlastp |
| 1532 | wheat\|12v3\|BF478401 | 5503 | 557 | 81 | globlastp |
| 1533 | oat\|11v1\|GO586759_P1 | 5504 | 557 | 80.5 | globlastp |
| 1534 | rye\|12v1\|BE587278 | 5505 | 557 | 80.4 | globlastp |
| 1535 | rye\|12v1\|DRR001012.711688 | 5506 | 557 | 80.1 | globlastp |
| 1536 | switchgrass\|12v1\|FL756755_P1 | 5507 | 558 | 81.7 | globlastp |
| 1537 | switchgrass\|12v1\|FL715104_P1 | 5508 | 558 | 81.4 | globlastp |
| 1538 | maize\|10v1\|EC877313_P1 | 5509 | 559 | 84.8 | globlastp |
| 1539 | sorghum\|12v1\|SB03G035270 | 5510 | 559 | 83.7 | globlastp |
| 1540 | switchgrass\|gb167\|FE629499 | 5511 | 560 | 92.22 | glotblastn |
| 1541 | sorghum\|12v1\|SB03G037090 | 5512 | 560 | 90.3 | globlastp |
| 1542 | maize\|10v1\|CD941687_P1 | 5513 | 560 | 89.7 | globlastp |
| 1543 | barley\|12v1\|BG299761_P1 | 5514 | 560 | 86 | globlastp |
| 1544 | rye\|12v1\|DRR001012.117815 | 5515 | 560 | 84.3 | globlastp |
| 1545 | brachypodium\|12v1\|BRADI2G52390_P1 | 5516 | 560 | 83 | globlastp |
| 1546 | maize\|10v1\|CD942894_P1 | 5517 | 560 | 82.2 | globlastp |
| 1547 | switchgrass\|12v1\|FL879437_P1 | 5518 | 561 | 87.6 | globlastp |
| 1548 | switchgrass\|12v1\|DN148904_P1 | 5519 | 561 | 84.6 | globlastp |
| 1549 | maize\|10v1\|BE344773_P1 | 5520 | 561 | 80.2 | globlastp |
| 1550 | switchgrass\|12v1\|DN140762_P1 | 5521 | 562 | 94.4 | globlastp |
| 1551 | millet\|10v1\|EVO454PM450141_P1 | 5522 | 562 | 92.9 | globlastp |
| 1552 | switchgrass\|gb167\|FL726353 | 5523 | 562 | 86.1 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 1553 | maize|10v1|BM339029_P1 | 5524 | 562 | 85.1 | globlastp |
| 1554 | sorghum|12v1|SB03G027790 | 5525 | 562 | 82.9 | globlastp |
| 1555 | switchgrass|12v1|DN147735_P1 | 5526 | 564 | 92 | globlastp |
| 1556 | sugarcane|10v1|BQ532774 | 5527 | 564 | 89.4 | globlastp |
| 1557 | switchgrass|12v1|DN141369_T1 | 5528 | 564 | 89.01 | glotblastn |
| 1558 | sorghum|12v1|SB10G026060 | 5529 | 564 | 88.5 | globlastp |
| 1559 | maize|10v1|T12685_P1 | 5530 | 564 | 86.8 | globlastp |
| 1560 | millet|10v1|EVO454PM016904_P1 | 5531 | 565 | 95.2 | globlastp |
| 1561 | switchgrass|12v1|FL798747_P1 | 5532 | 565 | 93.3 | globlastp |
| 1562 | switchgrass|gb167|FL981656 | 5533 | 565 | 93.3 | globlastp |
| 1563 | sorghum|12v1|SB06G028830 | 5534 | 565 | 92 | globlastp |
| 1564 | maize|10v1|BM338514_P1 | 5535 | 565 | 90.7 | globlastp |
| 1565 | maize|10v1|BM895380_P1 | 5536 | 565 | 88.5 | globlastp |
| 1566 | brachypodium|12v1|BRADI5G22007_P1 | 5537 | 565 | 84.5 | globlastp |
| 1567 | rice|11v1|BI801437 | 5538 | 565 | 83.3 | globlastp |
| 1568 | wheat|12v3|BE516240 | 5539 | 565 | 81.2 | globlastp |
| 1569 | rye|12v1|DRR001012.10091 | 5540 | 565 | 80.7 | globlastp |
| 1570 | barley|12v1|BQ760382_P1 | 5541 | 565 | 80.5 | globlastp |
| 1571 | sorghum|12v1|SB04G004190 | 5542 | 568 | 80.7 | globlastp |
| 1572 | millet|10v1|EVO454PM036906_P1 | 5543 | 569 | 87.9 | globlastp |
| 1573 | switchgrass|12v1|FE606715_P1 | 5544 | 569 | 84.5 | globlastp |
| 1574 | switchgrass|12v1|FE597648_P1 | 5545 | 569 | 83.9 | globlastp |
| 1575 | switchgrass|gb167|FE597648 | 5546 | 569 | 83.6 | globlastp |
| 1576 | millet|10v1|PMSLX0012767D1_P1 | 5547 | 570 | 81.6 | globlastp |
| 1577 | switchgrass|gb167|FE609828 | 5548 | 570 | 80.5 | globlastp |
| 1578 | switchgrass|12v1|FL784509_P1 | 5549 | 571 | 94 | globlastp |
| 1579 | maize|10v1|AW267378_P1 | 5550 | 571 | 92 | globlastp |
| 1580 | sorghum|12v1|SB02G000365 | 5551 | 571 | 91.7 | globlastp |
| 1581 | millet|10v1|EVO454PM010170_P1 | 5552 | 571 | 80.6 | globlastp |
| 1582 | wheat|12v3|BE405523 | 5553 | 571 | 80 | globlastp |
| 1583 | sorghum|12v1|SB09G000670 | 5554 | 572 | 94 | globlastp |
| 1584 | maize|10v1|AI622036_P1 | 5555 | 572 | 92.8 | globlastp |
| 1585 | wheat|12v3|SRR043323X32016D1 | 5556 | 572 | 91.96 | glotblastn |
| 1586 | rice|11v1|GFXAC079022X1 | 5557 | 572 | 89.7 | globlastp |
| 1587 | brachypodium|12v1|BRADI2G39420_P1 | 5558 | 572 | 88.8 | globlastp |
| 1588 | rye|12v1|DRR001012.201180 | 5559 | 572 | 83.9 | globlastp |
| 1589 | foxtail_millet|11v3|PHY7SI000064M_P1 | 5560 | 572 | 82.9 | globlastp |
| 1590 | rice|11v1|BE229765 | 5561 | 572 | 82.7 | globlastp |
| 1591 | sorghum|12v1|SB03G047010 | 5562 | 572 | 82.6 | globlastp |
| 1592 | wheat|12v3|BQ743986 | 5563 | 572 | 82.1 | globlastp |
| 1593 | barley|12v1|AV913031_P1 | 5564 | 572 | 81.8 | globlastp |
| 1594 | brachypodium|12v1|BRADI2G61777_P1 | 5565 | 572 | 81.6 | globlastp |
| 1595 | wheat|12v3|CA699178 | 5566 | 572 | 81.55 | glotblastn |
| 1596 | barley|12v1|AW983306_P1 | 5567 | 572 | 81.2 | globlastp |
| 1597 | rye|12v1|DRR001012.17645 | 5568 | 572 | 81.02 | glotblastn |
| 1598 | rye|12v1|DRR001012.111897 | 5569 | 572 | 80.7 | globlastp |
| 1599 | wheat|12v3|BE492986 | 5570 | 572 | 80.48 | glotblastn |
| 1600 | millet|10v1|EVO454PM121012_P1 | 5571 | 573 | 98.9 | globlastp |
| 1601 | switchgrass|gb167|FE620088 | 5572 | 573 | 98.9 | globlastp |
| 1602 | rice|11v1|BE040122 | 5573 | 573 | 94.9 | globlastp |
| 1603 | rye|12v1|DRR001012.127367 | 5574 | 573 | 92.6 | globlastp |
| 1604 | wheat|12v3|BQ579626 | 5574 | 573 | 92.6 | globlastp |
| 1605 | barley|12v1|BE060282_P1 | 5575 | 573 | 92 | globlastp |
| 1606 | oat|11v1|CN815187_P1 | 5576 | 573 | 92 | globlastp |
| 1607 | rice|11v1|CA764875 | 5577 | 573 | 91.4 | globlastp |
| 1608 | brachypodium|12v1|BRADI3G29110_P1 | 5578 | 573 | 90.3 | globlastp |
| 1609 | maize|10v1|AI491684_P1 | 5579 | 573 | 90.3 | globlastp |
| 1610 | sorghum|12v1|SB06G014440 | 5580 | 573 | 89.71 | glotblastn |
| 1611 | maize|10v1|AW520044_P1 | 5581 | 573 | 89.7 | globlastp |
| 1612 | brachypodium|12v1|BRADI4G07940_P1 | 5582 | 573 | 89.1 | globlastp |
| 1613 | oil_palm|11v1|EY402276_P1 | 5583 | 573 | 81.8 | globlastp |
| 1614 | aristolochia|10v1|SRR039082S0001137_P1 | 5584 | 573 | 81.2 | globlastp |
| 1615 | melon|10v1|AM714468_P1 | 5585 | 573 | 80.6 | globlastp |
| 1616 | cucumber|09v1|DN910761_P1 | 5586 | 573 | 80 | globlastp |
| 1617 | sorghum|12v1|SB05G005850 | 5587 | 574 | 88.2 | globlastp |
| 1618 | maize|10v1|AI987267_P1 | 5588 | 574 | 87.6 | globlastp |
| 1619 | millet|10v1|EVO454PM027597_P1 | 5589 | 574 | 81 | globlastp |
| 1620 | switchgrass|12v1|FL717832_P1 | 5590 | 574 | 80.4 | globlastp |
| 1621 | switchgrass|12v1|FL920522_P1 | 5591 | 575 | 86.9 | globlastp |
| 1622 | sorghum|12v1|SB02G002790 | 5592 | 575 | 83.1 | globlastp |
| 1623 | sorghum|12v1|SB02G044070 | 5593 | 576 | 92.5 | globlastp |
| 1624 | maize|10v1|BE345024_P1 | 5594 | 576 | 92 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 1625 | millet\|10v1\|EVO454PM059615_P1 | 5595 | 576 | 88.9 | globlastp |
| 1626 | brachypodium\|12v1\|BRADI1G16500_P1 | 5596 | 576 | 85.4 | globlastp |
| 1627 | leymus\|gb166\|EG378503_P1 | 5597 | 576 | 83.7 | globlastp |
| 1628 | wheat\|12v3\|BE414106 | 5598 | 576 | 82.3 | globlastp |
| 1629 | rice\|11v1\|BM038382 | 5599 | 576 | 81 | globlastp |
| 1630 | switchgrass\|12v1\|FL696404_P1 | 5600 | 578 | 98.8 | globlastp |
| 1631 | rice\|11v1\|BE530957 | 5601 | 578 | 96.7 | globlastp |
| 1632 | brachypodium\|12v1\|BRADI1G13720_P1 | 5602 | 578 | 96.5 | globlastp |
| 1633 | maize\|10v1\|MZEORFP_P1 | 5603 | 578 | 96.5 | globlastp |
| 1634 | rye\|12v1\|DRR001012.122396 | 5604 | 578 | 96.34 | glotblastn |
| 1635 | sorghum\|12v1\|SB01G013470 | 5605 | 578 | 95.9 | globlastp |
| 1636 | rye\|12v1\|DRR001012.122796 | 5606 | 578 | 95 | globlastp |
| 1637 | grape\|11v1\|GSVIVT01020543001_P1 | 5607 | 578 | 90.3 | globlastp |
| 1638 | cassava\|09v1\|CK644520_T1 | 5608 | 578 | 89.67 | glotblastn |
| 1639 | poplar\|13v1\|AI163021_P1 | 5609 | 578 | 89.5 | globlastp |
| 1640 | cotton\|11v1\|CO084380_P1 | 5610 | 578 | 89.4 | globlastp |
| 1641 | eucalyptus\|11v2\|CD669178_P1 | 5611 | 578 | 89.4 | globlastp |
| 1642 | gossypium_raimondii\|12v1\|DN801910_P1 | 5610 | 578 | 89.4 | globlastp |
| 1643 | castorbean\|12v1\|EG680374_P1 | 5612 | 578 | 89.2 | globlastp |
| 1644 | pigeonpea\|11v1\|SRR054580X104115_P1 | 5613 | 578 | 89.2 | globlastp |
| 1645 | poplar\|10v1\|AI163021 | 5614 | 578 | 89.18 | glotblastn |
| 1646 | bean\|12v2\|CA902221_P1 | 5615 | 578 | 89.1 | globlastp |
| 1647 | bean\|12v1\|CA902221 | 5615 | 578 | 89.1 | globlastp |
| 1648 | clementine\|11v1\|CN188446_P1 | 5616 | 578 | 89.1 | globlastp |
| 1649 | monkeyflower\|10v1\|GFXAJ565937X1 | 5617 | 578 | 89.1 | globlastp |
| 1650 | monkeyflower\|12v1\|DV209472_P1 | 5617 | 578 | 89.1 | globlastp |
| 1651 | orange\|11v1\|CN188446_P1 | 5616 | 578 | 89.1 | globlastp |
| 1652 | petunia\|gb171\|DQ020641_P1 | 5618 | 578 | 89.1 | globlastp |
| 1653 | solanum_phureja\|09v1\|SPHLEU28403 | 5619 | 578 | 89.1 | globlastp |
| 1654 | soybean\|11v1\|GLYMA09G07570 | 5620 | 578 | 89.1 | globlastp |
| 1655 | soybean\|12v1\|GLYMA09G07570_P1 | 5620 | 578 | 89.1 | globlastp |
| 1656 | watermelon\|11v1\|AM737723 | 5621 | 578 | 89.1 | globlastp |
| 1657 | valeriana\|11v1\|SRR099039X108628 | 5622 | 578 | 89.01 | glotblastn |
| 1658 | nicotiana_benthamiana\|12v1\|BP748941_P1 | 5623 | 578 | 89 | globlastp |
| 1659 | aquilegia\|10v2\|DR927211_P1 | 5624 | 578 | 89 | globlastp |
| 1660 | trigonella\|11v1\|SRR066194X145996 | 5625 | 578 | 89 | glotblastn |
| 1661 | amborella\|12v3\|AY699216_P1 | 5626 | 578 | 88.9 | globlastp |
| 1662 | chickpea\|11v1\|GR392965 | 5627 | 578 | 88.8 | globlastp |
| 1663 | chickpea\|13v2\|GR392965_P1 | 5627 | 578 | 88.8 | globlastp |
| 1664 | soybean\|11v1\|GLYMA15G18790 | 5628 | 578 | 88.8 | globlastp |
| 1665 | soybean\|12v1\|GLYMA15G18790_P1 | 5628 | 578 | 88.8 | globlastp |
| 1666 | tomato\|11v1\|LEU28403 | 5629 | 578 | 88.8 | globlastp |
| 1667 | antirrhinum\|gb166\|AY566619_P1 | 5630 | 578 | 88.7 | globlastp |
| 1668 | cacao\|10v1\|CA798124_P1 | 5631 | 578 | 88.7 | globlastp |
| 1669 | thellungiella_parvulum\|11v1\|EPCRP030837 | 5632 | 578 | 88.7 | globlastp |
| 1670 | nicotiana_benthamiana\|12v1\|GFXAY596739X1_P1 | 5633 | 578 | 88.6 | globlastp |
| 1671 | maize\|10v1\|AI947765_T1 | 5634 | 578 | 88.59 | glotblastn |
| 1672 | arnica\|11v1\|SRR099034X100378_P1 | 5635 | 578 | 88.5 | globlastp |
| 1673 | medicago\|12v1\|AW686511_P1 | 5636 | 578 | 88.5 | globlastp |
| 1674 | ambrosia\|11v1\|SRR346935.112170_T1 | 5637 | 578 | 88.45 | glotblastn |
| 1675 | prunus\|10v1\|CN579460 | 5638 | 578 | 88.4 | globlastp |
| 1676 | prunus_mume\|13v1\|DW342897_P1 | 5639 | 578 | 88.3 | globlastp |
| 1677 | canola\|11v1\|DY004560_P1 | 5640 | 578 | 88.3 | globlastp |
| 1678 | tabernaemontana\|11v1\|SRR098689X101385 | 5641 | 578 | 88.3 | globlastp |
| 1679 | thellungiella_halophilum\|11v1\|EHJGI11013611 | 5642 | 578 | 88.3 | globlastp |
| 1680 | bean\|12v2\|SRR090491.1037431_P1 | 5643 | 578 | 88.2 | globlastp |
| 1681 | b_rapa\|11v1\|BG544904_P1 | 5644 | 578 | 88.2 | globlastp |
| 1682 | apple\|11v1\|CN579460_P1 | 5645 | 578 | 88.1 | globlastp |
| 1683 | arabidopsis_lyrata\|09v1\|JGIAL025979_P1 | 5646 | 578 | 88.1 | globlastp |
| 1684 | amsonia\|11v1\|SRR098688X100594_P1 | 5647 | 578 | 88 | globlastp |
| 1685 | plantago\|11v2\|SRR066373X106645_P1 | 5648 | 578 | 88 | globlastp |
| 1686 | arabidopsis\|10v1\|AT4G21710_P1 | 5649 | 578 | 87.9 | globlastp |
| 1687 | apple\|11v1\|CN580488_T1 | 5650 | 578 | 87.89 | glotblastn |
| 1688 | strawberry\|11v1\|DY667228 | 5651 | 578 | 87.8 | globlastp |
| 1689 | cucumber\|09v1\|AM737723_T1 | 5652 | 578 | 87.71 | glotblastn |
| 1690 | canola\|11v1\|EV055759_P1 | 5653 | 578 | 87.7 | globlastp |
| 1691 | b_rapa\|11v1\|AT002075_P1 | 5654 | 578 | 87.3 | globlastp |
| 1692 | poppy\|11v1\|GFXDQ017122X1_P1 | 5655 | 578 | 87.2 | globlastp |
| 1693 | abies\|11v2\|SRR098676X108534_P1 | 5656 | 578 | 87.1 | globlastp |
| 1694 | cephalotaxus\|11v1\|AY699209_P1 | 5657 | 578 | 87 | globlastp |
| 1695 | euphorbia\|11v1\|DV124499_P1 | 5658 | 578 | 85.7 | globlastp |
| 1696 | ceratodon\|10v1\|SRR074890S0024567_P1 | 5659 | 578 | 85.4 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 1697 | physcomitrella\|10v1\|FC414727_P1 | 5660 | 578 | 85.4 | globlastp |
| 1698 | petunia\|gb171\|DQ020638_P1 | 5661 | 578 | 85 | globlastp |
| 1699 | monkeyflower\|12v1\|GFXAJ558241X1_P1 | 5662 | 578 | 84.6 | globlastp |
| 1700 | oil_palm\|11v1\|GH635997_P1 | 5663 | 578 | 84.6 | globlastp |
| 1701 | tomato\|11v1\|GFXAJ565936X1 | 5664 | 578 | 84.4 | globlastp |
| 1702 | antirrhinum\|gb166\|AY566620_P1 | 5665 | 578 | 83.9 | globlastp |
| 1703 | solanum_phureja\|09v1\|SPHGFXAJ565936X1 | 5666 | 578 | 83.9 | globlastp |
| 1704 | tripterygium\|11v1\|SRR098677X104577 | 5667 | 578 | 83.7 | glotblastn |
| 1705 | b_rapa\|11v1\|E6ANDIZ02G1AVU_P1 | 5668 | 578 | 83.1 | globlastp |
| 1706 | liriodendron\|gb166\|GFXAY566615X1_T1 | 5669 | 578 | 82.54 | glotblastn |
| 1707 | vinca\|11v1\|SRR098690X103405 | 5670 | 578 | 82.2 | glotblastn |
| 1708 | rye\|12v1\|DRR001012.100960 | 5671 | 578 | 82 | globlastp |
| 1709 | wheat\|12v3\|CA694404 | 5671 | 578 | 82 | globlastp |
| 1710 | switchgrass\|gb167\|FL691093 | 5672 | 579 | 91.7 | globlastp |
| 1711 | switchgrass\|12v1\|FL702388_P1 | 5673 | 579 | 91.5 | globlastp |
| 1712 | maize\|10v1\|AW600635_P1 | 5674 | 579 | 85.4 | globlastp |
| 1713 | millet\|10v1\|EVO454PM004565_P1 | 5675 | 579 | 82.5 | globlastp |
| 1714 | switchgrass\|12v1\|GD047127_P1 | 5676 | 580 | 95.8 | globlastp |
| 1715 | switchgrass\|12v1\|FE622371_P1 | 5677 | 580 | 95.6 | globlastp |
| 1716 | maize\|10v1\|AW498340_P1 | 5678 | 580 | 92.5 | globlastp |
| 1717 | millet\|10v1\|EVO454PM007673_P1 | 5679 | 580 | 91.4 | globlastp |
| 1718 | rice\|11v1\|AU172537 | 5680 | 580 | 88.4 | globlastp |
| 1719 | barley\|12v1\|BI951707_P1 | 5681 | 580 | 87.3 | globlastp |
| 1720 | rye\|12v1\|DRR001012.108541 | 5682 | 580 | 86.84 | glotblastn |
| 1721 | brachypodium\|12v1\|BRADI1G07140_P1 | 5683 | 580 | 86.4 | globlastp |
| 1722 | wheat\|12v3\|CA731703 | 5684 | 580 | 86 | globlastp |
| 1723 | wheat\|12v3\|CJ688448 | 5685 | 580 | 86 | globlastp |
| 1724 | wheat\|12v3\|BE430680 | 5686 | 580 | 85.7 | globlastp |
| 1725 | wheat\|12v3\|SRR043326X61261D1 | 5687 | 580 | 82.4 | globlastp |
| 1726 | sorghum\|12v1\|SB01G001470 | 5688 | 581 | 80.82 | glotblastn |
| 1727 | switchgrass\|gb167\|FL740714 | 5689 | 582 | 90.37 | glotblastn |
| 1728 | sorghum\|12v1\|SB01G034230 | 5690 | 582 | 88.6 | globlastp |
| 1729 | maize\|10v1\|AW191774_P1 | 5691 | 582 | 87 | globlastp |
| 1730 | switchgrass\|12v1\|FL740714_P1 | 5692 | 582 | 83.3 | globlastp |
| 1731 | switchgrass\|12v1\|GD032085_P1 | 5693 | 584 | 93.6 | globlastp |
| 1732 | switchgrass\|12v1\|FL876127_P1 | 5694 | 584 | 92.8 | globlastp |
| 1733 | cenchrus\|gb166\|EB659901_P1 | 5695 | 584 | 90.8 | globlastp |
| 1734 | maize\|10v1\|AW308661_P1 | 5696 | 584 | 85.5 | globlastp |
| 1735 | sorghum\|12v1\|SB01G038830 | 5697 | 584 | 85.5 | globlastp |
| 1736 | switchgrass\|gb167\|FL876127 | 5698 | 584 | 84.7 | globlastp |
| 1737 | barley\|12v1\|AV917342_P1 | 5699 | 584 | 80 | globlastp |
| 1738 | sorghum\|12v1\|SB08G017000 | 5700 | 586 | 96.5 | globlastp |
| 1739 | switchgrass\|gb167\|FL772843 | 5701 | 586 | 88.9 | globlastp |
| 1740 | sugarcane\|10v1\|CA150053 | 5702 | 586 | 88.6 | globlastp |
| 1741 | millet\|10v1\|EVO454PM003727_P1 | 5703 | 586 | 88.3 | globlastp |
| 1742 | switchgrass\|12v1\|FL772843_P1 | 5704 | 586 | 88.2 | globlastp |
| 1743 | maize\|10v1\|CF015939_T1 | — | 586 | 81.69 | glotblastn |
| 1744 | lovegrass\|gb167\|EH189424_P1 | 5705 | 586 | 81 | globlastp |
| 1745 | foxtail_millet\|11v3\|EC611921_P1 | 5706 | 586 | 80.7 | globlastp |
| 1746 | cynodon\|10v1\|ES298101_P1 | 5707 | 586 | 80.3 | globlastp |
| 1747 | rice\|11v1\|BU572389 | 5708 | 586 | 80.27 | glotblastn |
| 1748 | sorghum\|12v1\|SB09G029060 | 5709 | 587 | 80.2 | globlastp |
| 1749 | foxtail_millet\|11v3\|PHY7SI028803M_P1 | 5710 | 588 | 96.7 | globlastp |
| 1750 | rice\|11v1\|BI799345 | 5711 | 588 | 92.5 | globlastp |
| 1751 | switchgrass\|12v1\|DN149726_P1 | 5712 | 588 | 92.1 | globlastp |
| 1752 | barley\|12v1\|AJ461484_P1 | 5713 | 588 | 90.4 | globlastp |
| 1753 | switchgrass\|gb167\|DN149726 | 5714 | 588 | 90.2 | globlastp |
| 1754 | switchgrass\|12v1\|FE601563_P1 | 5715 | 588 | 87.3 | globlastp |
| 1755 | banana\|12v1\|FF558588_P1 | 5716 | 588 | 85 | globlastp |
| 1755 | banana\|12v1\|FF558588_P1 | 5716 | 669 | 83.6 | globlastp |
| 1756 | oil_palm\|11v1\|ES370569_P1 | 5717 | 588 | 84.4 | globlastp |
| 1756 | oil_palm\|11v1\|ES370569_P1 | 5717 | 669 | 82.4 | globlastp |
| 1757 | rye\|12v1\|DRR001012.119625 | 5718 | 588 | 84.3 | globlastp |
| 1758 | wheat\|12v3\|BE493469 | 5719 | 588 | 83.9 | globlastp |
| 1758 | wheat\|12v3\|BE493469 | 5719 | 669 | 80.6 | globlastp |
| 1759 | eucalyptus\|11v2\|CT986059_P1 | 5720 | 588 | 83.8 | globlastp |
| 1759 | eucalyptus\|11v2\|CT986059_P1 | 5720 | 669 | 84.8 | globlastp |
| 1760 | rye\|12v1\|DRR001012.102824 | 5721 | 588 | 83.8 | globlastp |
| 1760 | rye\|12v1\|DRR001012.102824 | 5721 | 669 | 80.6 | globlastp |
| 1761 | brachypodium\|12v1\|BRADI5G08235_P1 | 5722 | 588 | 83.7 | globlastp |
| 1761 | brachypodium\|12v1\|BRADI5G08235_P1 | 5722 | 669 | 80.3 | globlastp |
| 1762 | sorghum\|12v1\|SB06G013930 | 5723 | 588 | 83.7 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 1762 | sorghum\|12v1\|SB06G013930 | 5723 | 669 | 80.8 | globlastp |
| 1763 | oat\|11v1\|CN817802_T1 | 5724 | 588 | 83.68 | glotblastn |
| 1764 | castorbean\|12v1\|EG656511_P1 | 5725 | 588 | 83.6 | globlastp |
| 1764 | castorbean\|12v1\|EG656511_P1 | 5725 | 669 | 85.8 | globlastp |
| 1765 | foxtail_millet\|11v3\|PHY7SI009245M_P1 | 5726 | 588 | 83.6 | globlastp |
| 1765 | foxtail_millet\|11v3\|PHY7SI009245M_P1 | 5726 | 669 | 80.5 | globlastp |
| 1766 | sorghum\|12v1\|SB06G013940 | 5727 | 588 | 83.6 | globlastp |
| 1766 | sorghum\|12v1\|SB06G013940 | 5727 | 669 | 80.8 | globlastp |
| 1767 | amborella\|12v3\|CK761744_P1 | 5728 | 588 | 83.4 | globlastp |
| 1767 | amborella\|12v3\|CK761744_P1 | 5728 | 669 | 82.2 | globlastp |
| 1768 | brachypodium\|12v1\|BRADI5G08230_P1 | 5729 | 588 | 83.4 | globlastp |
| 1768 | brachypodium\|12v1\|BRADI5G08230_P1 | 5729 | 669 | 80 | globlastp |
| 1769 | maize\|10v1\|T18386_P1 | 5730 | 588 | 83.4 | globlastp |
| 1769 | maize\|10v1\|T18386_P1 | 5730 | 669 | 80.7 | globlastp |
| 1770 | cassava\|09v1\|CK643428_P1 | 5731 | 588 | 83.3 | globlastp |
| 1770 | cassava\|09v1\|CK643428_P1 | 5731 | 669 | 85.2 | globlastp |
| 1771 | maize\|10v1\|T18293_P1 | 5732 | 588 | 83.3 | globlastp |
| 1771 | maize\|10v1\|T18293_P1 | 5732 | 669 | 80.2 | globlastp |
| 1772 | rice\|11v1\|U38053 | 5733 | 588 | 83.3 | globlastp |
| 1772 | rice\|11v1\|U38053 | 5733 | 669 | 80.9 | globlastp |
| 1773 | banana\|12v1\|DN239957_P1 | 5734 | 588 | 83.2 | globlastp |
| 1773 | banana\|12v1\|DN239957_P1 | 5734 | 669 | 80.9 | globlastp |
| 1774 | cassava\|09v1\|JGICASSAVA6609VALIDM1_P1 | 5735 | 588 | 83.2 | globlastp |
| 1774 | cassava\|09v1\|JGICASSAVA6609VALIDM1_P1 | 5735 | 669 | 85.2 | globlastp |
| 1775 | chelidonium\|11v1\|SRR084752X106414_P1 | 5736 | 588 | 83.2 | globlastp |
| 1775 | chelidonium\|11v1\|SRR084752X106414_P1 | 5736 | 669 | 82.1 | globlastp |
| 1776 | apple\|11v1\|CN490891_P1 | 5737 | 588 | 83.1 | globlastp |
| 1776 | apple\|11v1\|CN490891_P1 | 5737 | 669 | 84.6 | globlastp |
| 1777 | cucumber\|09v1\|BU791062_P1 | 5738 | 588 | 83.1 | globlastp |
| 1777 | cucumber\|09v1\|BU791062_P1 | 5738 | 669 | 84.9 | globlastp |
| 1778 | tripterygium\|11v1\|SRR098677X10105 | 5739 | 588 | 83 | globlastp |
| 1778 | tripterygium\|11v1\|SRR098677X10105 | 5739 | 669 | 84.4 | globlastp |
| 1779 | poppy\|11v1\|FE967956_T1 | 5740 | 588 | 82.94 | glotblastn |
| 1779 | poppy\|11v1\|FE967956_T1 | 5740 | 669 | 82.78 | glotblastn |
| 1780 | poppy\|11v1\|SRR030259.135207_T1 | 5741 | 588 | 82.94 | glotblastn |
| 1780 | poppy\|11v1\|SRR030259.135207_T1 | 5741 | 669 | 82.78 | glotblastn |
| 1781 | switchgrass\|12v1\|FE641776_P1 | 5742 | 588 | 82.9 | globlastp |
| 1782 | amsonia\|11v1\|SRR098688X100786_P1 | 5743 | 588 | 82.9 | globlastp |
| 1782 | amsonia\|11v1\|SRR098688X100786_P1 | 5743 | 669 | 85.4 | globlastp |
| 1783 | poppy\|11v1\|SRR030259.104847_P1 | 5744 | 588 | 82.9 | globlastp |
| 1783 | poppy\|11v1\|SRR030259.104847_P1 | 5744 | 669 | 82.7 | globlastp |
| 1784 | nicotiana_benthamiana\|12v1\|BP749265_P1 | 5745 | 588 | 82.8 | globlastp |
| 1784 | nicotiana_benthamiana\|12v1\|BP749265_P1 | 5745 | 669 | 82.2 | globlastp |
| 1785 | watermelon\|11v1\|AM732793 | 5746 | 588 | 82.78 | glotblastn |
| 1785 | watermelon\|11v1\|AM732793 | 5746 | 669 | 84.71 | glotblastn |
| 1786 | poplar\|10v1\|BU808955 | 5747 | 588 | 82.7 | globlastp |
| 1786 | poplar\|10v1\|BU808955 | 5747 | 669 | 85.1 | globlastp |
| 1787 | poplar\|13v1\|BU808955_P1 | 5747 | 588 | 82.7 | globlastp |
| 1787 | poplar\|13v1\|BU808955_P1 | 5747 | 669 | 85.1 | globlastp |
| 1788 | orange\|11v1\|CK701952_T1 | 5748 | 588 | 82.63 | glotblastn |
| 1788 | orange\|11v1\|CK701952_T1 | 5748 | 669 | 85.69 | glotblastn |
| 1789 | clementine\|11v1\|CK701952_P1 | 5749 | 588 | 82.6 | globlastp |
| 1789 | clementine\|11v1\|CK701952_P1 | 5749 | 669 | 85.4 | globlastp |
| 1790 | flaveria\|11v1\|SRR149232.301988_T1 | 5750 | 588 | 82.57 | glotblastn |
| 1790 | flaveria\|11v1\|SRR149232.301988_T1 | 5750 | 669 | 84.81 | glotblastn |
| 1791 | lettuce\|12v1\|DW108243_P1 | 5751 | 588 | 82.5 | globlastp |
| 1791 | lettuce\|12v1\|DW108243_P1 | 5751 | 669 | 83.8 | globlastp |
| 1792 | silene\|11v1\|SRR096785X103511 | 5752 | 588 | 82.5 | globlastp |
| 1792 | silene\|11v1\|SRR096785X103511 | 5752 | 669 | 83.5 | globlastp |
| 1793 | flaveria\|11v1\|SRR149229.105537_T1 | 5753 | 588 | 82.49 | glotblastn |
| 1793 | flaveria\|11v1\|SRR149229.105537_T1 | 5753 | 669 | 84.34 | glotblastn |
| 1794 | centaurea\|11v1\|EH717944_P1 | 5754 | 588 | 82.4 | globlastp |
| 1794 | centaurea\|11v1\|EH717944_P1 | 5754 | 669 | 84.5 | globlastp |
| 1795 | aquilegia\|10v2\|DR916365_P1 | 5755 | 588 | 82.4 | globlastp |
| 1795 | aquilegia\|10v2\|DR916365_P1 | 5755 | 669 | 83.4 | globlastp |
| 1796 | podocarpus\|10v1\|SRR065014S0001540_P1 | 5756 | 588 | 82.4 | globlastp |
| 1796 | podocarpus\|10v1\|SRR065014S0001540_P1 | 5756 | 669 | 82.3 | globlastp |
| 1797 | cotton\|11v1\|AI726463_T1 | 5757 | 588 | 82.37 | glotblastn |
| 1797 | cotton\|11v1\|AI726463_T1 | 5757 | 669 | 84.62 | glotblastn |
| 1798 | cotton\|11v1\|BF278372_T1 | 5758 | 588 | 82.37 | glotblastn |
| 1798 | cotton\|11v1\|BF278372_T1 | 5758 | 669 | 85 | glotblastn |
| 1799 | aquilegia\|10v2\|DR925645_P1 | 5759 | 588 | 82.3 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 1799 | aquilegia\|10v2\|DR925645_P1 | 5759 | 669 | 84 | globlastp |
| 1800 | b_rapa\|11v1\|CD836760_P1 | 5760 | 588 | 82.3 | globlastp |
| 1800 | b_rapa\|11v1\|CD836760_P1 | 5760 | 669 | 82 | globlastp |
| 1801 | cacao\|10v1\|CU481473_P1 | 5761 | 588 | 82.3 | globlastp |
| 1801 | cacao\|10v1\|CU481473_P1 | 5761 | 669 | 84.5 | globlastp |
| 1802 | cotton\|11v1\|CO103364_P1 | 5762 | 588 | 82.3 | globlastp |
| 1802 | cotton\|11v1\|CO103364_P1 | 5762 | 669 | 84.6 | globlastp |
| 1803 | gossypium_raimondii\|12v1\|AI726463_P1 | 5763 | 588 | 82.3 | globlastp |
| 1803 | gossypium_raimondii\|12v1\|AI726463_P1 | 5763 | 669 | 84.6 | globlastp |
| 1804 | prunus\|10v1\|CN490891 | 5764 | 588 | 82.3 | globlastp |
| 1804 | prunus\|10v1\|CN490891 | 5764 | 669 | 84.5 | globlastp |
| 1805 | prunus_mume\|13v1\|CV050672_P1 | 5765 | 588 | 82.2 | globlastp |
| 1805 | prunus_mume\|13v1\|CV050672_P1 | 5765 | 669 | 84.5 | globlastp |
| 1806 | gossypium_raimondii\|12v1\|AI728825_P1 | 5766 | 588 | 82.2 | globlastp |
| 1806 | gossypium_raimondii\|12v1\|AI728825_P1 | 5766 | 669 | 84.4 | globlastp |
| 1807 | sequoia\|10v1\|SRR065044S0004548 | 5767 | 588 | 82.2 | globlastp |
| 1807 | sequoia\|10v1\|SRR065044S0004548 | 5767 | 669 | 81.1 | globlastp |
| 1808 | ambrosia\|11v1\|SRR346935.100861_T1 | 5768 | 588 | 82.17 | glotblastn |
| 1808 | ambrosia\|11v1\|SRR346935.100861_T1 | 5768 | 669 | 84.62 | glotblastn |
| 1809 | cotton\|11v1\|DW492306_P1 | 5769 | 588 | 82.1 | globlastp |
| 1809 | cotton\|11v1\|DW492306_P1 | 5769 | 669 | 84.3 | globlastp |
| 1810 | ambrosia\|11v1\|SRR346935.108934_T1 | 5770 | 588 | 82.08 | glotblastn |
| 1810 | ambrosia\|11v1\|SRR346935.108934_T1 | 5770 | 669 | 84.71 | glotblastn |
| 1811 | flaveria\|11v1\|SRR149229.144621_T1 | 5771 | 588 | 82.08 | glotblastn |
| 1811 | flaveria\|11v1\|SRR149229.144621_T1 | 5771 | 669 | 84.23 | glotblastn |
| 1812 | vinca\|11v1\|SRR098690X140407 | 5772 | 588 | 82.01 | glotblastn |
| 1812 | vinca\|11v1\|SRR098690X140407 | 5772 | 669 | 82.2 | globlastp |
| 1813 | euphorbia\|11v1\|DV123408_P1 | 5773 | 588 | 82 | globlastp |
| 1813 | euphorbia\|11v1\|DV123408_P1 | 5773 | 669 | 85.3 | globlastp |
| 1814 | poppy\|11v1\|SRR096789.102474_T1 | 5774 | 588 | 82 | globlastp |
| 1814 | poppy\|11v1\|SRR096789.102474_T1 | 5774 | 669 | 81.63 | glotblastn |
| 1815 | tomato\|11v1\|BG627851 | 5775 | 588 | 82 | globlastp |
| 1815 | tomato\|11v1\|BG627851 | 5775 | 669 | 82.6 | globlastp |
| 1816 | poplar\|13v1\|AJ298115_P1 | 5776 | 588 | 82 | globlastp |
| 1816 | poplar\|13v1\|AJ298115_P1 | 5776 | 669 | 84.8 | globlastp |
| 1817 | nicotiana_benthamiana\|12v1\|EB695946_P1 | 5777 | 588 | 81.9 | globlastp |
| 1817 | nicotiana_benthamiana\|12v1\|EB695946_P1 | 5777 | 669 | 83.4 | globlastp |
| 1818 | arabidopsis_lyrata\|09v1\|JGIAL018794_P1 | 5778 | 588 | 81.9 | globlastp |
| 1818 | arabidopsis_lyrata\|09v1\|JGIAL018794_P1 | 5778 | 669 | 82.6 | globlastp |
| 1819 | arabidopsis\|10v1\|AT3G55410_P1 | 5779 | 588 | 81.9 | globlastp |
| 1819 | arabidopsis\|10v1\|AT3G55410_P1 | 5779 | 669 | 82.7 | globlastp |
| 1820 | poplar\|10v1\|AJ298115 | 5780 | 588 | 81.9 | globlastp |
| 1820 | poplar\|10v1\|AJ298115 | 5780 | 669 | 84.8 | globlastp |
| 1821 | vinca\|11v1\|SRR098690X10694 | 5781 | 588 | 81.9 | globlastp |
| 1821 | vinca\|11v1\|SRR098690X10694 | 5781 | 669 | 84.5 | globlastp |
| 1822 | sciadopitys\|10v1\|SRR065035S0026542 | 5782 | 588 | 81.85 | glotblastn |
| 1822 | sciadopitys\|10v1\|SRR065035S0026542 | 5782 | 669 | 82.07 | glotblastn |
| 1823 | poppy\|11v1\|FE965289_T1 | 5783 | 588 | 81.81 | glotblastn |
| 1823 | poppy\|11v1\|FE965289_T1 | 5783 | 669 | 81.15 | glotblastn |
| 1824 | nicotiana_benthamiana\|12v1\|EB681944_P1 | 5784 | 588 | 81.7 | globlastp |
| 1824 | nicotiana_benthamiana\|12v1\|EB681944_P1 | 5784 | 669 | 81.2 | globlastp |
| 1825 | poppy\|11v1\|SRR030259.121112_P1 | 5785 | 588 | 81.7 | globlastp |
| 1825 | poppy\|11v1\|SRR030259.121112_P1 | 5785 | 669 | 81.8 | globlastp |
| 1826 | silene\|11v1\|SRR096785X106583 | 5786 | 588 | 81.7 | globlastp |
| 1826 | silene\|11v1\|SRR096785X106583 | 5786 | 669 | 82.5 | globlastp |
| 1827 | solanum_phureja\|09v1\|SPHBG627851 | 5787 | 588 | 81.7 | globlastp |
| 1827 | solanum_phureja\|09v1\|SPHBG627851 | 5787 | 669 | 82 | globlastp |
| 1828 | valeriana\|11v1\|SRR099039X106755 | 5788 | 588 | 81.7 | glotblastn |
| 1828 | valeriana\|11v1\|SRR099039X106755 | 5788 | 669 | 83.37 | glotblastn |
| 1829 | valeriana\|11v1\|SRR099039X117744 | 5789 | 588 | 81.7 | globlastp |
| 1829 | valeriana\|11v1\|SRR099039X117744 | 5789 | 669 | 85.1 | globlastp |
| 1830 | monkeyflower\|10v1\|GR041459 | 5790 | 588 | 81.6 | globlastp |
| 1830 | monkeyflower\|10v1\|GR041459 | 5790 | 669 | 83.1 | globlastp |
| 1831 | monkeyflower\|12v1\|GR137919_P1 | 5790 | 588 | 81.6 | globlastp |
| 1831 | monkeyflower\|12v1\|GR137919_P1 | 5790 | 669 | 83.1 | globlastp |
| 1832 | thellungiella_parvulum\|11v1\|DN776865 | 5791 | 588 | 81.6 | globlastp |
| 1832 | thellungiella_parvulum\|11v1\|DN776865 | 5791 | 669 | 82.4 | globlastp |
| 1833 | b_rapa\|11v1\|BG543370_P1 | 5792 | 588 | 81.5 | globlastp |
| 1833 | b_rapa\|11v1\|BG543370_P1 | 5792 | 669 | 82.7 | globlastp |
| 1834 | cephalotaxus\|11v1\|SRR064395X109569_P1 | 5793 | 588 | 81.5 | globlastp |
| 1834 | cephalotaxus\|11v1\|SRR064395X109569_P1 | 5793 | 669 | 80.9 | globlastp |
| 1835 | monkeyflower\|10v1\|CV521029 | 5794 | 588 | 81.5 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 1835 | monkeyflower\|10v1\|CV521029 | 5794 | 669 | 84.1 | globlastp |
| 1836 | monkeyflower\|12v1\|CV521029_P1 | 5794 | 588 | 81.5 | globlastp |
| 1836 | monkeyflower\|12v1\|CV521029_P1 | 5794 | 669 | 84.1 | globlastp |
| 1837 | sunflower\|12v1\|CX946769 | 5795 | 588 | 81.5 | globlastp |
| 1837 | sunflower\|12v1\|CX946769 | 5795 | 669 | 84.7 | globlastp |
| 1838 | amorphophallus\|11v2\|SRR089351X598842_T1 | 5796 | 588 | 81.43 | glotblastn |
| 1838 | amorphophallus\|11v2\|SRR089351X598842_T1 | 5796 | 669 | 80.9 | glotblastn |
| 1839 | zostera\|10v1\|SRR057351S0013123 | 5797 | 588 | 81.4 | globlastp |
| 1840 | zostera\|12v1\|SRR057351X103792D1_P1 | 5797 | 588 | 81.4 | globlastp |
| 1841 | arabidopsis\|10v1\|AT5G65750_P1 | 5798 | 588 | 81.4 | globlastp |
| 1841 | arabidopsis\|10v1\|AT5G65750_P1 | 5798 | 669 | 82.6 | globlastp |
| 1842 | phalaenopsis\|11v1\|SRR125771.1006355_T1 | 5799 | 588 | 81.31 | glotblastn |
| 1842 | phalaenopsis\|11v1\|SRR125771.1006355_T1 | 5799 | 669 | 80.9 | glotblastn |
| 1843 | wheat\|12v3\|CA642089 | 5800 | 588 | 81.3 | globlastp |
| 1844 | arabidopsis_lyrata\|09v1\|JGIAL031268_P1 | 5801 | 588 | 81.3 | globlastp |
| 1844 | arabidopsis_lyrata\|09v1\|JGIAL031268_P1 | 5801 | 669 | 82.3 | globlastp |
| 1845 | taxus\|10v1\|SRR032523S0007163 | 5802 | 588 | 81.21 | glotblastn |
| 1845 | taxus\|10v1\|SRR032523S0007163 | 5802 | 669 | 81.01 | glotblastn |
| 1846 | solanum_phureja\|09v1\|SPHAJ302131 | 5803 | 588 | 81.2 | globlastp |
| 1846 | solanum_phureja\|09v1\|SPHAJ302131 | 5803 | 669 | 81.7 | globlastp |
| 1847 | strawberry\|11v1\|DY670233 | 5804 | 588 | 81.2 | globlastp |
| 1847 | strawberry\|11v1\|DY670233 | 5804 | 669 | 83.9 | globlastp |
| 1848 | tomato\|11v1\|AJ302131 | 5805 | 588 | 81.19 | glotblastn |
| 1848 | tomato\|11v1\|AJ302131 | 5805 | 669 | 81.37 | glotblastn |
| 1849 | amorphophallus\|11v2\|SRR089351X125059_P1 | 5806 | 588 | 81.1 | globlastp |
| 1849 | amorphophallus\|11v2\|SRR089351X125059_P1 | 5806 | 669 | 81.9 | globlastp |
| 1850 | arnica\|11v1\|SRR099034X104253_P1 | 5807 | 588 | 81.1 | globlastp |
| 1850 | arnica\|11v1\|SRR099034X104253_P1 | 5807 | 669 | 84.5 | globlastp |
| 1851 | canola\|11v1\|ES905247_P1 | 5808 | 588 | 81 | globlastp |
| 1851 | canola\|11v1\|ES905247_P1 | 5808 | 669 | 80.9 | globlastp |
| 1852 | Clementine\|11v1\|CF834323_P1 | 5809 | 588 | 81 | globlastp |
| 1852 | Clementine\|11v1\|CF834323_P1 | 5809 | 669 | 84.1 | globlastp |
| 1853 | orange\|11v1\|CF834323_P1 | 5810 | 588 | 81 | globlastp |
| 1853 | orange\|11v1\|CF834323_P1 | 5810 | 669 | 84.1 | globlastp |
| 1854 | canola\|11v1\|EV192510_T1 | 5811 | 588 | 80.81 | glotblastn |
| 1854 | canola\|11v1\|EV192510_T1 | 5811 | 669 | 80.68 | glotblastn |
| 1855 | b_rapa\|11v1\|DY024002_P1 | 5812 | 588 | 80.8 | globlastp |
| 1855 | b_rapa\|11v1\|DY024002_P1 | 5812 | 669 | 81 | globlastp |
| 1856 | canola\|11v1\|EE416237_P1 | 5813 | 588 | 80.8 | globlastp |
| 1856 | canola\|11v1\|EE416237_P1 | 5813 | 669 | 81.8 | globlastp |
| 1857 | pine\|10v2\|AA739591_P1 | 5814 | 588 | 80.8 | globlastp |
| 1857 | pine\|10v2\|AA739591_P1 | 5814 | 669 | 80.9 | globlastp |
| 1858 | prunus_mume\|13v1\|DW342624_T1 | 5815 | 588 | 80.61 | glotblastn |
| 1858 | prunus_mume\|13v1\|DW342624_P1 | 5815 | 669 | 80.5 | globlastp |
| 1859 | abies\|11v2\|SRR098676X101909_P1 | 5816 | 588 | 80.6 | globlastp |
| 1859 | abies\|11v2\|SRR098676X101909_P1 | 5816 | 669 | 80.9 | globlastp |
| 1860 | thellungiella_halophilum\|11v1\|DN772746 | 5817 | 588 | 80.6 | globlastp |
| 1860 | thellungiella_halophilum\|11v1\|DN772746 | 5817 | 669 | 82.6 | globlastp |
| 1861 | triphysaria\|10v1\|BM357063 | 5818 | 588 | 80.51 | glotblastn |
| 1861 | triphysaria\|10v1\|BM357063 | 5818 | 669 | 83.35 | glotblastn |
| 1862 | pseudotsuga\|10v1\|SRR065119S0003046 | 5819 | 588 | 80.47 | glotblastn |
| 1862 | pseudotsuga\|10v1\|SRR065119S0003046 | 5819 | 669 | 81.19 | glotblastn |
| 1863 | canola\|11v1\|EE453879_P1 | 5820 | 588 | 80.2 | globlastp |
| 1864 | spruce\|11v1\|ES659322 | 5821 | 588 | 80.18 | glotblastn |
| 1864 | spruce\|11v1\|ES659322 | 5821 | 669 | 80.62 | glotblastn |
| 1865 | thellungiella_parvulum\|11v1\|DN775569 | 5822 | 588 | 80.16 | glotblastn |
| 1865 | thellungiella_parvulum\|11v1\|DN775569 | 5822 | 669 | 82.59 | glotblastn |
| 1866 | canola\|11v1\|EE451765_P1 | 5823 | 588 | 80.1 | globlastp |
| 1866 | canola\|11v1\|EE451765_P1 | 5823 | 669 | 80.1 | globlastp |
| 1867 | lettuce\|12v1\|LS12v1CRP091489_P1 | 5824 | 588 | 80.1 | globlastp |
| 1867 | lettuce\|12v1\|LS12v1CRP091489_P1 | 5824 | 669 | 81.4 | globlastp |
| 1868 | switchgrass\|12v1\|DN144756_T1 | 5825 | 588 | 80.04 | glotblastn |
| 1869 | foxtail_millet\|11v3\|PHY7SI002922M_P1 | 5826 | 589 | 97.6 | globlastp |
| 1870 | sugarcane\|10v1\|BQ533119 | 5827 | 589 | 96.7 | globlastp |
| 1871 | millet\|10v1\|EVO454PM024192_P1 | 5828 | 589 | 96.2 | globlastp |
| 1872 | sorghum\|12v1\|SB03G037480 | 5829 | 589 | 96.2 | globlastp |
| 1873 | switchgrass\|12v1\|DN150389_P1 | 5830 | 589 | 96.2 | globlastp |
| 1874 | switchgrass\|gb167\|DN150389 | 5831 | 589 | 95.7 | globlastp |
| 1875 | rice\|11v1\|AA752205 | 5832 | 589 | 93.3 | globlastp |
| 1876 | brachypodium\|12v1\|BRADI2G52777_P1 | 5833 | 589 | 88.1 | globlastp |
| 1877 | oat\|11v1\|CN820506_P1 | 5834 | 589 | 88.1 | globlastp |
| 1878 | pseudoroegneria\|gb167\|FF365257 | 5835 | 589 | 87.1 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 1879 | wheat\|12v3\|BE404799 | 5836 | 589 | 86.7 | globlastp |
| 1880 | barley\|12v1\|BF624474_P1 | 5837 | 589 | 86.2 | globlastp |
| 1881 | leymus\|gb166\|EG392549_P1 | 5838 | 589 | 85.7 | globlastp |
| 1882 | oat\|11v1\|GO593702_T1 | 5839 | 589 | 84.76 | glotblastn |
| 1883 | rye\|12v1\|DRR001012.107131 | 5840 | 589 | 83.8 | globlastp |
| 1884 | lolium\|10v1\|ES699534_P1 | 5841 | 589 | 82.9 | globlastp |
| 1885 | sorghum\|12v1\|SB02G036080 | 5842 | 590 | 89.5 | globlastp |
| 1886 | switchgrass\|12v1\|DN143417_P1 | 5843 | 590 | 87.1 | globlastp |
| 1887 | switchgrass\|12v1\|FE607440_P1 | 5844 | 590 | 84.7 | globlastp |
| 1888 | switchgrass\|gb167\|DN143417 | 5845 | 590 | 84.2 | globlastp |
| 1889 | foxtail_millet\|11v3\|PHY7SI032776M_P1 | 5846 | 590 | 83.3 | globlastp |
| 1890 | sugarcane\|10v1\|CA067567 | 5847 | 590 | 81.88 | glotblastn |
| 1891 | sorghum\|12v1\|SB09G024370 | 5848 | 591 | 90.8 | globlastp |
| 1892 | foxtail_millet\|11v3\|PHY7SI022187M_P1 | 5849 | 591 | 86.8 | globlastp |
| 1893 | switchgrass\|12v1\|DN142345_P1 | 5850 | 591 | 84.4 | globlastp |
| 1894 | switchgrass\|gb167\|DN142345 | 5851 | 591 | 83.7 | globlastp |
| 1895 | switchgrass\|12v1\|FE645382_P1 | 5852 | 591 | 83 | globlastp |
| 1896 | sugarcane\|10v1\|CA103945 | 5853 | 592 | 92.7 | globlastp |
| 1897 | foxtail_millet\|11v3\|PHY7SI026860M_P1 | 5854 | 592 | 89.8 | globlastp |
| 1898 | sorghum\|12v1\|SB05G002140 | 5855 | 592 | 85.6 | globlastp |
| 1899 | rice\|11v1\|AU055910 | 5856 | 592 | 80.4 | globlastp |
| 1900 | wheat\|12v3\|CA617395 | 5857 | 593 | 95.8 | globlastp |
| 1901 | maize\|10v1\|AI855306_P1 | 5858 | 593 | 91.7 | globlastp |
| 1902 | sorghum\|12v1\|SB12V1CUFF33786T3 | 5859 | 593 | 90.6 | globlastp |
| 1903 | foxtail_millet\|11v3\|PHY7SI003476M_P1 | 5860 | 593 | 87.6 | globlastp |
| 1904 | switchgrass\|12v1\|SRR187769.1032073_P1 | 5861 | 593 | 81.2 | globlastp |
| 1905 | foxtail_millet\|11v3\|EC612302_P1 | 5862 | 594 | 90.5 | globlastp |
| 1906 | switchgrass\|gb167\|DN146578 | 5863 | 594 | 89.66 | glotblastn |
| 1907 | switchgrass\|12v1\|FL988994_P1 | 5864 | 594 | 88.3 | globlastp |
| 1908 | sorghum\|12v1\|SB06G022600 | 5865 | 594 | 87.8 | globlastp |
| 1909 | rice\|11v1\|AA751969 | 5866 | 594 | 81.03 | glotblastn |
| 1910 | sorghum\|12v1\|SB02G038410 | 5867 | 595 | 92.1 | globlastp |
| 1911 | maize\|10v1\|AW120311_P1 | 5868 | 595 | 91.4 | globlastp |
| 1912 | sugarcane\|10v1\|CA164284 | 5869 | 595 | 84.79 | glotblastn |
| 1913 | sorghum\|12v1\|SB04G027640 | 5870 | 596 | 90.7 | globlastp |
| 1914 | switchgrass\|12v1\|FL786140_P1 | 5871 | 596 | 89.1 | globlastp |
| 1915 | switchgrass\|gb167\|FL721485 | 5872 | 596 | 88.7 | globlastp |
| 1916 | switchgrass\|12v1\|FL721485_P1 | 5873 | 596 | 87.5 | globlastp |
| 1917 | foxtail_millet\|11v3\|PHY7SI017900M_P1 | 5874 | 596 | 87.5 | globlastp |
| 1918 | millet\|10v1\|CD726376_P1 | 5875 | 596 | 87.1 | globlastp |
| 1919 | cenchrus\|gb166\|EB657574_P1 | 5876 | 596 | 86.3 | globlastp |
| 1920 | cynodon\|10v1\|ES295019_P1 | 5877 | 596 | 83.1 | globlastp |
| 1921 | foxtail_millet\|11v3\|PHY7SI010534M_P1 | 5878 | 598 | 90.7 | globlastp |
| 1922 | brachypodium\|12v1\|BRADI5G17650T2_P1 | 5879 | 598 | 88.2 | globlastp |
| 1923 | barley\|12v1\|BM097165_P1 | 5880 | 598 | 87.2 | globlastp |
| 1924 | rye\|12v1\|DRR001012.110300 | 5881 | 598 | 87 | globlastp |
| 1925 | switchgrass\|12v1\|FE640105_P1 | 5882 | 598 | 86.4 | globlastp |
| 1926 | switchgrass\|12v1\|FE631813_P1 | 5883 | 598 | 85.2 | globlastp |
| 1927 | wheat\|12v3\|BE500130 | 5884 | 598 | 82.4 | globlastp |
| 1928 | barley\|12v1\|BQ753928_P1 | 5885 | 598 | 82.1 | globlastp |
| 1929 | wheat\|12v3\|CA607637 | 5886 | 598 | 81.7 | globlastp |
| 1930 | foxtail_millet\|11v3\|PHY7SI017738M_P1 | 5887 | 598 | 81.2 | globlastp |
| 1931 | switchgrass\|12v1\|FE613606_P1 | 5888 | 598 | 81 | globlastp |
| 1932 | brachypodium\|12v1\|BRADI3G50660_P1 | 5889 | 598 | 80.2 | globlastp |
| 1933 | switchgrass\|gb167\|FE613606 | 5890 | 598 | 80.2 | globlastp |
| 1934 | sorghum\|12v1\|SB04G032930 | 5891 | 598 | 80.1 | globlastp |
| 1935 | sorghum\|12v1\|SB05G022970 | 5892 | 599 | 86.9 | globlastp |
| 1936 | foxtail_millet\|11v3\|EC612732_P1 | 5893 | 599 | 82.7 | globlastp |
| 1937 | switchgrass\|12v1\|FL902137_P1 | 5894 | 599 | 81.1 | globlastp |
| 1938 | switchgrass\|12v1\|DN142479_T1 | 5895 | 599 | 81.01 | glotblastn |
| 1939 | sorghum\|12v1\|SB07G005620_P1 | 5896 | 600 | 86.6 | globlastp |
| 1940 | foxtail_millet\|11v3\|PHY7SI013963M_P1 | 5897 | 600 | 82 | globlastp |
| 1941 | switchgrass\|12v1\|FL825596_T1 | 5898 | 600 | 80.7 | glotblastn |
| 1942 | sorghum\|12v1\|SB10G012990 | 5899 | 601 | 95.7 | globlastp |
| 1943 | switchgrass\|12v1\|FE607208_P1 | 5900 | 601 | 92.7 | globlastp |
| 1944 | rice\|11v1\|AU083373 | 5901 | 601 | 90.3 | globlastp |
| 1945 | wheat\|12v3\|BE402176 | 5902 | 601 | 89.8 | globlastp |
| 1946 | brachypodium\|12v1\|BRADI1G42580_P1 | 5903 | 601 | 89 | globlastp |
| 1947 | rye\|12v1\|DRR001012.153298 | 5904 | 601 | 88.14 | glotblastn |
| 1948 | sugarcane\|10v1\|CA119301 | 5905 | 601 | 86.3 | globlastp |
| 1949 | switchgrass\|12v1\|SRR187765.274141_P1 | 5906 | 601 | 86 | globlastp |
| 1950 | sugarcane\|10v1\|BQ533976 | 5907 | 601 | 82.43 | glotblastn |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 1951 | barley\|12v1\|BF262112_P1 | 5908 | 601 | 82.2 | globlastp |
| 1952 | leymus\|gb166\|EG380361_P1 | 5909 | 601 | 81.9 | globlastp |
| 1953 | rye\|12v1\|DRR001012.108416 | 5910 | 601 | 81.62 | glotblastn |
| 1954 | maize\|10v1\|AI941780_T1 | 5911 | 601 | 80.81 | glotblastn |
| 1955 | brachypodium\|12v1\|BRADI3G53200_T1 | 5912 | 601 | 80.54 | glotblastn |
| 1956 | wheat\|12v3\|BE604097 | 5913 | 601 | 80.54 | glotblastn |
| 1957 | sorghum\|12v1\|SB04G030050 | 5914 | 601 | 80.3 | globlastp |
| 1958 | switchgrass\|gb167\|DN147068 | 5915 | 601 | 80.11 | glotblastn |
| 1959 | switchgrass\|12v1\|DN147068_P1 | 5916 | 601 | 80 | globlastp |
| 1960 | foxtail_millet\|11v3\|PHY7SI017132M_P1 | 5917 | 601 | 80 | globlastp |
| 1961 | rice\|11v1\|AU031830 | 5918 | 601 | 80 | glotblastn |
| 1962 | sugarcane\|10v1\|CA078268 | 5919 | 602 | 96.2 | globlastp |
| 1963 | sorghum\|12v1\|SB07G006400 | 5920 | 602 | 95.7 | globlastp |
| 1964 | foxtail_millet\|11v3\|PHY7SI014254M_T1 | 5921 | 602 | 93.65 | glotblastn |
| 1965 | rice\|11v1\|AU070756 | 5922 | 602 | 90.9 | globlastp |
| 1966 | switchgrass\|12v1\|FL973471_P1 | 5923 | 602 | 89 | globlastp |
| 1967 | millet\|10v1\|EVO454PM089385_P1 | 5924 | 602 | 86.6 | globlastp |
| 1968 | switchgrass\|12v1\|HO310867_P1 | 5925 | 602 | 82.3 | globlastp |
| 1969 | pseudoroegneria\|gb167\|FF345388 | 5926 | 602 | 81.2 | globlastp |
| 1970 | rye\|12v1\|BE704630 | 5927 | 602 | 81.2 | globlastp |
| 1971 | rye\|12v1\|DRR001012.174686 | 5928 | 602 | 81.2 | globlastp |
| 1972 | wheat\|12v3\|CA598158 | 5929 | 602 | 81.2 | globlastp |
| 1973 | brachypodium\|12v1\|BRADI3G18320_P1 | 5930 | 602 | 80.4 | globlastp |
| 1974 | sorghum\|12v1\|SB03G038750 | 5931 | 603 | 95.2 | globlastp |
| 1975 | foxtail_millet\|11v3\|PHY7SI001054M_P1 | 5932 | 603 | 91.3 | globlastp |
| 1976 | rice\|11v1\|CA763022 | 5933 | 603 | 88 | globlastp |
| 1977 | brachypodium\|12v1\|BRADI2G53970_P1 | 5934 | 603 | 85.7 | globlastp |
| 1978 | wheat\|12v3\|CA499352 | 5935 | 603 | 84.3 | globlastp |
| 1979 | wheat\|12v3\|BE592048 | 5936 | 603 | 83.9 | globlastp |
| 1980 | rye\|12v1\|BE494441 | 5937 | 603 | 83.7 | globlastp |
| 1981 | wheat\|12v3\|CA597218 | 5938 | 603 | 80.3 | globlastp |
| 1982 | sorghum\|12v1\|SB03G041150 | 5939 | 604 | 92.8 | globlastp |
| 1983 | switchgrass\|12v1\|FL765239_P1 | 5940 | 604 | 88 | globlastp |
| 1984 | foxtail_millet\|11v3\|PHY7SI004487M_P1 | 5941 | 604 | 88 | globlastp |
| 1985 | millet\|10v1\|EVO454PM018951_P1 | 5942 | 604 | 82.7 | globlastp |
| 1986 | foxtail_millet\|11v3\|EC612408_T1 | 5943 | 605 | 90.65 | glotblastn |
| 1987 | sorghum\|12v1\|SB10G023130 | 5944 | 605 | 85.9 | globlastp |
| 1988 | sugarcane\|10v1\|CA066507 | 5945 | 605 | 85.7 | globlastp |
| 1989 | rice\|11v1\|BI306514 | 5946 | 605 | 84.3 | glotblastn |
| 1990 | brachypodium\|12v1\|BRADI1G37020_T1 | 5947 | 605 | 83.88 | glotblastn |
| 1991 | oat\|11v1\|CN817174_T1 | 5948 | 605 | 83.88 | glotblastn |
| 1992 | rye\|12v1\|DRR001012.106695 | 5949 | 605 | 83.61 | glotblastn |
| 1993 | wheat\|12v3\|BE411964 | 5950 | 605 | 83.14 | glotblastn |
| 1994 | millet\|10v1\|EVO454PM001039_P1 | 5951 | 605 | 83.1 | globlastp |
| 1995 | switchgrass\|12v1\|FE618188_P1 | 5952 | 605 | 83.1 | globlastp |
| 1996 | switchgrass\|gb167\|FE618188 | 5953 | 605 | 83.1 | globlastp |
| 1997 | cenchrus\|gb166\|EB652675_P1 | 5954 | 605 | 82.9 | globlastp |
| 1998 | barley\|12v1\|BF624975_T1 | 5955 | 605 | 82.44 | glotblastn |
| 1999 | sorghum\|12v1\|SB07G026140 | 5956 | 606 | 96.6 | globlastp |
| 2000 | foxtail_millet\|11v3\|PHY7SI013455M_P1 | 5957 | 606 | 93.9 | globlastp |
| 2001 | maize\|10v1\|CD996489_P1 | 5958 | 606 | 93.5 | globlastp |
| 2002 | rice\|11v1\|CA748457 | 5959 | 606 | 87.9 | globlastp |
| 2003 | brachypodium\|12v1\|BRADI3G41320_P1 | 5960 | 606 | 86.7 | globlastp |
| 2004 | barley\|12v1\|AK359805_P1 | 5961 | 606 | 86.1 | globlastp |
| 2005 | rye\|12v1\|BE494872 | 5962 | 606 | 85.9 | globlastp |
| 2006 | wheat\|12v3\|CD880934 | 5963 | 606 | 85.21 | glotblastn |
| 2007 | sorghum\|12v1\|AW284970 | 5964 | 607 | 87.5 | globlastp |
| 2008 | sorghum\|12v1\|SB01G009530 | 5964 | 607 | 87.5 | globlastp |
| 2009 | maize\|10v1\|AW059954_P1 | 5965 | 607 | 85.7 | globlastp |
| 2010 | sugarcane\|10v1\|BQ530027 | 5966 | 607 | 83.57 | glotblastn |
| 2011 | sorghum\|12v1\|SB09G022630 | 5967 | 608 | 90.8 | globlastp |
| 2012 | switchgrass\|12v1\|FL993342_P1 | 5968 | 608 | 89 | globlastp |
| 2013 | cenchrus\|gb166\|EB669554_P1 | 5969 | 608 | 88.1 | globlastp |
| 2014 | foxtail_millet\|11v3\|PHY7SI023197M_P1 | 5970 | 608 | 88.1 | globlastp |
| 2015 | wheat\|12v3\|BE604061 | 5971 | 608 | 83.5 | globlastp |
| 2016 | rice\|11v1\|BI813410 | 5972 | 608 | 83.1 | globlastp |
| 2017 | switchgrass\|gb167\|FL993342 | 5973 | 608 | 83.1 | globlastp |
| 2018 | rye\|12v1\|DRR001012.828307XX1 | 5974 | 608 | 83 | globlastp |
| 2019 | barley\|12v1\|BF626716_P1 | 5975 | 608 | 81.2 | globlastp |
| 2020 | brachypodium\|12v1\|BRADI2G23200_P1 | 5976 | 608 | 80.9 | globlastp |
| 2021 | sugarcane\|10v1\|CA091367 | 5977 | 609 | 91.2 | globlastp |
| 2022 | sorghum\|12v1\|SB06G023260 | 5978 | 609 | 90.5 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 2023 | foxtail_millet\|11v3\|PHY7SI011332M_P1 | 5979 | 609 | 87.3 | globlastp |
| 2024 | millet\|10v1\|EVO454PM326349_P1 | 5980 | 609 | 85.5 | globlastp |
| 2025 | switchgrass\|12v1\|FE635833_P1 | 5981 | 609 | 82.3 | globlastp |
| 2026 | switchgrass\|12v1\|FL965224_P1 | 5982 | 609 | 82.3 | globlastp |
| 2027 | switchgrass\|gb167\|FE635833 | 5982 | 609 | 82.3 | globlastp |
| 2028 | sorghum\|12v1\|SB10G005040 | 5983 | 610 | 96.1 | globlastp |
| 2029 | sugarcane\|10v1\|CA216130 | 5984 | 610 | 94.8 | globlastp |
| 2030 | foxtail_millet\|11v3\|PHY7SI007419M_P1 | 5985 | 610 | 91.6 | globlastp |
| 2031 | wheat\|12v3\|CA484155 | 5986 | 610 | 89.6 | globlastp |
| 2032 | switchgrass\|gb167\|FL980407 | 5987 | 610 | 88.4 | globlastp |
| 2033 | millet\|10v1\|EVO454PM167260_P1 | 5988 | 610 | 88.3 | globlastp |
| 2034 | switchgrass\|12v1\|FL980407_P1 | 5989 | 610 | 87.7 | globlastp |
| 2035 | switchgrass\|12v1\|GD015248_P1 | 5990 | 610 | 87 | globlastp |
| 2036 | switchgrass\|gb167\|GD015248 | 5991 | 610 | 87 | globlastp |
| 2037 | lovegrass\|gb167\|DN480312_P1 | 5992 | 610 | 81.4 | globlastp |
| 2038 | sorghum\|12v1\|SB04G006020 | 5993 | 611 | 92.9 | globlastp |
| 2039 | maize\|10v1\|AW054575_P1 | 5994 | 611 | 92.8 | globlastp |
| 2040 | switchgrass\|12v1\|FL873296_P1 | 5995 | 611 | 92.1 | globlastp |
| 2041 | foxtail_millet\|11v3\|PHY7SI018649M_P1 | 5996 | 611 | 92.1 | globlastp |
| 2042 | sugarcane\|10v1\|CA289508 | 5997 | 611 | 92.1 | globlastp |
| 2043 | maize\|10v1\|ZMCRP2V222510_T1 | 5998 | 611 | 90.2 | glotblastn |
| 2044 | sorghum\|12v1\|SB12V1CRP053042 | 5999 | 611 | 86.49 | glotblastn |
| 2045 | millet\|10v1\|EVO454PM554128_P1 | 6000 | 611 | 85.6 | globlastp |
| 2046 | rice\|11v1\|BE230517 | 6001 | 611 | 80.8 | globlastp |
| 2047 | switchgrass\|12v1\|FL691774_P1 | 6002 | 613 | 90.7 | globlastp |
| 2048 | foxtail_millet\|11v3\|PHY7SI005698M_P1 | 6003 | 613 | 90 | globlastp |
| 2049 | rice\|11v1\|BM038357_P1 | 6004 | 613 | 88.6 | globlastp |
| 2050 | brachypodium\|12v1\|BRADI1G38025_P1 | 6005 | 613 | 88.2 | globlastp |
| 2051 | switchgrass\|12v1\|FL810628_P1 | 6006 | 613 | 83.7 | globlastp |
| 2052 | wheat\|12v3\|SRR073321X137461D1_T1 | 6007 | 613 | 81.64 | glotblastn |
| 2053 | sorghum\|12v1\|SB02G009130 | 6008 | 614 | 85.3 | globlastp |
| 2054 | foxtail_millet\|11v3\|PHY7SI028698M_P1 | 6009 | 614 | 84.3 | globlastp |
| 2055 | foxtail_millet\|11v3\|PHY7SI028688M_P1 | 6010 | 614 | 84.2 | globlastp |
| 2056 | sorghum\|12v1\|SB02G009140 | 6011 | 614 | 83.12 | glotblastn |
| 2057 | switchgrass\|12v1\|FE627523_P1 | 6012 | 614 | 83 | globlastp |
| 2058 | brachypodium\|12v1\|BRADI1G52740_T1 | 6013 | 614 | 80.2 | glotblastn |
| 2059 | sorghum\|12v1\|SB06G015410 | 6014 | 615 | 91.5 | globlastp |
| 2060 | switchgrass\|gb167\|FE628616 | 6015 | 615 | 91.1 | globlastp |
| 2061 | foxtail_millet\|11v3\|PHY7SI010641M_P1 | 6016 | 615 | 90.5 | globlastp |
| 2062 | switchgrass\|12v1\|FE628616_P1 | 6017 | 615 | 89.9 | globlastp |
| 2063 | sorghum\|12v1\|SB06G015400 | 6018 | 615 | 88.6 | globlastp |
| 2064 | brachypodium\|12v1\|BRADI5G09180_P1 | 6019 | 615 | 86.4 | globlastp |
| 2065 | barley\|12v1\|BF261816_P1 | 6020 | 615 | 85.4 | globlastp |
| 2066 | rye\|12v1\|DRR001012.136309 | 6021 | 615 | 85.4 | globlastp |
| 2067 | wheat\|12v3\|CA694027 | 6022 | 615 | 85.13 | glotblastn |
| 2068 | pseudoroegneria\|gb167\|FF346018 | 6023 | 615 | 85.1 | globlastp |
| 2069 | wheat\|12v3\|BE638108 | 6024 | 615 | 84.8 | globlastp |
| 2070 | wheat\|12v3\|BI479695 | 6025 | 615 | 83.2 | globlastp |
| 2071 | wheat\|12v3\|CA618982 | 6026 | 616 | 98.53 | glotblastn |
| 2072 | sorghum\|12v1\|SB06G025770 | 6027 | 618 | 93.3 | globlastp |
| 2073 | foxtail_millet\|11v3\|PHY7SI010516M_P1 | 6028 | 618 | 91.6 | globlastp |
| 2074 | switchgrass\|12v1\|FL941640_P1 | 6029 | 618 | 91 | globlastp |
| 2075 | switchgrass\|12v1\|FE618003_P1 | 6030 | 618 | 89.8 | globlastp |
| 2076 | switchgrass\|gb167\|FE618003 | 6030 | 618 | 89.8 | globlastp |
| 2077 | millet\|10v1\|CD725035_P1 | 6031 | 618 | 84.4 | globlastp |
| 2078 | brachypodium\|12v1\|BRADI5G18750_P1 | 6032 | 618 | 81.5 | globlastp |
| 2079 | switchgrass\|12v1\|SRR187765.696295_T1 | 6033 | 619 | 86.25 | glotblastn |
| 2080 | sorghum\|12v1\|SB03G036325 | 6034 | 619 | 84.15 | glotblastn |
| 2081 | switchgrass\|12v1\|FL786883_T1 | 6035 | 619 | 83.75 | glotblastn |
| 2082 | lovegrass\|gb167\|DN480814_P1 | 6036 | 619 | 80.7 | globlastp |
| 2083 | foxtail_millet\|11v3\|PHY7SI003577M_P1 | 6037 | 619 | 80.5 | globlastp |
| 2084 | foxtail_millet\|11v3\|PHY7SI010398M_P1 | 6038 | 621 | 83.6 | globlastp |
| 2085 | switchgrass\|gb167\|FE606354 | 6039 | 621 | 81.9 | globlastp |
| 2086 | millet\|10v1\|CD725601_P1 | 6040 | 621 | 81.8 | globlastp |
| 2087 | switchgrass\|12v1\|DN141325_P1 | 6041 | 622 | 80.5 | globlastp |
| 2088 | sorghum\|12v1\|SB07G025120 | 6042 | 622 | 80.35 | glotblastn |
| 2089 | sorghum\|12v1\|SB01G016420 | 6043 | 623 | 89.7 | globlastp |
| 2090 | foxtail_millet\|11v3\|PHY7SI039879M_P1 | 6044 | 623 | 85.8 | globlastp |
| 2091 | sorghum\|12v1\|SB02G029320 | 6045 | 624 | 86.7 | globlastp |
| 2092 | maize\|10v1\|CF043867_P1 | 6046 | 624 | 83.1 | globlastp |
| 2093 | millet\|10v1\|EVO454PM458631_P1 | 6047 | 624 | 82 | globlastp |
| 2094 | foxtail_millet\|11v3\|PHY7SI031193M_P1 | 6048 | 624 | 81.2 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 2095 | sorghum\|12v1\|SB03G043280 | 6049 | 625 | 94.2 | globlastp |
| 2096 | foxtail_millet\|11v3\|PHY7SI005148M_T1 | 6050 | 625 | 87.67 | glotblastn |
| 2097 | foxtail_millet\|11v3\|PHY7SI002757M_P1 | 6051 | 627 | 86.1 | globlastp |
| 2098 | sorghum\|12v1\|SB03G009060 | 6052 | 627 | 84.1 | globlastp |
| 2099 | switchgrass\|12v1\|FL726886_P1 | 6053 | 627 | 82.1 | globlastp |
| 2100 | sorghum\|12v1\|SB01G046350 | 6054 | 629 | 86.9 | globlastp |
| 2101 | sugarcane\|10v1\|CA074330 | 630 | 630 | 100 | globlastp |
| 2102 | sorghum\|12v1\|SB07G022630 | 6055 | 630 | 99.6 | globlastp |
| 2103 | switchgrass\|12v1\|DN140969_P1 | 6056 | 630 | 98.4 | globlastp |
| 2104 | switchgrass\|gb167\|DN140969 | 6056 | 630 | 98.4 | globlastp |
| 2105 | switchgrass\|12v1\|FE645210_P1 | 6056 | 630 | 98.4 | globlastp |
| 2106 | switchgrass\|gb167\|FE645210 | 6056 | 630 | 98.4 | globlastp |
| 2107 | cenchrus\|gb166\|EB657452_P1 | 6057 | 630 | 98 | globlastp |
| 2108 | foxtail_millet\|11v3\|EC613322_P1 | 6058 | 630 | 98 | globlastp |
| 2109 | barley\|12v1\|BE411312_P1 | 6059 | 630 | 95.9 | globlastp |
| 2110 | brachypodium\|12v1\|BRADI1G19960_P1 | 6060 | 630 | 95.9 | globlastp |
| 2111 | oat\|11v1\|GO581906_P1 | 6061 | 630 | 95.9 | globlastp |
| 2112 | pseudoroegneria\|gb167\|FF343605 | 6059 | 630 | 95.9 | globlastp |
| 2113 | wheat\|12v3\|BE419677 | 6059 | 630 | 95.9 | globlastp |
| 2114 | lolium\|10v1\|AU245785_T1 | 6062 | 630 | 95.51 | glotblastn |
| 2115 | leymus\|gb166\|EG396954_P1 | 6063 | 630 | 95.5 | globlastp |
| 2116 | rice\|11v1\|BI802985 | 6064 | 630 | 95.5 | globlastp |
| 2117 | rye\|12v1\|BE704628 | 6065 | 630 | 95.5 | globlastp |
| 2118 | rye\|12v1\|DRR001012.125579 | 6065 | 630 | 95.5 | globlastp |
| 2119 | oat\|11v1\|GO583055_P1 | 6066 | 630 | 95.1 | globlastp |
| 2120 | peanut\|10v1\|EE127200_P1 | 6067 | 630 | 93.9 | globlastp |
| 2121 | peanut\|10v1\|ES724140_P1 | 6068 | 630 | 93.9 | globlastp |
| 2122 | pigeonpea\|11v1\|SRR054580X109465_P1 | 6069 | 630 | 93.9 | globlastp |
| 2123 | cowpea\|12v1\|FF391074_P1 | 6070 | 630 | 93.5 | globlastp |
| 2124 | oil_palm\|11v1\|EY411468_P1 | 6071 | 630 | 93.5 | globlastp |
| 2125 | pigeonpea\|11v1\|SRR054580X109236_P1 | 6072 | 630 | 93.5 | globlastp |
| 2126 | banana\|12v1\|BBS1822T3_P1 | 6073 | 630 | 93.1 | globlastp |
| 2127 | bean\|12v1\|CA898112 | 6074 | 630 | 93.1 | globlastp |
| 2128 | cowpea\|12v1\|FF395868_P1 | 6075 | 630 | 93.1 | globlastp |
| 2129 | flaveria\|11v1\|SRR149229.14060_P1 | 6076 | 630 | 93.1 | globlastp |
| 2130 | flaveria\|11v1\|SRR149229.271685_P1 | 6076 | 630 | 93.1 | globlastp |
| 2131 | flaveria\|11v1\|SRR149232.133345_P1 | 6077 | 630 | 93.1 | globlastp |
| 2132 | flaveria\|11v1\|SRR149232.23150_P1 | 6076 | 630 | 93.1 | globlastp |
| 2133 | soybean\|11v1\|GLYMA09G28640 | 6078 | 630 | 93.1 | globlastp |
| 2134 | soybean\|12v1\|GLYMA09G28640_P1 | 6078 | 630 | 93.1 | globlastp |
| 2135 | soybean\|11v1\|GLYMA16G33360 | 6079 | 630 | 93.1 | globlastp |
| 2136 | soybean\|12v1\|GLYMA16G33370T4_P1 | 6079 | 630 | 93.1 | globlastp |
| 2137 | soybean\|11v1\|GLYMA20G35750 | 6080 | 630 | 93.1 | globlastp |
| 2138 | soybean\|12v1\|GLYMA20G35750_P1 | 6080 | 630 | 93.1 | globlastp |
| 2139 | bean\|12v2\|CA899890_P1 | 6081 | 630 | 92.7 | globlastp |
| 2140 | cirsium\|11v1\|SRR346952.1018515_P1 | 6082 | 630 | 92.7 | globlastp |
| 2141 | cirsium\|11v1\|SRR346952.111639_P1 | 6082 | 630 | 92.7 | globlastp |
| 2142 | coffea\|10v1\|DV666851_P1 | 6083 | 630 | 92.7 | globlastp |
| 2143 | dandelion\|10v1\|DR399058_P1 | 6084 | 630 | 92.7 | globlastp |
| 2144 | lettuce\|12v1\|DW063622_P1 | 6085 | 630 | 92.7 | globlastp |
| 2145 | platanus\|11v1\|SRR096786X101590_P1 | 6086 | 630 | 92.7 | globlastp |
| 2146 | centaurea\|11v1\|EH778178_P1 | 6082 | 630 | 92.7 | globlastp |
| 2147 | centaurea\|11v1\|EH718595_P1 | 6082 | 630 | 92.7 | globlastp |
| 2148 | centaurea\|11v1\|EH717068_T1 | 6087 | 630 | 92.65 | glotblastn |
| 2149 | ambrosia\|11v1\|SRR346946.101372_T1 | 6088 | 630 | 92.24 | glotblastn |
| 2150 | prunus_mume\|13v1\|BU039610_P1 | 6089 | 630 | 92.2 | globlastp |
| 2151 | ambrosia\|11v1\|SRR346935.325236_P1 | 6090 | 630 | 92.2 | globlastp |
| 2152 | ambrosia\|11v1\|SRR346943.104742_P1 | 6090 | 630 | 92.2 | globlastp |
| 2153 | arnica\|11v1\|SRR099034X132474_P1 | 6090 | 630 | 92.2 | globlastp |
| 2154 | chelidonium\|11v1\|SRR084752X107741_P1 | 6091 | 630 | 92.2 | globlastp |
| 2155 | flaveria\|11v1\|SRR149229.163723_P1 | 6090 | 630 | 92.2 | globlastp |
| 2156 | hornbeam\|12v1\|SRR364455.105073_P1 | 6092 | 630 | 92.2 | globlastp |
| 2157 | ipomoea_nil\|10v1\|CJ739977_P1 | 6093 | 630 | 92.2 | globlastp |
| 2158 | prunus\|10v1\|BU039610 | 6089 | 630 | 92.2 | globlastp |
| 2159 | sunflower\|12v1\|CD851643 | 6090 | 630 | 92.2 | globlastp |
| 2160 | sunflower\|12v1\|CD851651 | 6090 | 630 | 92.2 | globlastp |
| 2161 | sunflower\|12v1\|EE633004 | 6090 | 630 | 92.2 | globlastp |
| 2162 | olea\|13v1\|SRR014464X11134D1_P1 | 6094 | 630 | 92.2 | globlastp |
| 2163 | centaurea\|gb166\|EH766091 | 6095 | 630 | 91.84 | glotblastn |
| 2164 | gerbera\|09v1\|AJ762871_T1 | 6096 | 630 | 91.84 | glotblastn |
| 2165 | platanus\|11v1\|SRR096786X103251_T1 | 6097 | 630 | 91.84 | glotblastn |
| 2166 | sunflower\|12v1\|ERR029545X40874 | 6098 | 630 | 91.84 | glotblastn |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 2167 | ambrosia\|11v1\|SRR346943.116300_P1 | 6099 | 630 | 91.8 | globlastp |
| 2168 | apple\|11v1\|CN876664_P1 | 6100 | 630 | 91.8 | globlastp |
| 2169 | cassava\|09v1\|DV441101_P1 | 6101 | 630 | 91.8 | globlastp |
| 2170 | castorbean\|12v1\|GE633432_P1 | 6102 | 630 | 91.8 | globlastp |
| 2171 | centaurea\|gb166\|EH717068 | 6103 | 630 | 91.8 | globlastp |
| 2172 | eucalyptus\|11v2\|CD668611_P1 | 6104 | 630 | 91.8 | globlastp |
| 2173 | oil_palm\|11v1\|EL693601_P1 | 6105 | 630 | 91.8 | globlastp |
| 2174 | phyla\|11v2\|SRR099035X101156_P1 | 6106 | 630 | 91.8 | globlastp |
| 2175 | vinca\|11v1\|SRR098690X104175 | 6107 | 630 | 91.8 | globlastp |
| 2176 | blueberry\|12v1\|SRR353282X1807D1_T1 | 6108 | 630 | 91.43 | glotblastn |
| 2177 | fraxinus\|11v1\|SRR058827.113024_T1 | 6109 | 630 | 91.43 | glotblastn |
| 2178 | olea\|13v1\|SRR592583X161174D1_P1 | 6110 | 630 | 91.4 | globlastp |
| 2179 | amorphophallus\|11v2\|SRR089351X102088_P1 | 6111 | 630 | 91.4 | globlastp |
| 2180 | amsonia\|11v1\|SRR098688X107510_P1 | 6112 | 630 | 91.4 | globlastp |
| 2181 | aristolochia\|10v1\|FD750472_P1 | 6113 | 630 | 91.4 | globlastp |
| 2182 | chickpea\|11v1\|SRR133517.148214 | 6114 | 630 | 91.4 | globlastp |
| 2183 | chickpea\|13v2\|SRR133517.148214_P1 | 6114 | 630 | 91.4 | globlastp |
| 2184 | cotton\|11v1\|CO092137_P1 | 6115 | 630 | 91.4 | globlastp |
| 2185 | ginger\|gb164\|DY345402_P1 | 6116 | 630 | 91.4 | globlastp |
| 2186 | gossypium_raimondii\|12v1\|BG442956_P1 | 6115 | 630 | 91.4 | globlastp |
| 2187 | rose\|12v1\|BQ104637 | 6117 | 630 | 91.4 | globlastp |
| 2188 | tabernaemontana\|11v1\|SRR098689X102299 | 6118 | 630 | 91.4 | globlastp |
| 2189 | tobacco\|gb162\|CV019233 | 6119 | 630 | 91.4 | globlastp |
| 2190 | banana\|12v1\|FL647015_T1 | 6120 | 630 | 91.02 | glotblastn |
| 2191 | eschscholzia\|11v1\|SRR014116.122571_T1 | 6121 | 630 | 91.02 | glotblastn |
| 2192 | bean\|12v2\|CA898112_P1 | 6122 | 630 | 91 | globlastp |
| 2193 | artemisia\|10v1\|EY074664_P1 | 6123 | 630 | 91 | globlastp |
| 2194 | basilicum\|10v1\|DY325692_P1 | 6124 | 630 | 91 | globlastp |
| 2195 | blueberry\|12v1\|SRR353282X14043D1_P1 | 6125 | 630 | 91 | globlastp |
| 2196 | cacao\|10v1\|CU481646_P1 | 6126 | 630 | 91 | globlastp |
| 2197 | cotton\|11v1\|CO089165_P1 | 6127 | 630 | 91 | globlastp |
| 2198 | humulus\|11v1\|EX518234_P1 | 6128 | 630 | 91 | globlastp |
| 2199 | ipomoea_nil\|10v1\|BJ563148_P1 | 6129 | 630 | 91 | globlastp |
| 2200 | monkeyflower\|10v1\|CV520116 | 6130 | 630 | 91 | globlastp |
| 2201 | monkeyflower\|12v1\|CV520116_P1 | 6130 | 630 | 91 | globlastp |
| 2202 | nasturtium\|11v1\|SRR032558.102424_P1 | 6131 | 630 | 91 | globlastp |
| 2203 | orange\|11v1\|CB305130_P1 | 6132 | 630 | 91 | globlastp |
| 2204 | pepper\|12v1\|GD094722_P1 | 6133 | 630 | 91 | globlastp |
| 2205 | strawberry\|11v1\|SRR034866S0006579 | 6134 | 630 | 91 | globlastp |
| 2206 | tomato\|11v1\|BG133635 | 6135 | 630 | 91 | globlastp |
| 2207 | triphysaria\|10v1\|EY128411 | 6136 | 630 | 91 | globlastp |
| 2208 | vinca\|11v1\|SRR098690X119964 | 6137 | 630 | 91 | globlastp |
| 2209 | nicotiana_benthamiana\|12v1\|BP744332_T1 | 6138 | 630 | 90.61 | glotblastn |
| 2210 | poplar\|13v1\|AI165542_P1 | 6139 | 630 | 90.6 | globlastp |
| 2211 | catharanthus\|11v1\|SRR098691X111547_P1 | 6140 | 630 | 90.6 | globlastp |
| 2212 | clementine\|11v1\|CB305130_P1 | 6141 | 630 | 90.6 | globlastp |
| 2213 | gossypium_raimondii\|12v1\|BG445200_P1 | 6142 | 630 | 90.6 | globlastp |
| 2214 | grape\|11v1\|GSVIVT01022313001_P1 | 6143 | 630 | 90.6 | globlastp |
| 2215 | humulus\|11v1\|EX516492_P1 | 6144 | 630 | 90.6 | globlastp |
| 2216 | jatropha\|09v1\|GT228596_P1 | 6145 | 630 | 90.6 | globlastp |
| 2217 | kiwi\|gb166\|FG412659_P1 | 6146 | 630 | 90.6 | globlastp |
| 2218 | orange\|11v1\|CF830428_P1 | 6147 | 630 | 90.6 | globlastp |
| 2219 | poplar\|10v1\|AI165542 | 6139 | 630 | 90.6 | globlastp |
| 2220 | potato\|10v1\|BG095663_P1 | 6148 | 630 | 90.6 | globlastp |
| 2221 | sesame\|12v1\|BU670488 | 6149 | 630 | 90.6 | globlastp |
| 2222 | solanum_phureja\|09v1\|SPHBG133635 | 6148 | 630 | 90.6 | globlastp |
| 2223 | triphysaria\|10v1\|EX989885 | 6150 | 630 | 90.6 | globlastp |
| 2224 | vinca\|11v1\|SRR098690X101652 | 6151 | 630 | 90.6 | globlastp |
| 2225 | aquilegia\|10v2\|DR918066_P1 | 6152 | 630 | 90.2 | globlastp |
| 2226 | arabidopsis_lyrata\|09v1\|JGIAL018820_P1 | 6153 | 630 | 90.2 | globlastp |
| 2227 | canola\|11v1\|DY030272_P1 | 6154 | 630 | 90.2 | globlastp |
| 2228 | clementine\|11v1\|CF830428_P1 | 6155 | 630 | 90.2 | globlastp |
| 2229 | euphorbia\|11v1\|SRR098678X133629_P1 | 6156 | 630 | 90.2 | globlastp |
| 2230 | fagopyrum\|11v1\|SRR063703X101104_P1 | 6157 | 630 | 90.2 | globlastp |
| 2231 | radish\|gb164\|EV528078 | 6158 | 630 | 90.2 | globlastp |
| 2232 | radish\|gb164\|EV546258 | 6159 | 630 | 90.2 | globlastp |
| 2233 | radish\|gb164\|EW731449 | 6158 | 630 | 90.2 | globlastp |
| 2234 | silene\|11v1\|SRR096785X153172 | 6160 | 630 | 90.2 | globlastp |
| 2235 | tripterygium\|11v1\|SRR098677X104866 | 6161 | 630 | 90.2 | globlastp |
| 2236 | tripterygium\|11v1\|SRR098677X115523 | 6162 | 630 | 90.2 | globlastp |
| 2237 | valeriana\|11v1\|SRR099039X110396 | 6163 | 630 | 90.2 | globlastp |
| 2238 | arabidopsis\|10v1\|AT3G55620_P1 | 6164 | 630 | 89.8 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 2239 | b_rapa|11v1|CD830217_P1 | 6165 | 630 | 89.8 | globlastp |
| 2240 | canola|11v1|CN735659_P1 | 6166 | 630 | 89.8 | globlastp |
| 2241 | canola|11v1|EE405557_P1 | 6165 | 630 | 89.8 | globlastp |
| 2242 | lovegrass|gb167|EH184810_P1 | 6167 | 630 | 89.8 | globlastp |
| 2243 | strawberry|11v1|DV440665 | 6168 | 630 | 89.8 | globlastp |
| 2244 | canola|11v1|CN730372_P1 | 6169 | 630 | 89.4 | globlastp |
| 2245 | podocarpus|10v1|SRR065014S0011263_P1 | 6170 | 630 | 89.4 | globlastp |
| 2246 | b_rapa|11v1|CX187538_P1 | 6171 | 630 | 89 | globlastp |
| 2247 | catharanthus|11v1|SRR098691X113394_P1 | 6172 | 630 | 89 | globlastp |
| 2248 | chickpea|11v1|FE672990 | 6173 | 630 | 89 | globlastp |
| 2249 | chickpea|13v2|FE672990_P1 | 6173 | 630 | 89 | globlastp |
| 2250 | euonymus|11v1|SRR070038X172289_P1 | 6174 | 630 | 89 | globlastp |
| 2251 | euonymus|11v1|SRR070038X414930_P1 | 6174 | 630 | 89 | globlastp |
| 2252 | monkeyflower|10v1|GR067455 | 6175 | 630 | 89 | globlastp |
| 2253 | monkeyflower|12v1|GR067455_P1 | 6175 | 630 | 89 | globlastp |
| 2254 | phyla|11v2|SRR099037X113124_P1 | 6176 | 630 | 89 | globlastp |
| 2255 | silene|11v1|GH292754 | 6177 | 630 | 89 | globlastp |
| 2256 | silene|11v1|SRR096785X102821 | 6178 | 630 | 89 | globlastp |
| 2257 | thellungiella_parvulum|11v1|DN773718 | 6179 | 630 | 88.98 | glotblastn |
| 2258 | thellungiella_parvulum|11v1|EPCRP019003 | 6180 | 630 | 88.98 | glotblastn |
| 2259 | cacao|10v1|CU472943_P1 | 6181 | 630 | 88.6 | globlastp |
| 2260 | poppy|11v1|SRR030259.114710_P1 | 6182 | 630 | 88.6 | globlastp |
| 2261 | primula|11v1|SRR098679X121424_P1 | 6183 | 630 | 88.6 | globlastp |
| 2262 | watermelon|11v1|AB182929 | 6184 | 630 | 88.6 | globlastp |
| 2263 | flax|11v1|JG026727_T1 | 6185 | 630 | 88.57 | glotblastn |
| 2264 | medicago|12v1|XM_003622325_T1 | 6186 | 630 | 88.57 | glotblastn |
| 2265 | sarracenia|11v1|SRR192669.129090 | 6187 | 630 | 88.57 | glotblastn |
| 2266 | spurge|gb161|DV125160 | 6188 | 630 | 88.57 | glotblastn |
| 2267 | utricularia|11v1|SRR094438.122965 | 6189 | 630 | 88.21 | glotblastn |
| 2268 | zostera|12v1|SRR057351X106670D1_P1 | 6190 | 630 | 88.2 | globlastp |
| 2269 | kiwi|gb166|FG484183_P1 | 6191 | 630 | 88.2 | globlastp |
| 2270 | poplar|10v1|AI164646 | 6192 | 630 | 88.2 | globlastp |
| 2271 | poplar|13v1|AI164646_P1 | 6192 | 630 | 88.2 | globlastp |
| 2272 | poppy|11v1|SRR030259.12644_P1 | 6193 | 630 | 88.2 | globlastp |
| 2273 | sciadopitys|10v1|SRR065035S0036449 | 6194 | 630 | 88.2 | globlastp |
| 2274 | taxus|10v1|SRR032523S0028155 | 6195 | 630 | 88.2 | globlastp |
| 2275 | zostera|10v1|SRR057351S0004096 | 6190 | 630 | 88.2 | globlastp |
| 2276 | thellungiella_halophilum|11v1|DN773718 | 6196 | 630 | 88.16 | glotblastn |
| 2277 | ambrosia|11v1|SRR346943.107730_T1 | 6197 | 630 | 87.8 | glotblastn |
| 2278 | clover|gb162|AB236812_P1 | 6198 | 630 | 87.8 | globlastp |
| 2279 | cucurbita|11v1|FG227176_P1 | 6199 | 630 | 87.8 | globlastp |
| 2280 | distylium|11v1|SRR065077X101454_P1 | 6200 | 630 | 87.8 | globlastp |
| 2281 | flaveria|11v1|SRR149229.190286_P1 | 6201 | 630 | 87.8 | globlastp |
| 2282 | medicago|12v1|BE240689_P1 | 6202 | 630 | 87.8 | globlastp |
| 2283 | melon|10v1|EB715694_P1 | 6203 | 630 | 87.8 | globlastp |
| 2284 | phalaenopsis|11v1|SRR125771.1006537_P1 | 6204 | 630 | 87.8 | globlastp |
| 2285 | phalaenopsis|11v1|SRR125771.1011733_P1 | 6204 | 630 | 87.8 | globlastp |
| 2286 | pine|10v2|BM903098_P1 | 6205 | 630 | 87.8 | globlastp |
| 2287 | cannabis|12v1|SOLX00042286_P1 | 6206 | 630 | 87.6 | globlastp |
| 2288 | beet|12v1|AJ009737_P1 | 6207 | 630 | 87.4 | globlastp |
| 2289 | beech|11v1|SRR006294.12431_P1 | 6208 | 630 | 87.3 | globlastp |
| 2290 | maritime_pine|10v1|CR392997_P1 | 6209 | 630 | 87.3 | globlastp |
| 2291 | oak|10v1|SRR039734S0110825_P1 | 6210 | 630 | 87.3 | globlastp |
| 2292 | pine|10v2|AA557111_P1 | 6211 | 630 | 87.3 | globlastp |
| 2293 | pine|10v2|AW226483_P1 | 6211 | 630 | 87.3 | globlastp |
| 2294 | spruce|11v1|EX365100 | 6212 | 630 | 87.3 | globlastp |
| 2295 | spruce|11v1|SRR064180X498651 | 6212 | 630 | 87.3 | globlastp |
| 2296 | radish|gb164|EV528120 | 6213 | 630 | 87 | globlastp |
| 2297 | maritime_pine|10v1|SRR073317S0018081_T1 | 6214 | 630 | 86.94 | glotblastn |
| 2298 | abies|11v2|SRR098676X100878_P1 | 6215 | 630 | 86.9 | globlastp |
| 2299 | cedrus|11v1|SRR065007X116945_P1 | 6216 | 630 | 86.9 | globlastp |
| 2300 | cryptomeria|gb166|BW994649_P1 | 6217 | 630 | 86.9 | globlastp |
| 2301 | cucumber|09v1|EB715694_P1 | 6218 | 630 | 86.9 | globlastp |
| 2302 | eschscholzia|11v1|SRR014116.100907_P1 | 6219 | 630 | 86.9 | globlastp |
| 2303 | euonymus|11v1|SRR070038X112495_P1 | 6220 | 630 | 86.9 | globlastp |
| 2304 | melon|10v1|VMEL01698615123105_P1 | 6221 | 630 | 86.9 | globlastp |
| 2305 | momordica|10v1|SRR071315S0001316_P1 | 6222 | 630 | 86.9 | globlastp |
| 2306 | petunia|gb171|CV295494_P1 | 6223 | 630 | 86.9 | globlastp |
| 2307 | spruce|11v1|ES253826 | 6224 | 630 | 86.9 | globlastp |
| 2308 | spruce|11v1|ES867709 | 6225 | 630 | 86.9 | globlastp |
| 2309 | spruce|11v1|ES873855 | 6226 | 630 | 86.9 | globlastp |
| 2310 | spruce|11v1|EX361955 | 6224 | 630 | 86.9 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 2311 | zamia\|gb166\|DY030845 | 6227 | 630 | 86.9 | globlastp |
| 2312 | peach\|gb157.2\|BU039610_P1 | 6228 | 630 | 86.6 | globlastp |
| 2313 | oak\|10v1\|DB997678_T1 | 6229 | 630 | 86.53 | glotblastn |
| 2314 | maritime_pine\|10v1\|SRR073317S0142793_T1 | — | 630 | 86.53 | glotblastn |
| 2315 | cephalotaxus\|11v1\|SRR064395X100214_P1 | 6230 | 630 | 86.5 | globlastp |
| 2316 | chestnut\|gb170\|SRR006295S0008134_P1 | 6231 | 630 | 86.5 | globlastp |
| 2317 | cycas\|gb166\|CB088723_P1 | 6232 | 630 | 86.5 | globlastp |
| 2318 | pseudotsuga\|10v1\|SRR065119S0002809 | 6233 | 630 | 86.5 | globlastp |
| 2319 | spruce\|11v1\|CO237150 | 6234 | 630 | 86.5 | globlastp |
| 2320 | fagopyrum\|11v1\|SRR063689X102968_P1 | 6235 | 630 | 86.2 | globlastp |
| 2321 | flaveria\|11v1\|SRR149229.107405_T1 | 6236 | 630 | 86.12 | glotblastn |
| 2322 | pine\|10v2\|BX254326_T1 | 6237 | 630 | 86.12 | glotblastn |
| 2323 | cucumber\|09v1\|DV633817_P1 | 6238 | 630 | 86.1 | globlastp |
| 2324 | pine\|10v2\|GW754514_T1 | 6239 | 630 | 85.71 | glotblastn |
| 2325 | centaurea\|gb166\|EH720361 | 6240 | 630 | 85.7 | globlastp |
| 2326 | cephalotaxus\|11v1\|SRR064395X125095_P1 | 6241 | 630 | 85.7 | globlastp |
| 2327 | cirsium\|11v1\|SRR346952.1010767_P1 | 6242 | 630 | 85.7 | globlastp |
| 2328 | cynara\|gb167\|GE579606_P1 | 6243 | 630 | 85.7 | globlastp |
| 2329 | maritime_pine\|10v1\|BX254326_P1 | 6244 | 630 | 85.7 | globlastp |
| 2330 | pigeonpea\|11v1\|CCIIPG11047741_P1 | 6245 | 630 | 85.7 | globlastp |
| 2331 | plantago\|11v2\|SRR066373X110993_P1 | 6246 | 630 | 85.7 | globlastp |
| 2332 | sequoia\|10v1\|SRR065044S0000781 | 6247 | 630 | 85.7 | globlastp |
| 2333 | watermelon\|11v1\|AM713836 | 6248 | 630 | 85.6 | globlastp |
| 2334 | ambrosia\|11v1\|SRR346943.201002_T1 | 6249 | 630 | 85.31 | glotblastn |
| 2335 | sunflower\|12v1\|AJ539803 | 6250 | 630 | 85.3 | globlastp |
| 2336 | ambrosia\|11v1\|SRR346935.133099_P1 | 6251 | 630 | 84.9 | globlastp |
| 2337 | ambrosia\|11v1\|SRR346943.101825_P1 | 6252 | 630 | 84.9 | globlastp |
| 2338 | cichorium\|gb171\|EH691582_P1 | 6253 | 630 | 84.9 | globlastp |
| 2339 | gnetum\|10v1\|EX948582_P1 | 6254 | 630 | 84.9 | globlastp |
| 2340 | lettuce\|12v1\|DW060380_P1 | 6255 | 630 | 84.9 | globlastp |
| 2341 | orobanche\|10v1\|SRR023189S0001320_P1 | 6256 | 630 | 84.9 | globlastp |
| 2342 | pteridium\|11v1\|SRR043594X105316 | 6257 | 630 | 84.9 | globlastp |
| 2343 | ambrosia\|11v1\|SRR346935.107518_P1 | 6258 | 630 | 84.5 | globlastp |
| 2344 | cotton\|11v1\|BG445200_P1 | 6259 | 630 | 84.5 | globlastp |
| 2345 | pigeonpea\|11v1\|SRR054580X101723_P1 | 6260 | 630 | 84.5 | globlastp |
| 2346 | arnica\|11v1\|SRR099034X119021_T1 | 6261 | 630 | 84.49 | glotblastn |
| 2347 | ambrosia\|11v1\|SRR346943.43314_P1 | 6262 | 630 | 84.1 | globlastp |
| 2348 | cirsium\|11v1\|SRR346952.106650_P1 | 6263 | 630 | 84.1 | globlastp |
| 2349 | dandelion\|10v1\|DY819410_P1 | 6264 | 630 | 83.7 | globlastp |
| 2350 | flaveria\|11v1\|SRR149229.135585_P1 | 6265 | 630 | 83.5 | globlastp |
| 2351 | ceratodon\|10v1\|SRR074890S0022247_P1 | 6266 | 630 | 83.3 | globlastp |
| 2352 | olea\|11v1\|SRR014464.11134 | 6267 | 630 | 83.3 | globlastp |
| 2353 | physcomitrella\|10v1\|BJ174885_P1 | 6268 | 630 | 83.3 | globlastp |
| 2354 | cichorium\|gb171\|EH690915_T1 | 6269 | 630 | 83.27 | glotblastn |
| 2355 | physcomitrella\|10v1\|BJ174601_P1 | 6270 | 630 | 82.9 | globlastp |
| 2356 | radish\|gb164\|EV537845 | 6271 | 630 | 82.9 | globlastp |
| 2357 | antirrhinum\|gb166\|AJ794343_P1 | 6272 | 630 | 82.6 | globlastp |
| 2358 | millet\|10v1\|EVO454PM008575_P1 | 6273 | 630 | 82.4 | globlastp |
| 2359 | spikemoss\|gb165\|FE466723 | 6274 | 630 | 82 | globlastp |
| 2360 | poplar\|10v1\|POPTR0008S03180 | 6275 | 630 | 81.71 | glotblastn |
| 2361 | parthenium\|10v1\|GW778698_T1 | 6276 | 630 | 81.63 | glotblastn |
| 2362 | guizotia\|10v1\|GE573642_P1 | 6277 | 630 | 81.6 | globlastp |
| 2363 | fraxinus\|11v1\|SRR058827.110343_P1 | 6278 | 630 | 81.2 | globlastp |
| 2364 | spikemoss\|gb165\|FE467241 | 6279 | 630 | 81.2 | globlastp |
| 2365 | brachypodium\|12v1\|BRADI2G10857_P1 | 6280 | 630 | 80.9 | globlastp |
| 2366 | cleome_gynandra\|10v1\|SRR015532S0066348_P1 | 6281 | 630 | 80.8 | globlastp |
| 2367 | petunia\|gb171\|CV299721_P1 | 6282 | 630 | 80.4 | globlastp |
| 2368 | safflower\|gb162\|EL408052 | 6283 | 630 | 80.4 | globlastp |
| 2369 | centaurea\|11v1\|EH720361_P1 | 6284 | 630 | 80 | globlastp |
| 2370 | ambrosia\|11v1\|SRR346935.80808_P1 | 6285 | 630 | 80 | globlastp |
| 2371 | onion\|12v1\|SRR073446X111037D1_P1 | 6286 | 630 | 80 | globlastp |
| 2372 | sorghum\|12v1\|SB04G002670 | 6287 | 631 | 88.5 | globlastp |
| 2373 | maize\|10v1\|AW231612_P1 | 6288 | 631 | 85.4 | globlastp |
| 2374 | foxtail_millet\|11v3\|PHY7SI016813M_P1 | 6289 | 631 | 81.8 | globlastp |
| 2375 | sorghum\|12v1\|SB06G020170 | 6290 | 632 | 91.9 | globlastp |
| 2376 | maize\|10v1\|BE224944_P1 | 6291 | 632 | 91.7 | globlastp |
| 2377 | foxtail_millet\|11v3\|PHY7SI009805M_P1 | 6292 | 632 | 86.5 | globlastp |
| 2378 | foxtail_millet\|11v3\|SIPRD090813_T1 | 6293 | 632 | 84.86 | glotblastn |
| 2379 | switchgrass\|12v1\|FE612283_P1 | 6294 | 633 | 90.1 | globlastp |
| 2380 | brachypodium\|12v1\|BRADI1G08400_P1 | 6295 | 633 | 87.9 | globlastp |
| 2381 | rye\|12v1\|DRR001012.121069 | 6296 | 633 | 87.6 | globlastp |
| 2382 | wheat\|12v3\|CJ952926 | 6297 | 633 | 87 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 2383 | barley\|12v1\|AF406643_P1 | 6298 | 633 | 85.8 | globlastp |
| 2384 | foxtail_millet\|11v3\|PHY7SI034030M_P1 | 6299 | 633 | 83.5 | globlastp |
| 2385 | switchgrass\|12v1\|FL716316_P1 | 6300 | 640 | 81.2 | globlastp |
| 2386 | switchgrass\|gb167\|FL716316 | 6301 | 640 | 81.15 | glotblastn |
| 2387 | rice\|11v1\|BI795969 | 6302 | 641 | 81.8 | globlastp |
| 2388 | brachypodium\|12v1\|BRADI3G47800_P1 | 6303 | 643 | 93.2 | globlastp |
| 2389 | wheat\|12v3\|BQ237777 | 6304 | 643 | 92.1 | globlastp |
| 2390 | foxtail_millet\|11v3\|EC613250_P1 | 6305 | 643 | 91.5 | globlastp |
| 2391 | sorghum\|12v1\|SB04G024980 | 6306 | 643 | 90.8 | globlastp |
| 2392 | maize\|10v1\|AI612429_P1 | 6307 | 643 | 90.5 | globlastp |
| 2393 | switchgrass\|12v1\|FE647683_P1 | 6308 | 643 | 90.3 | globlastp |
| 2394 | maize\|10v1\|AI737219_P1 | 6309 | 643 | 89.4 | globlastp |
| 2395 | oil_palm\|11v1\|SRR190698.108780_P1 | 6310 | 643 | 88.3 | globlastp |
| 2396 | oil_palm\|11v1\|EL692446_P1 | 6311 | 643 | 88.1 | globlastp |
| 2397 | amborella\|12v3\|SRR038635.94614_P1 | 6312 | 643 | 87.1 | globlastp |
| 2398 | banana\|12v1\|MAGEN2012018109_P1 | 6313 | 643 | 86.2 | globlastp |
| 2399 | amorphophallus\|11v2\|SRR089351X111818_T1 | 6314 | 643 | 85.75 | glotblastn |
| 2400 | solanum_phureia\|09v1\|SPHAW737348 | 6315 | 643 | 85.5 | globlastp |
| 2401 | eucalyptus\|11v2\|CD668409_P1 | 6316 | 643 | 85.1 | globlastp |
| 2402 | tomato\|11v1\|AW737348 | 6317 | 643 | 85.1 | globlastp |
| 2403 | zostera\|10v1\|AM768454 | 6318 | 643 | 85.05 | glotblastn |
| 2404 | cotton\|11v1\|AW587510_P1 | 6319 | 643 | 85 | globlastp |
| 2405 | gossypium_raimondii\|12v1\|AW587510_P1 | 6319 | 643 | 85 | globlastp |
| 2406 | phalaenopsis\|11v1\|SRR125771.1048758_P1 | 6320 | 643 | 85 | globlastp |
| 2407 | phyla\|11v2\|SRR099035X121463_T1 | 6321 | 643 | 84.88 | glotblastn |
| 2408 | castorbean\|11v1\|EG656596 | 6322 | 643 | 84.8 | globlastp |
| 2409 | castorbean\|12v1\|EG656596_P1 | 6322 | 643 | 84.8 | globlastp |
| 2410 | cucumber\|09v1\|DV737753_P1 | 6323 | 643 | 84.8 | globlastp |
| 2411 | watermelon\|11v1\|AM732207 | 6324 | 643 | 84.8 | globlastp |
| 2412 | nicotiana_benthamiana\|12v1\|FG135243_P1 | 6325 | 643 | 84.7 | globlastp |
| 2413 | tabernaemontana\|11v1\|SRR098689X112646 | 6326 | 643 | 84.65 | glotblastn |
| 2414 | cassava\|09v1\|FF534723_P1 | 6327 | 643 | 84.6 | globlastp |
| 2415 | melon\|10v1\|AM732207_P1 | 6328 | 643 | 84.6 | globlastp |
| 2416 | ambrosia\|11v1\|SRR346935.178950_P1 | 6329 | 643 | 84.5 | globlastp |
| 2417 | nicotiana_benthamiana\|12v1\|BP751817_P1 | 6330 | 643 | 84.4 | globlastp |
| 2418 | pigeonpea\|11v1\|SRR054580X1028_P1 | 6331 | 643 | 84.4 | globlastp |
| 2419 | valeriana\|11v1\|SRR099039X113384 | 6332 | 643 | 84.2 | globlastp |
| 2420 | banana\|12v1\|ES431755_P1 | 6333 | 643 | 84.1 | globlastp |
| 2421 | bean\|12v1\|SRR001335.264127 | 6334 | 643 | 84.1 | globlastp |
| 2422 | beet\|12v1\|BQ589904_P1 | 6335 | 643 | 84.1 | globlastp |
| 2423 | oak\|10v1\|FP045293_P1 | 6336 | 643 | 84.1 | globlastp |
| 2424 | poplar\|10v1\|AI163495 | 6337 | 643 | 84.1 | globlastp |
| 2425 | poplar\|13v1\|AI163495_P1 | 6337 | 643 | 84.1 | globlastp |
| 2426 | poplar\|10v1\|DT476741 | 6338 | 643 | 84.1 | globlastp |
| 2427 | poplar\|13v1\|DT476741_P1 | 6338 | 643 | 84.1 | globlastp |
| 2428 | ambrosia\|11v1\|SRR346935.100892_P1 | 6339 | 643 | 84 | globlastp |
| 2429 | banana\|12v1\|BBS21T3_P1 | 6340 | 643 | 84 | globlastp |
| 2430 | monkeyflower\|10v1\|GR060921 | 6341 | 643 | 84 | globlastp |
| 2431 | monkeyflower\|12v1\|GR113891_P1 | 6341 | 643 | 84 | globlastp |
| 2432 | ambrosia\|11v1\|SRR346935.118239_T1 | 6342 | 643 | 83.99 | glotblastn |
| 2433 | bean\|12v2\|SRR001335.264127_P1 | 6343 | 643 | 83.9 | globlastp |
| 2434 | soybean\|12v1\|GLYMA08G13770_P1 | 6344 | 643 | 83.9 | globlastp |
| 2435 | euphorbia\|11v1\|DV133781_P1 | 6345 | 643 | 83.9 | globlastp |
| 2436 | amsonia\|11v1\|SRR098688X106392_P1 | 6346 | 643 | 83.7 | globlastp |
| 2437 | beech\|11v1\|SRR006294.24743_T1 | 6347 | 643 | 83.68 | glotblastn |
| 2438 | peanut\|10v1\|GO268027_T1 | 6348 | 643 | 83.68 | glotblastn |
| 2439 | orange\|11v1\|CB304651_P1 | 6349 | 643 | 83.6 | globlastp |
| 2440 | spurge\|gb161\|DV133781 | 6350 | 643 | 83.6 | globlastp |
| 2441 | zostera\|12v1\|SRR057351X20488D1_T1 | 6318 | 643 | 83.41 | glotblastn |
| 2442 | apple\|11v1\|CN996714_P1 | 6351 | 643 | 83.4 | globlastp |
| 2443 | poppy\|11v1\|SRR030259.109492_P1 | 6352 | 643 | 83.4 | globlastp |
| 2444 | soybean\|11v1\|GLYMA05G30630 | 6353 | 643 | 83.4 | globlastp |
| 2445 | soybean\|12v1\|GLYMA05G30630_P1 | 6353 | 643 | 83.4 | globlastp |
| 2446 | tobacco\|gb162\|GFXAM711117X1 | 6354 | 643 | 83.4 | globlastp |
| 2447 | trigonella\|11v1\|SRR066194X103705 | 6355 | 643 | 83.4 | globlastp |
| 2448 | bean\|12v2\|FG229148_P1 | 6356 | 643 | 83.2 | globlastp |
| 2449 | strawberry\|11v1\|DY667941 | 6357 | 643 | 83.2 | globlastp |
| 2450 | flaveria\|11v1\|SRR149229.109258_P1 | 6358 | 643 | 83.1 | globlastp |
| 2451 | monkeyflower\|10v1\|GR021687 | 6359 | 643 | 83 | globlastp |
| 2452 | monkeyflower\|12v1\|GR171697_P1 | 6359 | 643 | 83 | globlastp |
| 2453 | prunus_mume\|13v1\|BU048518_P1 | 6360 | 643 | 82.9 | globlastp |
| 2454 | prunus\|10v1\|BU048518 | 6360 | 643 | 82.9 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 2455 | chickpea|13v2|GR394918_P1 | 6361 | 643 | 82.8 | globlastp |
| 2456 | solanum_phureja|09v1|SPHAW217173 | 6362 | 643 | 82.8 | globlastp |
| 2457 | soybean|11v1|GLYMA08G13810 | 6363 | 643 | 82.8 | globlastp |
| 2458 | soybean|12v1|GLYMA08G13810_P1 | 6363 | 643 | 82.8 | globlastp |
| 2459 | tomato|11v1|AW217173 | 6364 | 643 | 82.8 | globlastp |
| 2460 | cirsium|11v1|SRR346952.1024359_P1 | 6365 | 643 | 82.7 | globlastp |
| 2461 | cotton|11v1|AW187180_P1 | 6366 | 643 | 82.7 | globlastp |
| 2462 | gossypium_raimondii|12v1|DT558220_P1 | 6367 | 643 | 82.7 | globlastp |
| 2463 | centaurea|11v1|EH725998_P1 | 6368 | 643 | 82.7 | globlastp |
| 2464 | apple|11v1|CN496063_P1 | 6369 | 643 | 82.5 | globlastp |
| 2465 | cassava|09v1|DB920810_P1 | 6370 | 643 | 82.5 | globlastp |
| 2466 | cotton|11v1|CO072400XX1_P1 | 6371 | 643 | 82.5 | globlastp |
| 2467 | lettuce|12v1|DW059332_P1 | 6372 | 643 | 82.4 | globlastp |
| 2468 | cephalotaxus|11v1|SRR064395X109174_T1 | 6373 | 643 | 82.24 | glotblastn |
| 2469 | pine|10v2|BX251480_P1 | 6374 | 643 | 82 | globlastp |
| 2470 | thellungiella_halophilum|11v1|BY816883 | 6375 | 643 | 81.8 | globlastp |
| 2471 | lettuce|12v1|DW050733_P1 | 6376 | 643 | 81.7 | globlastp |
| 2472 | maritime_pine|10v1|BX251480_P1 | 6377 | 643 | 81.5 | globlastp |
| 2473 | pigeonpea|11v1|SRR054580X131417_P1 | 6378 | 643 | 81.4 | globlastp |
| 2474 | arabidopsis|10v1|AT1G13180_P1 | 6379 | 643 | 81.3 | globlastp |
| 2475 | centaurea|gb166|EH715416 | 6380 | 643 | 81.3 | globlastp |
| 2476 | spruce|11v1|ES255727 | 6381 | 643 | 81.3 | globlastp |
| 2477 | arabidopsis_lyrata|09v1|JGIAL001380_P1 | 6382 | 643 | 81.1 | globlastp |
| 2478 | thellungiella_parvulum|11v1|BY816884 | 6383 | 643 | 81.1 | globlastp |
| 2479 | pseudotsuga|10v1|SRR065119S0022026 | 6384 | 643 | 81.07 | glotblastn |
| 2480 | cacao|10v1|CU541357_T1 | 6385 | 643 | 80.67 | glotblastn |
| 2481 | b_rapa|11v1|DY025861_P1 | 6386 | 643 | 80.4 | globlastp |
| 2482 | canola|11v1|EE464831_P1 | 6387 | 643 | 80.4 | globlastp |
| 2483 | canola|11v1|EE466498_P1 | 6386 | 643 | 80.4 | globlastp |
| 2484 | canola|11v1|SRR329661.125838_P1 | 6388 | 643 | 80.4 | globlastp |
| 2485 | medicago|12v1|BF638396_T1 | 6389 | 643 | 80.37 | glotblastn |
| 2486 | b_rapa|11v1|DW998855_P1 | 6390 | 643 | 80.1 | globlastp |
| 2487 | sugarcane|10v1|CA065339_P1 | 6391 | 644 | 98.2 | globlastp |
| 2488 | maize|10v1|AI948098_P1 | 6392 | 644 | 91.9 | globlastp |
| 2489 | switchgrass|12v1|FE617860_P1 | 6393 | 644 | 88.8 | globlastp |
| 2490 | foxtail_millet|11v3|EC613703_P1 | 6394 | 644 | 87.8 | globlastp |
| 2491 | switchgrass|12v1|FE647199_T1 | 6395 | 644 | 86.96 | glotblastn |
| 2492 | millet|10v1|CD726439_T1 | 6396 | 644 | 85.22 | glotblastn |
| 2493 | cynodon|10v1|ES296885_P1 | 6397 | 644 | 83.5 | globlastp |
| 2494 | lovegrass|gb167|DN482827_P1 | 6398 | 644 | 81.7 | globlastp |
| 2495 | rice|11v1|BE039995_P1 | 6399 | 644 | 81.2 | globlastp |
| 2496 | barley|12v1|BI958660_P1 | 6400 | 644 | 80.5 | globlastp |
| 2497 | maize|10v1|AI001223_P1 | 645 | 645 | 100 | globlastp |
| 2498 | cenchrus|gb166|EB656881_P1 | 6401 | 645 | 99.3 | globlastp |
| 2499 | maize|10v1|AI855312_P1 | 6402 | 645 | 99.3 | globlastp |
| 2500 | millet|10v1|CD725181_P1 | 6401 | 645 | 99.3 | globlastp |
| 2501 | millet|10v1|EVO454PM072876_P1 | 6401 | 645 | 99.3 | globlastp |
| 2502 | wheat|12v3|CA485423 | 6402 | 645 | 99.3 | globlastp |
| 2503 | foxtail_millet|11v3|PHY7SI031386M_P1 | 6403 | 645 | 98.7 | globlastp |
| 2504 | lovegrass|gb167|DN481142_P1 | 6404 | 645 | 98.7 | globlastp |
| 2505 | rice|11v1|BE039677 | 6405 | 645 | 98.7 | globlastp |
| 2506 | rice|11v1|BI794989 | 6405 | 645 | 98.7 | globlastp |
| 2507 | sugarcane|10v1|CA077917 | 6406 | 645 | 98.7 | globlastp |
| 2508 | switchgrass|gb167|DN140712 | 6407 | 645 | 98.7 | globlastp |
| 2509 | switchgrass|gb167|FE605366 | 6403 | 645 | 98.7 | globlastp |
| 2510 | switchgrass|gb167|FL716932 | 6403 | 645 | 98.7 | globlastp |
| 2511 | switchgrass|12v1|FL716932_P1 | 6403 | 645 | 98.7 | globlastp |
| 2512 | foxtail_millet|11v3|PHY7SI003223M_P1 | 6408 | 645 | 98 | globlastp |
| 2513 | sorghum|12v1|SB02G004110 | 6409 | 645 | 98 | globlastp |
| 2514 | sugarcane|10v1|CA070342 | 6410 | 645 | 98 | globlastp |
| 2515 | sugarcane|10v1|CA103755 | 6410 | 645 | 98 | globlastp |
| 2516 | switchgrass|gb167|DN146891 | 6408 | 645 | 98 | globlastp |
| 2517 | switchgrass|12v1|DN140712_P1 | 6408 | 645 | 98 | globlastp |
| 2518 | brachypodium|12v1|BRADI1G05670_P1 | 6411 | 645 | 96.7 | globlastp |
| 2519 | rice|11v1|AU031512 | 6412 | 645 | 94.7 | globlastp |
| 2520 | rice|11v1|BI797945 | 6413 | 645 | 94.7 | globlastp |
| 2521 | switchgrass|12v1|FE605366_P1 | 6414 | 645 | 94.3 | globlastp |
| 2522 | brachypodium|12v1|BRADI1G55980_P1 | 6415 | 645 | 93.4 | globlastp |
| 2523 | barley|12v1|BF621440_P1 | 6416 | 645 | 92.8 | globlastp |
| 2524 | pseudoroegneria|gb167|FF348975 | 6417 | 645 | 92.8 | globlastp |
| 2525 | rye|12v1|BE494119 | 6418 | 645 | 92.8 | globlastp |
| 2526 | rye|12v1|BG263876 | 6418 | 645 | 92.8 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 2527 | rye\|12v1\|DRR001012.105054 | 6418 | 645 | 92.8 | globlastp |
| 2528 | rye\|12v1\|DRR001012.11360 | 6418 | 645 | 92.8 | globlastp |
| 2529 | rye\|12v1\|DRR001012.175741 | 6418 | 645 | 92.8 | globlastp |
| 2530 | rye\|12v1\|DRR001012.262220 | 6418 | 645 | 92.8 | globlastp |
| 2531 | wheat\|12v3\|BE402378 | 6418 | 645 | 92.8 | globlastp |
| 2532 | lovegrass\|gb167\|EH188825_T1 | 6419 | 645 | 92.76 | glotblastn |
| 2533 | rye\|12v1\|DRR001012.405886 | 6420 | 645 | 92.76 | glotblastn |
| 2534 | rye\|12v1\|DRR001013.139413 | 6421 | 645 | 92.76 | glotblastn |
| 2535 | rye\|12v1\|DRR001015.146123 | 6422 | 645 | 92.76 | glotblastn |
| 2536 | rye\|12v1\|DRR001012.715073 | 6423 | 645 | 92.11 | glotblastn |
| 2537 | oat\|11v1\|CN816932_P1 | 6424 | 645 | 92.1 | globlastp |
| 2538 | oil_palm\|11v1\|EL930541_P1 | 6425 | 645 | 92.1 | globlastp |
| 2539 | rye\|12v1\|DRR001012.483052 | 6426 | 645 | 92.1 | globlastp |
| 2540 | maize\|10v1\|BM378337_T1 | 6427 | 645 | 91.45 | glotblastn |
| 2541 | fescue\|gb161\|DT689971_P1 | 6428 | 645 | 91.4 | globlastp |
| 2542 | ginger\|gb164\|DY359093_P1 | 6429 | 645 | 91.4 | globlastp |
| 2543 | ginger\|gb164\|DY361757_P1 | 6429 | 645 | 91.4 | globlastp |
| 2544 | oil_palm\|11v1\|EY409533_P1 | 6430 | 645 | 91.4 | globlastp |
| 2545 | phalaenopsis\|11v1\|CB031848_P1 | 6431 | 645 | 91.4 | globlastp |
| 2546 | phalaenopsis\|11v1\|SRR125771.1007801_P1 | 6432 | 645 | 91.4 | globlastp |
| 2547 | pineapple\|10v1\|CO730773_P1 | 6433 | 645 | 91.4 | globlastp |
| 2548 | poppy\|11v1\|SRR030259.107962_P1 | 6434 | 645 | 91.4 | globlastp |
| 2549 | poppy\|11v1\|SRR030259.156311_P1 | 6434 | 645 | 91.4 | globlastp |
| 2550 | poppy\|11v1\|SRR030259.236604_P1 | 6435 | 645 | 91.4 | globlastp |
| 2551 | poppy\|11v1\|SRR096789.118652_P1 | 6435 | 645 | 91.4 | globlastp |
| 2552 | cowpea\|12v1\|FF385204_P1 | 6436 | 645 | 90.8 | globlastp |
| 2553 | ipomoea_nil\|10v1\|BJ564090_P1 | 6437 | 645 | 90.8 | globlastp |
| 2554 | liriodendron\|gb166\|CK754187_P1 | 6438 | 645 | 90.8 | globlastp |
| 2555 | liriodendron\|gb166\|CK762830_P1 | 6438 | 645 | 90.8 | globlastp |
| 2556 | oat\|11v1\|GO594028_P1 | 6439 | 645 | 90.8 | globlastp |
| 2557 | peanut\|10v1\|EE127019_P1 | 6440 | 645 | 90.8 | globlastp |
| 2558 | peanut\|10v1\|ES703074_P1 | 6440 | 645 | 90.8 | globlastp |
| 2559 | platanus\|11v1\|SRR096786X109535_P1 | 6441 | 645 | 90.8 | globlastp |
| 2560 | platanus\|11v1\|SRR096786X116175_P1 | 6438 | 645 | 90.8 | globlastp |
| 2561 | platanus\|11v1\|SRR096786X144645_P1 | 6438 | 645 | 90.8 | globlastp |
| 2562 | poppy\|11v1\|FE967690_P1 | 6442 | 645 | 90.8 | globlastp |
| 2563 | phalaenopsis\|11v1\|SRR125771.1047942XX2_T1 | 6443 | 645 | 90.13 | glotblastn |
| 2564 | poppy\|11v1\|SRR030259.107504_T1 | 6444 | 645 | 90.13 | glotblastn |
| 2565 | acacia\|10v1\|FS584542_P1 | 6445 | 645 | 90.1 | globlastp |
| 2566 | amorphophallus\|11v2\|SRR089351X100616_P1 | 6446 | 645 | 90.1 | globlastp |
| 2567 | aristolochia\|10v1\|SRR039082S0062615_P1 | 6447 | 645 | 90.1 | globlastp |
| 2568 | avocado\|10v1\|CK752507_P1 | 6448 | 645 | 90.1 | globlastp |
| 2569 | beet\|12v1\|BI643078XX2_P1 | 6449 | 645 | 90.1 | globlastp |
| 2570 | beet\|12v1\|BQ488142_P1 | 6450 | 645 | 90.1 | globlastp |
| 2571 | chelidonium\|11v1\|SRR084752X107444_P1 | 6447 | 645 | 90.1 | globlastp |
| 2572 | chelidonium\|11v1\|SRR084752X109905_P1 | 6447 | 645 | 90.1 | globlastp |
| 2573 | curcuma\|10v1\|DY385986_P1 | 6451 | 645 | 90.1 | globlastp |
| 2574 | eschscholzia\|11v1\|CK744958_P1 | 6447 | 645 | 90.1 | globlastp |
| 2575 | medicago\|12v1\|AW288024_P1 | 6452 | 645 | 90.1 | globlastp |
| 2576 | papaya\|gb165\|EX262807_P1 | 6453 | 645 | 90.1 | globlastp |
| 2577 | soybean\|11v1\|GLYMA10G36610 | 6454 | 645 | 90.1 | globlastp |
| 2578 | soybean\|12v1\|GLYMA10G36610T2_P1 | 6454 | 645 | 90.1 | globlastp |
| 2579 | trigonella\|11v1\|SRR066194X101951 | 6452 | 645 | 90.1 | globlastp |
| 2580 | trigonella\|11v1\|SRR066194X113780 | 6452 | 645 | 90.1 | globlastp |
| 2581 | trigonella\|11v1\|SRR066194X152074 | 6452 | 645 | 90.1 | globlastp |
| 2582 | tripterygium\|11v1\|SRR098677X113317 | 6455 | 645 | 90.1 | globlastp |
| 2583 | rye\|12v1\|DRR001012.217772 | 6456 | 645 | 89.54 | glotblastn |
| 2584 | olea\|13v1\|SRR014463X23649D1_P1 | 6457 | 645 | 89.5 | globlastp |
| 2585 | soybean\|12v1\|AI442769_P1 | 6458 | 645 | 89.5 | globlastp |
| 2586 | apple\|11v1\|CN879688_P1 | 6459 | 645 | 89.5 | globlastp |
| 2587 | aquilegia\|10v2\|DT741994_P1 | 6460 | 645 | 89.5 | globlastp |
| 2588 | aquilegia\|10v2\|JGIAC014479_P1 | 6461 | 645 | 89.5 | globlastp |
| 2589 | banana\|12v1\|ES433189_P1 | 6462 | 645 | 89.5 | globlastp |
| 2590 | banana\|12v1\|FF558491_P1 | 6462 | 645 | 89.5 | globlastp |
| 2591 | banana\|12v1\|FL667103_P1 | 6463 | 645 | 89.5 | globlastp |
| 2592 | cacao\|10v1\|CA794237_P1 | 6464 | 645 | 89.5 | globlastp |
| 2593 | cephalotaxus\|11v1\|SRR064395X100526_P1 | 6465 | 645 | 89.5 | globlastp |
| 2594 | cephalotaxus\|11v1\|SRR064395X102184_P1 | 6465 | 645 | 89.5 | globlastp |
| 2595 | cleome_spinosa\|10v1\|SRR015531S0000734_P1 | 6466 | 645 | 89.5 | globlastp |
| 2596 | cleome_spinosa\|10v1\|SRR015531S0011141_P1 | 6466 | 645 | 89.5 | globlastp |
| 2597 | cotton\|11v1\|AI725541_P1 | 6464 | 645 | 89.5 | globlastp |
| 2598 | cotton\|11v1\|AI726016_P1 | 6464 | 645 | 89.5 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
| --- | --- | --- | --- | --- | --- |
| 2599 | cotton\|11v1\|BE054022_P1 | 6464 | 645 | 89.5 | globlastp |
| 2600 | cotton\|11v1\|BQ406421_P1 | 6464 | 645 | 89.5 | globlastp |
| 2601 | cucumber\|09v1\|BI740218_P1 | 6467 | 645 | 89.5 | globlastp |
| 2602 | cyamopsis\|10v1\|EG980456_P1 | 6468 | 645 | 89.5 | globlastp |
| 2603 | euonymus\|11v1\|SRR070038X102341_P1 | 6469 | 645 | 89.5 | globlastp |
| 2604 | euonymus\|11v1\|SRR070038X104515_P1 | 6470 | 645 | 89.5 | globlastp |
| 2605 | euphorbia\|11v1\|DV151673XX1_P1 | 6467 | 645 | 89.5 | globlastp |
| 2606 | flax\|11v1\|JG020740_P1 | 6471 | 645 | 89.5 | globlastp |
| 2607 | flax\|11v1\|JG033539_P1 | 6471 | 645 | 89.5 | globlastp |
| 2608 | fraxinus\|11v1\|SRR058827.135979_P1 | 6457 | 645 | 89.5 | globlastp |
| 2609 | fraxinus\|11v1\|SRR058827.143569_P1 | 6457 | 645 | 89.5 | globlastp |
| 2610 | fraxinus\|11v1\|SRR058827.166203_P1 | 6457 | 645 | 89.5 | globlastp |
| 2611 | gossypium_raimondii\|12v1\|AI725541_P1 | 6464 | 645 | 89.5 | globlastp |
| 2612 | gossypium_raimondii\|12v1\|AI726016_P1 | 6464 | 645 | 89.5 | globlastp |
| 2613 | gossypium_raimondii\|12v1\|BE054022_P1 | 6464 | 645 | 89.5 | globlastp |
| 2614 | gossypium_raimondii\|12v1\|BQ406421_P1 | 6464 | 645 | 89.5 | globlastp |
| 2615 | grape\|11v1\|GSVIVT01001168001_P1 | 6472 | 645 | 89.5 | globlastp |
| 2616 | grape\|11v1\|GSVIVT01017975001_P1 | 6472 | 645 | 89.5 | globlastp |
| 2617 | grape\|11v1\|GSVIVT01034582001_P1 | 6472 | 645 | 89.5 | globlastp |
| 2618 | hornbeam\|12v1\|SRR364455.104726_P1 | 6473 | 645 | 89.5 | globlastp |
| 2619 | iceplant\|gb164\|BE035960_P1 | 6474 | 645 | 89.5 | globlastp |
| 2620 | ipomoea_batatas\|10v1\|CB330101_P1 | 6475 | 645 | 89.5 | globlastp |
| 2621 | ipomoea_nil\|10v1\|CJ746229_P1 | 6475 | 645 | 89.5 | globlastp |
| 2622 | liquorice\|gb171\|FS238680_P1 | 6476 | 645 | 89.5 | globlastp |
| 2623 | liquorice\|gb171\|FS244103_P1 | 6477 | 645 | 89.5 | globlastp |
| 2624 | melon\|10v1\|DV633021_P1 | 6467 | 645 | 89.5 | globlastp |
| 2625 | melon\|10v1\|DV633197_P1 | 6467 | 645 | 89.5 | globlastp |
| 2626 | nuphar\|gb166\|DT585510_P1 | 6478 | 645 | 89.5 | globlastp |
| 2627 | oat\|11v1\|CN815803_P1 | 6479 | 645 | 89.5 | globlastp |
| 2628 | oat\|11v1\|GO590607_P1 | 6480 | 645 | 89.5 | globlastp |
| 2629 | oil_palm\|11v1\|EY410764_P1 | 6481 | 645 | 89.5 | globlastp |
| 2630 | olea\|11v1\|SRR014463.15044 | 6457 | 645 | 89.5 | globlastp |
| 2631 | olea\|13v1\|SRR014463X15044D1_P1 | 6457 | 645 | 89.5 | globlastp |
| 2632 | olea\|11v1\|SRR014463.15566 | 6457 | 645 | 89.5 | globlastp |
| 2633 | olea\|13v1\|SRR014463X15566D1_P1 | 6457 | 645 | 89.5 | globlastp |
| 2634 | phyla\|11v2\|SRR099037X192733_P1 | 6482 | 645 | 89.5 | globlastp |
| 2635 | pigeonpea\|11v1\|SRR054580X101013_P1 | 6483 | 645 | 89.5 | globlastp |
| 2636 | pigeonpea\|11v1\|SRR054580X123056_P1 | 6484 | 645 | 89.5 | globlastp |
| 2637 | platanus\|11v1\|SRR096786X101919_P1 | 6485 | 645 | 89.5 | globlastp |
| 2638 | poplar\|10v1\|CN549329 | 6486 | 645 | 89.5 | globlastp |
| 2639 | poplar\|13v1\|CN549329_P1 | 6486 | 645 | 89.5 | globlastp |
| 2640 | poppy\|11v1\|FE964611_P1 | 6487 | 645 | 89.5 | globlastp |
| 2641 | salvia\|10v1\|CV162854 | 6488 | 645 | 89.5 | globlastp |
| 2642 | soybean\|11v1\|GLYMA10G36880 | 6458 | 645 | 89.5 | globlastp |
| 2643 | soybean\|12v1\|GLYMA10G36880T2_P1 | 6458 | 645 | 89.5 | globlastp |
| 2644 | soybean\|11v1\|GLYMA20G30730 | 6489 | 645 | 89.5 | globlastp |
| 2645 | soybean\|12v1\|GLYMA20G30730_P1 | 6489 | 645 | 89.5 | globlastp |
| 2646 | soybean\|11v1\|GLYMA20G30970 | 6490 | 645 | 89.5 | globlastp |
| 2647 | soybean\|12v1\|GLYMA20G30970_P1 | 6490 | 645 | 89.5 | globlastp |
| 2648 | spurge\|gb161\|DV151673 | 6467 | 645 | 89.5 | globlastp |
| 2649 | taxus\|10v1\|SRR032523S0032389 | 6465 | 645 | 89.5 | globlastp |
| 2650 | thalictrum\|11v1\|SRR096787X110776 | 6460 | 645 | 89.5 | globlastp |
| 2651 | tomato\|11v1\|BG125191 | 6491 | 645 | 89.5 | globlastp |
| 2652 | tripterygium\|11v1\|SRR098677X103895 | 6492 | 645 | 89.5 | globlastp |
| 2653 | tripterygium\|11v1\|SRR098677X115130 | 6493 | 645 | 89.5 | globlastp |
| 2654 | valeriana\|11v1\|SRR099039X100965 | 6494 | 645 | 89.5 | globlastp |
| 2655 | watermelon\|11v1\|BI740218 | 6467 | 645 | 89.5 | globlastp |
| 2656 | zostera\|10v1\|AM767488 | 6495 | 645 | 89.5 | globlastp |
| 2657 | apple\|11v1\|CN491562_T1 | 6496 | 645 | 89.47 | glotblastn |
| 2658 | cacao\|10v1\|CF973211_T1 | 6497 | 645 | 89.47 | glotblastn |
| 2659 | phyla\|11v2\|SRR099037X100375_T1 | 6498 | 645 | 89.47 | glotblastn |
| 2660 | fraxinus\|11v1\|SRR058827.122827_T1 | 6499 | 645 | 88.82 | glotblastn |
| 2661 | primula\|11v1\|SRR098679X130115_T1 | 6500 | 645 | 88.82 | glotblastn |
| 2662 | watermelon\|11v1\|DV633021_T1 | 6501 | 645 | 88.82 | glotblastn |
| 2663 | castorbean\|12v1\|EE258293_P1 | 6502 | 645 | 88.8 | globlastp |
| 2664 | centaurea\|11v1\|SRR346940.102154_P1 | 6503 | 645 | 88.8 | globlastp |
| 2665 | peach\|gb157.2\|AJ825789_P1 | 6504 | 645 | 88.8 | globlastp |
| 2666 | peach\|gb157.2\|DY633412_P1 | 6505 | 645 | 88.8 | globlastp |
| 2667 | prunus_mume\|13v1\|BU573849_P1 | 6504 | 645 | 88.8 | globlastp |
| 2668 | prunus_mume\|13v1\|CB821568_P1 | 6505 | 645 | 88.8 | globlastp |
| 2669 | acacia\|10v1\|GR483156_P1 | 6506 | 645 | 88.8 | globlastp |
| 2670 | amborella\|12v3\|CK749271_P1 | 6507 | 645 | 88.8 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 2671 | apple\|11v1\|CN496803_P1 | 6504 | 645 | 88.8 | globlastp |
| 2672 | apple\|11v1\|CN883935_P1 | 6504 | 645 | 88.8 | globlastp |
| 2673 | aquilegia\|10v2\|JGIAC025912_P1 | 6508 | 645 | 88.8 | globlastp |
| 2674 | banana\|12v1\|FF560106_P1 | 6509 | 645 | 88.8 | globlastp |
| 2675 | basilicum\|10v1\|DY322568_P1 | 6510 | 645 | 88.8 | globlastp |
| 2676 | basilicum\|10v1\|DY335943_P1 | 6510 | 645 | 88.8 | globlastp |
| 2677 | basilicum\|10v1\|DY336014_P1 | 6511 | 645 | 88.8 | globlastp |
| 2678 | blueberry\|12v1\|CF811672_P1 | 6512 | 645 | 88.8 | globlastp |
| 2679 | cannabis\|12v1\|JK501439_P1 | 6513 | 645 | 88.8 | globlastp |
| 2680 | cassava\|09v1\|CK644351_P1 | 6514 | 645 | 88.8 | globlastp |
| 2681 | cassava\|09v1\|DV442470_P1 | 6502 | 645 | 88.8 | globlastp |
| 2682 | cassava\|09v1\|DV447662_P1 | 6514 | 645 | 88.8 | globlastp |
| 2683 | castorbean\|11v1\|EE258293 | 6502 | 645 | 88.8 | globlastp |
| 2684 | castorbean\|11v1\|T24222 | 6514 | 645 | 88.8 | globlastp |
| 2685 | castorbean\|12v1\|T24222_P1 | 6514 | 645 | 88.8 | globlastp |
| 2686 | chestnut\|gb170\|SRR006295S0000282_P1 | 6515 | 645 | 88.8 | globlastp |
| 2687 | chestnut\|gb170\|SRR006295S0001374_P1 | 6516 | 645 | 88.8 | globlastp |
| 2688 | chickpea\|11v1\|DY475120 | 6517 | 645 | 88.8 | globlastp |
| 2689 | chickpea\|11v1\|GR393585 | 6517 | 645 | 88.8 | globlastp |
| 2690 | chickpea\|13v2\|GR393585_P1 | 6517 | 645 | 88.8 | globlastp |
| 2691 | clementine\|11v1\|CF504162_P1 | 6518 | 645 | 88.8 | globlastp |
| 2692 | cleome_gynandra\|10v1\|SRR015532S0005062_P1 | 6519 | 645 | 88.8 | globlastp |
| 2693 | cleome_gynandra\|10v1\|SRR015532S0018099_P1 | 6519 | 645 | 88.8 | globlastp |
| 2694 | cleome_spinosa\|10v1\|GR932171_P1 | 6519 | 645 | 88.8 | globlastp |
| 2695 | cleome_spinosa\|10v1\|SRR015531S0026352_P1 | 6519 | 645 | 88.8 | globlastp |
| 2696 | cryptomeria\|gb166\|BP174275_P1 | 6520 | 645 | 88.8 | globlastp |
| 2697 | cryptomeria\|gb166\|BW993048_P1 | 6520 | 645 | 88.8 | globlastp |
| 2698 | cucurbita\|11v1\|SRR091276X1_P1 | 6521 | 645 | 88.8 | globlastp |
| 2699 | cyamopsis\|10v1\|EG985540_P1 | 6522 | 645 | 88.8 | globlastp |
| 2700 | distylium\|11v1\|SRR065077X118115_P1 | 6523 | 645 | 88.8 | globlastp |
| 2701 | distylium\|11v1\|SRR065077X131771_P1 | 6524 | 645 | 88.8 | globlastp |
| 2702 | eucalyptus\|11v2\|CT984581_P1 | 6525 | 645 | 88.8 | globlastp |
| 2703 | eucalyptus\|11v2\|SRR001658X117_P1 | 6525 | 645 | 88.8 | globlastp |
| 2704 | euonymus\|11v1\|SRR070038X110227_P1 | 6526 | 645 | 88.8 | globlastp |
| 2705 | euonymus\|11v1\|SRR070038X110709_P1 | 6526 | 645 | 88.8 | globlastp |
| 2706 | euonymus\|11v1\|SRR070038X128756_P1 | 6527 | 645 | 88.8 | globlastp |
| 2707 | flax\|11v1\|EU830771_P1 | 6528 | 645 | 88.8 | globlastp |
| 2708 | flax\|11v1\|JG017787_P1 | 6529 | 645 | 88.8 | globlastp |
| 2709 | flax\|11v1\|JG028441_P1 | 6528 | 645 | 88.8 | globlastp |
| 2710 | flax\|11v1\|JG032308_P1 | 6528 | 645 | 88.8 | globlastp |
| 2711 | fraxinus\|11v1\|FR638309_P1 | 6530 | 645 | 88.8 | globlastp |
| 2712 | gerbera\|09v1\|AJ751009_P1 | 6531 | 645 | 88.8 | globlastp |
| 2713 | gerbera\|09v1\|AJ755281_P1 | 6531 | 645 | 88.8 | globlastp |
| 2714 | humulus\|11v1\|EX515858_P1 | 6513 | 645 | 88.8 | globlastp |
| 2715 | ipomoea_batatas\|10v1\|CB330422_P1 | 6532 | 645 | 88.8 | globlastp |
| 2716 | kiwi\|gb166\|FG396999_P1 | 6533 | 645 | 88.8 | globlastp |
| 2717 | kiwi\|gb166\|FG420418_P1 | 6533 | 645 | 88.8 | globlastp |
| 2718 | medicago\|12v1\|AA660242_P1 | 6534 | 645 | 88.8 | globlastp |
| 2719 | medicago\|12v1\|AL373560_P1 | 6534 | 645 | 88.8 | globlastp |
| 2720 | momordica\|10v1\|SRR071315S0006027_P1 | 6535 | 645 | 88.8 | globlastp |
| 2721 | momordica\|10v1\|SRR071315S0007312_P1 | 6535 | 645 | 88.8 | globlastp |
| 2722 | nuphar\|gb166\|CK752042_P1 | 6536 | 645 | 88.8 | globlastp |
| 2723 | oak\|10v1\|DB998847_P1 | 6515 | 645 | 88.8 | globlastp |
| 2724 | oak\|10v1\|DN950342_P1 | 6516 | 645 | 88.8 | globlastp |
| 2725 | orange\|11v1\|CF504162_P1 | 6518 | 645 | 88.8 | globlastp |
| 2726 | pepper\|12v1\|BM065411_P1 | 6537 | 645 | 88.8 | globlastp |
| 2727 | physcomitrella\|10v1\|AW509599_P1 | 6538 | 645 | 88.8 | globlastp |
| 2728 | physcomitrella\|10v1\|Z98068_P1 | 6539 | 645 | 88.8 | globlastp |
| 2729 | pigeonpea\|11v1\|GR468077_P1 | 6540 | 645 | 88.8 | globlastp |
| 2730 | poplar\|10v1\|AI162815 | 6541 | 645 | 88.8 | globlastp |
| 2731 | poplar\|13v1\|AI162815_P1 | 6541 | 645 | 88.8 | globlastp |
| 2732 | poppy\|11v1\|SRR096789.220194_P1 | 6542 | 645 | 88.8 | globlastp |
| 2733 | potato\|10v1\|AJ487428_P1 | 6543 | 645 | 88.8 | globlastp |
| 2734 | prunus\|10v1\|CB819415 | 6504 | 645 | 88.8 | globlastp |
| 2735 | prunus\|10v1\|CB821568 | 6505 | 645 | 88.8 | globlastp |
| 2736 | rye\|12v1\|DRR001012.174607 | 6544 | 645 | 88.8 | globlastp |
| 2737 | salvia\|10v1\|CV165019 | 6545 | 645 | 88.8 | globlastp |
| 2738 | salvia\|10v1\|FE537147 | 6546 | 645 | 88.8 | globlastp |
| 2739 | scabiosa\|11v1\|SRR063723X108189 | 6547 | 645 | 88.8 | globlastp |
| 2740 | scabiosa\|11v1\|SRR063723X115009 | 6547 | 645 | 88.8 | globlastp |
| 2741 | sciadopitys\|10v1\|SRR065035S0007628 | 6548 | 645 | 88.8 | globlastp |
| 2742 | sequoia\|10v1\|SRR065044S0014606 | 6520 | 645 | 88.8 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 2743 | sequoia|10v1|SRR065044S0029384 | 6520 | 645 | 88.8 | globlastp |
| 2744 | silene|11v1|GH293918 | 6549 | 645 | 88.8 | globlastp |
| 2745 | silene|11v1|SRR096785X106429 | 6550 | 645 | 88.8 | globlastp |
| 2746 | solanum_phureia|09v1|SPHBG125191 | 6543 | 645 | 88.8 | globlastp |
| 2747 | soybean|11v1|GLYMA02G08690 | 6551 | 645 | 88.8 | globlastp |
| 2748 | soybean|12v1|GLYMA02G08690_P1 | 6551 | 645 | 88.8 | globlastp |
| 2749 | tomato|11v1|AA824813 | 6552 | 645 | 88.8 | globlastp |
| 2750 | valeriana|11v1|SRR099039X101660 | 6553 | 645 | 88.8 | globlastp |
| 2751 | zamia|gb166|DY030861 | 6554 | 645 | 88.8 | globlastp |
| 2752 | centaurea|11v1|EH714043_P1 | 6503 | 645 | 88.8 | globlastp |
| 2753 | bean|12v2|CA897180_P1 | 6555 | 645 | 88.2 | globlastp |
| 2754 | bean|12v2|CA903004_P1 | 6555 | 645 | 88.2 | globlastp |
| 2755 | centaurea|11v1|EH741265_P1 | 6556 | 645 | 88.2 | globlastp |
| 2756 | centaurea|11v1|EH754977_P1 | 6556 | 645 | 88.2 | globlastp |
| 2757 | centaurea|11v1|SRR346938.107178_P1 | 6556 | 645 | 88.2 | globlastp |
| 2758 | centaurea|11v1|SRR346938.395477_P1 | 6556 | 645 | 88.2 | globlastp |
| 2759 | centaurea|11v1|SRR346941.103041_P1 | 6556 | 645 | 88.2 | globlastp |
| 2760 | nicotiana_benthamiana|12v1|CN746388_P1 | 6557 | 645 | 88.2 | globlastp |
| 2761 | olea|13v1|SRR014463X19320D1_P1 | 6558 | 645 | 88.2 | globlastp |
| 2762 | ambrosia|11v1|SRR346935.540449_P1 | 6559 | 645 | 88.2 | globlastp |
| 2763 | ambrosia|11v1|SRR346943.122145_P1 | 6559 | 645 | 88.2 | globlastp |
| 2764 | ambrosia|11v1|SRR346943.126555_P1 | 6559 | 645 | 88.2 | globlastp |
| 2765 | antirrhinum|gb166|AJ558859_P1 | 6560 | 645 | 88.2 | globlastp |
| 2766 | aristolochia|10v1|SRR039083S0112943_P1 | 6561 | 645 | 88.2 | globlastp |
| 2767 | arnica|11v1|SRR099034X101529_P1 | 6556 | 645 | 88.2 | globlastp |
| 2768 | arnica|11v1|SRR099034X101893_P1 | 6556 | 645 | 88.2 | globlastp |
| 2769 | arnica|11v1|SRR099034X11492_P1 | 6559 | 645 | 88.2 | globlastp |
| 2770 | artemisia|10v1|EY032434_P1 | 6556 | 645 | 88.2 | globlastp |
| 2771 | artemisia|10v1|EY032917_P1 | 6556 | 645 | 88.2 | globlastp |
| 2772 | artemisia|10v1|EY046218_P1 | 6556 | 645 | 88.2 | globlastp |
| 2773 | bean|12v1|CA903004 | 6555 | 645 | 88.2 | globlastp |
| 2774 | beech|11v1|SRR006293.11432_P1 | 6562 | 645 | 88.2 | globlastp |
| 2775 | beech|11v1|SRR006293.485_P1 | 6562 | 645 | 88.2 | globlastp |
| 2776 | centaurea|gb166|EH714043 | 6556 | 645 | 88.2 | globlastp |
| 2777 | centaurea|11v1|EH740958_P1 | 6556 | 645 | 88.2 | globlastp |
| 2778 | centaurea|gb166|EH740958 | 6556 | 645 | 88.2 | globlastp |
| 2779 | centaurea|11v1|EH752575_P1 | 6556 | 645 | 88.2 | globlastp |
| 2780 | centaurea|gb166|EH752575 | 6556 | 645 | 88.2 | globlastp |
| 2781 | ceratodon|10v1|AW086820_P1 | 6563 | 645 | 88.2 | globlastp |
| 2782 | ceratodon|10v1|SRR074890S0031415_P1 | 6564 | 645 | 88.2 | globlastp |
| 2783 | ceratodon|10v1|SRR074890S0206507_P1 | 6564 | 645 | 88.2 | globlastp |
| 2784 | chickpea|11v1|SRR133517.201721 | 6565 | 645 | 88.2 | globlastp |
| 2785 | chickpea|13v2|SRR133517.201721_P1 | 6565 | 645 | 88.2 | globlastp |
| 2786 | cichorium|gb171|DT211776_P1 | 6556 | 645 | 88.2 | globlastp |
| 2787 | cichorium|gb171|EH698739_P1 | 6556 | 645 | 88.2 | globlastp |
| 2788 | cirsium|11v1|SRR346952.100954_P1 | 6556 | 645 | 88.2 | globlastp |
| 2789 | cirsium|11v1|SRR346952.1016079_P1 | 6556 | 645 | 88.2 | globlastp |
| 2790 | cirsium|11v1|SRR346952.1018181_P1 | 6556 | 645 | 88.2 | globlastp |
| 2791 | cirsium|11v1|SRR346952.110842_P1 | 6556 | 645 | 88.2 | globlastp |
| 2792 | cirsium|11v1|SRR346952.120716_P1 | 6556 | 645 | 88.2 | globlastp |
| 2793 | clementine|11v1|BE213468_P1 | 6566 | 645 | 88.2 | globlastp |
| 2794 | cowpea|12v1|FC460394_P1 | 6555 | 645 | 88.2 | globlastp |
| 2795 | cowpea|12v1|FF383542_P1 | 6555 | 645 | 88.2 | globlastp |
| 2796 | cucurbita|11v1|SRR091276X101659_P1 | 6567 | 645 | 88.2 | globlastp |
| 2797 | cucurbita|11v1|SRR091276X105539_P1 | 6567 | 645 | 88.2 | globlastp |
| 2798 | cycas|gb166|EX927238_P1 | 6568 | 645 | 88.2 | globlastp |
| 2799 | cycas|gb166|EX928133_P1 | 6569 | 645 | 88.2 | globlastp |
| 2800 | cynara|gb167|GE585921_P1 | 6556 | 645 | 88.2 | globlastp |
| 2801 | cynara|gb167|GE586256_P1 | 6556 | 645 | 88.2 | globlastp |
| 2802 | cynara|gb167|GE587349_P1 | 6556 | 645 | 88.2 | globlastp |
| 2803 | dandelion|10v1|DR398987_P1 | 6556 | 645 | 88.2 | globlastp |
| 2804 | dandelion|10v1|DR398999_P1 | 6556 | 645 | 88.2 | globlastp |
| 2805 | dandelion|10v1|DR399385_P1 | 6556 | 645 | 88.2 | globlastp |
| 2806 | dandelion|10v1|DY818871_P1 | 6556 | 645 | 88.2 | globlastp |
| 2807 | eggplant|10v1|FS000205_P1 | 6570 | 645 | 88.2 | globlastp |
| 2808 | eggplant|10v1|FS013827_P1 | 6571 | 645 | 88.2 | globlastp |
| 2809 | eucalyptus|11v2|CT988037_P1 | 6572 | 645 | 88.2 | globlastp |
| 2810 | euonymus|11v1|SRR070038X107398_P1 | 6573 | 645 | 88.2 | globlastp |
| 2811 | fagopyrum|11v1|SRR063689X100250_P1 | 6574 | 645 | 88.2 | globlastp |
| 2812 | fagopyrum|11v1|SRR063689X100675_P1 | 6574 | 645 | 88.2 | globlastp |
| 2813 | fagopyrum|11v1|SRR063703X118250_P1 | 6574 | 645 | 88.2 | globlastp |
| 2814 | fescue|gb161|DT690258_P1 | 6575 | 645 | 88.2 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 2815 | flaveria|11v1|SRR149229.101618_P1 | 6559 | 645 | 88.2 | globlastp |
| 2816 | flaveria|11v1|SRR149229.106611_P1 | 6559 | 645 | 88.2 | globlastp |
| 2817 | flaveria|11v1|SRR149229.116457_P1 | 6556 | 645 | 88.2 | globlastp |
| 2818 | flaveria|11v1|SRR149229.128215_P1 | 6559 | 645 | 88.2 | globlastp |
| 2819 | flaveria|11v1|SRR149229.181354_P1 | 6559 | 645 | 88.2 | globlastp |
| 2820 | flaveria|11v1|SRR149229.472800_P1 | 6559 | 645 | 88.2 | globlastp |
| 2821 | flaveria|11v1|SRR149232.100137_P1 | 6559 | 645 | 88.2 | globlastp |
| 2822 | flaveria|11v1|SRR149232.110616_P1 | 6559 | 645 | 88.2 | globlastp |
| 2823 | flaveria|11v1|SRR149232.129420_P1 | 6559 | 645 | 88.2 | globlastp |
| 2824 | flaveria|11v1|SRR149232.129867_P1 | 6559 | 645 | 88.2 | globlastp |
| 2825 | flaveria|11v1|SRR149232.158991_P1 | 6556 | 645 | 88.2 | globlastp |
| 2826 | flaveria|11v1|SRR149232.286298_P1 | 6559 | 645 | 88.2 | globlastp |
| 2827 | flaveria|11v1|SRR149241.162170_P1 | 6559 | 645 | 88.2 | globlastp |
| 2828 | flaveria|11v1|SRR149241.174618_P1 | 6559 | 645 | 88.2 | globlastp |
| 2829 | flaveria|11v1|SRR149241.370637_P1 | 6576 | 645 | 88.2 | globlastp |
| 2830 | flaveria|11v1|SRR149242.140914_P1 | 6559 | 645 | 88.2 | globlastp |
| 2831 | fraxinus|11v1|SRR058827.17920_P1 | 6558 | 645 | 88.2 | globlastp |
| 2832 | ginseng|10v1|CN847306_P1 | 6577 | 645 | 88.2 | globlastp |
| 2833 | guizotia|10v1|GE552550_P1 | 6559 | 645 | 88.2 | globlastp |
| 2834 | guizotia|10v1|GE554321_P1 | 6559 | 645 | 88.2 | globlastp |
| 2835 | guizotia|10v1|GE557968_P1 | 6559 | 645 | 88.2 | globlastp |
| 2836 | hornbeam|12v1|SRR364455.106828_P1 | 6578 | 645 | 88.2 | globlastp |
| 2837 | jatropha|09v1|GH295800_P1 | 6579 | 645 | 88.2 | globlastp |
| 2838 | kiwi|gb166|FG417957_P1 | 6580 | 645 | 88.2 | globlastp |
| 2839 | lettuce|12v1|DW046230_P1 | 6581 | 645 | 88.2 | globlastp |
| 2840 | nasturtium|11v1|GH163661_P1 | 6582 | 645 | 88.2 | globlastp |
| 2841 | orange|11v1|BE213468_P1 | 6566 | 645 | 88.2 | globlastp |
| 2842 | parthenium|10v1|GW784328_P1 | 6559 | 645 | 88.2 | globlastp |
| 2843 | parthenium|10v1|GW786047_P1 | 6559 | 645 | 88.2 | globlastp |
| 2844 | pepper|12v1|BM061831_P1 | 6583 | 645 | 88.2 | globlastp |
| 2845 | pepper|12v1|CA515799_P1 | 6584 | 645 | 88.2 | globlastp |
| 2846 | petunia|gb171|FN000831_P1 | 6557 | 645 | 88.2 | globlastp |
| 2847 | phyla|11v2|SRR099035X101639_P1 | 6585 | 645 | 88.2 | globlastp |
| 2848 | phyla|11v2|SRR099035X101664_P1 | 6586 | 645 | 88.2 | globlastp |
| 2849 | physcomitrella|10v1|AW497269_P1 | 6564 | 645 | 88.2 | globlastp |
| 2850 | physcomitrella|10v1|AW561228_P1 | 6564 | 645 | 88.2 | globlastp |
| 2851 | physcomitrella|10v1|AW599198_P1 | 6564 | 645 | 88.2 | globlastp |
| 2852 | plantago|11v2|SRR066373X114020_P1 | 6587 | 645 | 88.2 | globlastp |
| 2853 | plantago|11v2|SRR066373X134662_P1 | 6587 | 645 | 88.2 | globlastp |
| 2854 | poplar|10v1|AI163604 | 6588 | 645 | 88.2 | globlastp |
| 2855 | poplar|13v1|AI163604_P1 | 6588 | 645 | 88.2 | globlastp |
| 2856 | potato|10v1|BG098668_P1 | 6589 | 645 | 88.2 | globlastp |
| 2857 | rhizophora|10v1|SRR005792S0001046 | 6590 | 645 | 88.2 | globlastp |
| 2858 | safflower|gb162|EL374295 | 6556 | 645 | 88.2 | globlastp |
| 2859 | safflower|gb162|EL392618 | 6556 | 645 | 88.2 | globlastp |
| 2860 | sarracenia|11v1|SRR192669.106537 | 6591 | 645 | 88.2 | globlastp |
| 2861 | senecio|gb170|DY658018 | 6592 | 645 | 88.2 | globlastp |
| 2862 | sesame|12v1|BU668184 | 6593 | 645 | 88.2 | globlastp |
| 2863 | solanum_phureja|09v1|SPHAA824813 | 6594 | 645 | 88.2 | globlastp |
| 2864 | sunflower|12v1|CD847938 | 6559 | 645 | 88.2 | globlastp |
| 2865 | sunflower|12v1|CD849099 | 6559 | 645 | 88.2 | globlastp |
| 2866 | sunflower|12v1|CD850007 | 6556 | 645 | 88.2 | globlastp |
| 2867 | sunflower|12v1|CD851302 | 6559 | 645 | 88.2 | globlastp |
| 2868 | sunflower|12v1|CD851490 | 6559 | 645 | 88.2 | globlastp |
| 2869 | sunflower|12v1|CD851810 | 6559 | 645 | 88.2 | globlastp |
| 2870 | sunflower|12v1|CD857481 | 6559 | 645 | 88.2 | globlastp |
| 2871 | sunflower|12v1|CF078940 | 6556 | 645 | 88.2 | globlastp |
| 2872 | sunflower|12v1|CF079382 | 6556 | 645 | 88.2 | globlastp |
| 2873 | sunflower|12v1|CF091224 | 6559 | 645 | 88.2 | globlastp |
| 2874 | sunflower|12v1|DY908159 | 6559 | 645 | 88.2 | globlastp |
| 2875 | sunflower|12v1|DY918643 | 6559 | 645 | 88.2 | globlastp |
| 2876 | sunflower|12v1|DY920079 | 6559 | 645 | 88.2 | globlastp |
| 2877 | sunflower|12v1|DY924690 | 6559 | 645 | 88.2 | globlastp |
| 2878 | sunflower|12v1|DY957194 | 6559 | 645 | 88.2 | globlastp |
| 2879 | sunflower|12v1|EE640715 | 6559 | 645 | 88.2 | globlastp |
| 2880 | sunflower|12v1|EE650842 | 6556 | 645 | 88.2 | globlastp |
| 2881 | sunflower|12v1|SRR346950X101153 | 6559 | 645 | 88.2 | globlastp |
| 2882 | tea|10v1|CV014409 | 6595 | 645 | 88.2 | globlastp |
| 2883 | tobacco|gb162|BQ842825 | 6596 | 645 | 88.2 | globlastp |
| 2884 | tobacco|gb162|CV016244 | 6557 | 645 | 88.2 | globlastp |
| 2885 | tragopogon|10v1|SRR020205S0011374 | 6556 | 645 | 88.2 | globlastp |
| 2886 | tragopogon|10v1|SRR020205S0041653 | 6556 | 645 | 88.2 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 2887 | triphysaria\|10v1\|EX982426 | 6597 | 645 | 88.2 | globlastp |
| 2888 | nicotiana_benthamiana\|12v1\|CN743253_P1 | 6557 | 645 | 88.2 | globlastp |
| 2889 | zostera\|12v1\|AM767488_T1 | 6598 | 645 | 88.16 | glotblastn |
| 2890 | chickpea\|13v2\|DY475120_T1 | 6599 | 645 | 88.16 | glotblastn |
| 2891 | nicotiana_benthamiana\|12v1\|EB447393_P1 | 6600 | 645 | 87.5 | globlastp |
| 2892 | switchgrass\|12v1\|FL947377_T1 | 6601 | 645 | 87.5 | glotblastn |
| 2893 | ambrosia\|11v1\|SRR346935.172586_T1 | 6602 | 645 | 87.5 | glotblastn |
| 2894 | ambrosia\|11v1\|SRR346943.110825_T1 | 6602 | 645 | 87.5 | glotblastn |
| 2895 | ambrosia\|11v1\|SRR346943.134260_T1 | 6602 | 645 | 87.5 | glotblastn |
| 2896 | ambrosia\|11v1\|SRR346943.175035_T1 | 6602 | 645 | 87.5 | glotblastn |
| 2897 | avocado\|10v1\|FD504015_P1 | 6603 | 645 | 87.5 | globlastp |
| 2898 | cannabis\|12v1\|EW700987_P1 | 6604 | 645 | 87.5 | globlastp |
| 2899 | cirsium\|11v1\|SRR349641.807871_P1 | 6605 | 645 | 87.5 | globlastp |
| 2900 | cucurbita\|11v1\|SRR091276X104052_T1 | 6606 | 645 | 87.5 | glotblastn |
| 2901 | cucurbita\|11v1\|SRR091277X114272_T1 | 6607 | 645 | 87.5 | glotblastn |
| 2902 | cycas\|gb166\|CB091000_P1 | 6608 | 645 | 87.5 | globlastp |
| 2903 | eggplant\|10v1\|FS001546_P1 | 6600 | 645 | 87.5 | globlastp |
| 2904 | fagopyrum\|11v1\|SRR063689X112242_P1 | 6609 | 645 | 87.5 | globlastp |
| 2905 | flaveria\|11v1\|SRR149229.124890_P1 | 6610 | 645 | 87.5 | globlastp |
| 2906 | flaveria\|11v1\|SRR149229.144508_T1 | 6611 | 645 | 87.5 | glotblastn |
| 2907 | flaveria\|11v1\|SRR149229.211249_T1 | 6612 | 645 | 87.5 | glotblastn |
| 2908 | flaveria\|11v1\|SRR149232.233619_P1 | 6613 | 645 | 87.5 | globlastp |
| 2909 | flaveria\|11v1\|SRR149232.390430_T1 | 6614 | 645 | 87.5 | glotblastn |
| 2910 | guizotia\|10v1\|GE559342XX1_P1 | 6615 | 645 | 87.5 | globlastp |
| 2911 | humulus\|11v1\|EX515729_P1 | 6604 | 645 | 87.5 | globlastp |
| 2912 | lettuce\|12v1\|DW044998_P1 | 6616 | 645 | 87.5 | globlastp |
| 2913 | lettuce\|12v1\|DW103829_P1 | 6617 | 645 | 87.5 | globlastp |
| 2914 | lolium\|10v1\|DT672847_P1 | 6618 | 645 | 87.5 | globlastp |
| 2915 | lotus\|09v1\|BU494085_P1 | 6619 | 645 | 87.5 | globlastp |
| 2916 | marchantia\|gb166\|C95841_P1 | 6620 | 645 | 87.5 | globlastp |
| 2917 | marchantia\|gb166\|C96393_P1 | 6620 | 645 | 87.5 | globlastp |
| 2918 | monkeyflower\|10v1\|DV206181 | 6621 | 645 | 87.5 | globlastp |
| 2919 | monkeyflower\|12v1\|DV206181_P1 | 6621 | 645 | 87.5 | globlastp |
| 2920 | nasturtium\|11v1\|SRR032558.101013_P1 | 6622 | 645 | 87.5 | globlastp |
| 2921 | nicotiana_benthamiana\|12v1\|CN743096_P1 | 6623 | 645 | 87.5 | globlastp |
| 2922 | nicotiana_benthamiana\|gb162\|CN743096 | 6623 | 645 | 87.5 | globlastp |
| 2923 | nicotiana_benthamiana\|12v1\|CN744194_P1 | 6623 | 645 | 87.5 | globlastp |
| 2924 | nicotiana_benthamiana\|gb162\|CN744194 | 6623 | 645 | 87.5 | globlastp |
| 2925 | petunia\|gb171\|CV299836_P1 | 6623 | 645 | 87.5 | globlastp |
| 2926 | physcomitrella\|10v1\|AW599143_P1 | 6624 | 645 | 87.5 | globlastp |
| 2927 | podocarpus\|10v1\|SRR065014S0024080_P1 | 6625 | 645 | 87.5 | globlastp |
| 2928 | primula\|11v1\|FS229531_P1 | 6626 | 645 | 87.5 | globlastp |
| 2929 | primula\|11v1\|SRR098679X104291XX1_P1 | 6626 | 645 | 87.5 | globlastp |
| 2930 | primula\|11v1\|SRR098679X110646_P1 | 6626 | 645 | 87.5 | globlastp |
| 2931 | pteridium\|11v1\|GW574922 | 6627 | 645 | 87.5 | globlastp |
| 2932 | pteridium\|11v1\|SRR043594X117656 | 6627 | 645 | 87.5 | globlastp |
| 2933 | rose\|12v1\|BI977264 | 6628 | 645 | 87.5 | globlastp |
| 2934 | sarracenia\|11v1\|SRR192669.117714 | 6629 | 645 | 87.5 | globlastp |
| 2935 | sarracenia\|11v1\|SRR192669.129872 | 6630 | 645 | 87.5 | globlastp |
| 2936 | sciadopitys\|10v1\|SRR065035S0008606 | 6631 | 645 | 87.5 | globlastp |
| 2937 | senecio\|gb170\|CO553505 | 6632 | 645 | 87.5 | globlastp |
| 2938 | solanum_phureja\|09v1\|SPHBG123662 | 6623 | 645 | 87.5 | globlastp |
| 2939 | spikemoss\|gb165\|DN838212 | 6633 | 645 | 87.5 | globlastp |
| 2940 | spikemoss\|gb165\|FE433036 | 6633 | 645 | 87.5 | globlastp |
| 2941 | strawberry\|11v1\|CO381320 | 6628 | 645 | 87.5 | globlastp |
| 2942 | sunflower\|12v1\|BU671980 | 6634 | 645 | 87.5 | globlastp |
| 2943 | tobacco\|gb162\|CV020272 | 6600 | 645 | 87.5 | globlastp |
| 2944 | tobacco\|gb162\|DW001960 | 6623 | 645 | 87.5 | globlastp |
| 2945 | tobacco\|gb162\|EB677827 | 6600 | 645 | 87.5 | globlastp |
| 2946 | tomato\|11v1\|BG123662 | 6623 | 645 | 87.5 | globlastp |
| 2947 | tragopogon\|10v1\|SRR020205S0036982 | 6635 | 645 | 87.5 | glotblastn |
| 2948 | triphysaria\|10v1\|BM356875 | 6636 | 645 | 87.5 | globlastp |
| 2949 | triphysaria\|10v1\|EX990722 | 6636 | 645 | 87.5 | globlastp |
| 2950 | utricularia\|11v1\|SRR094438.10133 | 6637 | 645 | 87.5 | globlastp |
| 2951 | dandelion\|10v1\|DY841132_T1 | 6635 | 645 | 86.84 | glotblastn |
| 2952 | poppy\|11v1\|SRR096789.252757_T1 | 6638 | 645 | 86.84 | glotblastn |
| 2953 | primula\|11v1\|SRR098679X209502_T1 | 6639 | 645 | 86.84 | glotblastn |
| 2954 | spurge\|gb161\|BI962078 | 6640 | 645 | 86.84 | glotblastn |
| 2955 | arabidopsis_lyrata\|09v1\|BQ834079_P1 | 6641 | 645 | 86.8 | globlastp |
| 2956 | arabidopsis_lyrata\|09v1\|JGIAL003533_P1 | 6641 | 645 | 86.8 | globlastp |
| 2957 | arabidopsis_lyrata\|09v1\|JGIAL022903_P1 | 6641 | 645 | 86.8 | globlastp |
| 2958 | arabidopsis\|10v1\|AT1G22780_P1 | 6641 | 645 | 86.8 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 2959 | arabidopsis\|10v1\|AT1G34030_P1 | 6641 | 645 | 86.8 | globlastp |
| 2960 | arabidopsis\|10v1\|AT4G09800_P1 | 6641 | 645 | 86.8 | globlastp |
| 2961 | blueberry\|12v1\|CV190545_P1 | 6642 | 645 | 86.8 | globlastp |
| 2962 | blueberry\|12v1\|SRR353282X101939D1_P1 | 6642 | 645 | 86.8 | globlastp |
| 2963 | bupleurum\|11v1\|FG341930_P1 | 6643 | 645 | 86.8 | globlastp |
| 2964 | euphorbia\|11v1\|BI962078_P1 | 6644 | 645 | 86.8 | globlastp |
| 2965 | euphorbia\|11v1\|BP959355_P1 | 6645 | 645 | 86.8 | globlastp |
| 2966 | euphorbia\|11v1\|DV123555_P1 | 6646 | 645 | 86.8 | globlastp |
| 2967 | euphorbia\|11v1\|SRR098678X105620_P1 | 6646 | 645 | 86.8 | globlastp |
| 2968 | fern\|gb171\|BP911673_P1 | 6647 | 645 | 86.8 | globlastp |
| 2969 | fraxinus\|11v1\|SRR058827.100066_P1 | 6648 | 645 | 86.8 | globlastp |
| 2970 | lotus\|09v1\|LLBF177459_P1 | 6649 | 645 | 86.8 | globlastp |
| 2971 | nasturtium\|11v1\|SRR032558.108754_P1 | 6650 | 645 | 86.8 | globlastp |
| 2972 | nicotiana_benthamiana\|gb162\|CN743253 | 6651 | 645 | 86.8 | globlastp |
| 2973 | onion\|12v1\|CF439287_P1 | 6652 | 645 | 86.8 | globlastp |
| 2974 | onion\|12v1\|CF443333_P1 | 6652 | 645 | 86.8 | globlastp |
| 2975 | onion\|12v1\|SRR073446X121672D1_P1 | 6653 | 645 | 86.8 | globlastp |
| 2976 | onion\|12v1\|SRR073446X128281D1_P1 | 6653 | 645 | 86.8 | globlastp |
| 2977 | orobanche\|10v1\|SRR023189S0008126_P1 | 6654 | 645 | 86.8 | globlastp |
| 2978 | orobanche\|10v1\|SRR023189S0008932_P1 | 6655 | 645 | 86.8 | globlastp |
| 2979 | papaya\|gb165\|EX249656_P1 | 6656 | 645 | 86.8 | globlastp |
| 2980 | spurge\|gb161\|DV123555 | 6646 | 645 | 86.8 | globlastp |
| 2981 | abies\|11v2\|SRR098676X102010_P1 | 6657 | 645 | 86.2 | globlastp |
| 2982 | amsonia\|11v1\|SRR098688X101617_P1 | 6658 | 645 | 86.2 | globlastp |
| 2983 | arnica\|11v1\|SRR099034X156142_P1 | 6659 | 645 | 86.2 | globlastp |
| 2984 | cedrus\|11v1\|SRR065007X106236_P1 | 6660 | 645 | 86.2 | globlastp |
| 2985 | cedrus\|11v1\|SRR065007X155427_P1 | 6661 | 645 | 86.2 | globlastp |
| 2986 | gnetum\|10v1\|CB082487_P1 | 6662 | 645 | 86.2 | globlastp |
| 2987 | gnetum\|10v1\|DN955661_P1 | 6663 | 645 | 86.2 | globlastp |
| 2988 | guizotia\|10v1\|GE557973_P1 | 6664 | 645 | 86.2 | globlastp |
| 2989 | podocarpus\|10v1\|SRR065014S0007657_P1 | 6665 | 645 | 86.2 | globlastp |
| 2990 | spruce\|11v1\|ES248603 | 6666 | 645 | 86.2 | globlastp |
| 2991 | spruce\|11v1\|ES854557 | 6666 | 645 | 86.2 | globlastp |
| 2992 | spruce\|11v1\|EX350944 | 6666 | 645 | 86.2 | globlastp |
| 2993 | spruce\|11v1\|EX378591 | 6666 | 645 | 86.2 | globlastp |
| 2994 | spruce\|11v1\|EX409522 | 6666 | 645 | 86.2 | globlastp |
| 2995 | spruce\|11v1\|EX417022 | 6666 | 645 | 86.2 | globlastp |
| 2996 | spruce\|11v1\|SRR064180X1121 | 6667 | 645 | 86.2 | globlastp |
| 2997 | spruce\|11v1\|SRR064180X150837 | 6666 | 645 | 86.2 | globlastp |
| 2998 | strawberry\|11v1\|DY673703 | 6668 | 645 | 86.2 | globlastp |
| 2999 | flaveria\|11v1\|SRR149229.238699XX1_P1 | 6669 | 645 | 85.6 | globlastp |
| 3000 | b_juncea\|12v1\|E6ANDIZ01AKYGR_T1 | 6670 | 645 | 85.53 | glotblastn |
| 3001 | spruce\|11v1\|EX411458XX2 | 6671 | 645 | 85.53 | glotblastn |
| 3002 | canola\|11v1\|CN729814_T1 | — | 645 | 85.53 | glotblastn |
| 3003 | b_juncea\|12v1\|E6ANDIZ01A0VSM_P1 | 6672 | 645 | 85.5 | globlastp |
| 3004 | b_juncea\|12v1\|E6ANDIZ01A15S3_P1 | 6672 | 645 | 85.5 | globlastp |
| 3005 | b_juncea\|12v1\|E6ANDIZ01A3RWZ_P1 | 6672 | 645 | 85.5 | globlastp |
| 3006 | b_juncea\|12v1\|E6ANDIZ01A9USI_P1 | 6672 | 645 | 85.5 | globlastp |
| 3007 | b_juncea\|12v1\|E6ANDIZ01AKACQ_P1 | 6672 | 645 | 85.5 | globlastp |
| 3008 | b_juncea\|12v1\|E6ANDIZ01AYF0F_P1 | 6672 | 645 | 85.5 | globlastp |
| 3009 | b_juncea\|12v1\|E6ANDIZ01BZKR7_P1 | 6672 | 645 | 85.5 | globlastp |
| 3010 | b_oleracea\|gb161\|DY029753_P1 | 6672 | 645 | 85.5 | globlastp |
| 3011 | b_rapa\|11v1\|CD814622_P1 | 6672 | 645 | 85.5 | globlastp |
| 3012 | b_rapa\|11v1\|CD817700_P1 | 6672 | 645 | 85.5 | globlastp |
| 3013 | b_rapa\|11v1\|H74595_P1 | 6672 | 645 | 85.5 | globlastp |
| 3014 | b_rapa\|11v1\|L38210_P1 | 6672 | 645 | 85.5 | globlastp |
| 3015 | bruguiera\|gb166\|BP939636_P1 | 6673 | 645 | 85.5 | globlastp |
| 3016 | canola\|11v1\|CN725849_P1 | 6672 | 645 | 85.5 | globlastp |
| 3017 | canola\|11v1\|CN730875_P1 | 6672 | 645 | 85.5 | globlastp |
| 3018 | canola\|11v1\|CN735120_P1 | 6672 | 645 | 85.5 | globlastp |
| 3019 | canola\|11v1\|DW998748_P1 | 6672 | 645 | 85.5 | globlastp |
| 3020 | cirsium\|11v1\|SRR346952.42565_P1 | 6674 | 645 | 85.5 | globlastp |
| 3021 | flaveria\|11v1\|SRR149232.236591_P1 | 6675 | 645 | 85.5 | globlastp |
| 3022 | maritime_pine\|10v1\|BX665997_P1 | 6676 | 645 | 85.5 | globlastp |
| 3023 | pseudotsuga\|10v1\|SRR065119S0132532 | 6677 | 645 | 85.5 | globlastp |
| 3024 | radish\|gb164\|EV524681 | 6672 | 645 | 85.5 | globlastp |
| 3025 | radish\|gb164\|EV526891 | 6672 | 645 | 85.5 | globlastp |
| 3026 | radish\|gb164\|EV535060 | 6672 | 645 | 85.5 | globlastp |
| 3027 | radish\|gb164\|EV543584 | 6672 | 645 | 85.5 | globlastp |
| 3028 | radish\|gb164\|EV544067 | 6672 | 645 | 85.5 | globlastp |
| 3029 | radish\|gb164\|EW722251 | 6672 | 645 | 85.5 | globlastp |
| 3030 | radish\|gb164\|EX754584 | 6672 | 645 | 85.5 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 3031 | radish\|gb164\|EY904167 | 6672 | 645 | 85.5 | globlastp |
| 3032 | rose\|12v1\|EC586090 | 6678 | 645 | 85.5 | globlastp |
| 3033 | tabernaemontana\|11v1\|SRR098689X104258 | 6679 | 645 | 85.5 | globlastp |
| 3034 | thellungiella_parvulum\|11v1\|BE758566 | 6680 | 645 | 85.5 | globlastp |
| 3035 | thellungiella_parvulum\|11v1\|DN773306 | 6672 | 645 | 85.5 | globlastp |
| 3036 | vinca\|11v1\|SRR098690X108806 | 6681 | 645 | 85.5 | globlastp |
| 3037 | vinca\|11v1\|SRR098690X111525 | 6682 | 645 | 85.5 | globlastp |
| 3038 | vinca\|11v1\|SRR098690X125605 | 6683 | 645 | 85.5 | globlastp |
| 3039 | amsonia\|11v1\|SRR098688X108922_P1 | 6684 | 645 | 84.9 | globlastp |
| 3040 | b_oleracea\|gb161\|DY025873_P1 | 6685 | 645 | 84.9 | globlastp |
| 3041 | bupleurum\|11v1\|SRR301254.12342_P1 | 6686 | 645 | 84.9 | globlastp |
| 3042 | canola\|11v1\|CN730635_P1 | 6685 | 645 | 84.9 | globlastp |
| 3043 | coffea\|10v1\|DV672412_P1 | 6687 | 645 | 84.9 | globlastp |
| 3044 | maritime_pine\|10v1\|BX249306_P1 | 6688 | 645 | 84.9 | globlastp |
| 3045 | onion\|12v1\|CF450522_P1 | 6689 | 645 | 84.9 | globlastp |
| 3046 | pine\|10v2\|AA556384_P1 | 6690 | 645 | 84.9 | globlastp |
| 3047 | pine\|10v2\|AW010012_P1 | 6688 | 645 | 84.9 | globlastp |
| 3048 | sunflower\|12v1\|DY956676 | 6691 | 645 | 84.9 | globlastp |
| 3049 | tabernaemontana\|11v1\|SRR098689X108058 | 6692 | 645 | 84.9 | globlastp |
| 3050 | zinnia\|gb171\|AU286978 | 6693 | 645 | 84.9 | globlastp |
| 3051 | rye\|12v1\|DRR001012.334772 | 6694 | 645 | 84.87 | glotblastn |
| 3052 | zostera\|12v1\|SRR057351X398302D1_T1 | 6695 | 645 | 84.52 | glotblastn |
| 3053 | nuphar\|gb166\|CD474613_P1 | 6696 | 645 | 84.5 | globlastp |
| 3054 | blueberry\|12v1\|SRR353282X21198D1_T1 | 6697 | 645 | 84.42 | glotblastn |
| 3055 | tripterygium\|11v1\|SRR098677X236892 | 6698 | 645 | 84.21 | glotblastn |
| 3056 | spruce\|11v1\|ES246342XX1 | 6699 | 645 | 84.2 | globlastp |
| 3057 | spruce\|11v1\|EX330372XX1 | 6699 | 645 | 84.2 | globlastp |
| 3058 | spruce\|11v1\|EX359965 | 6699 | 645 | 84.2 | globlastp |
| 3059 | spruce\|11v1\|EX393202 | 6699 | 645 | 84.2 | globlastp |
| 3060 | spruce\|11v1\|GW728789XX2 | 6699 | 645 | 84.2 | globlastp |
| 3061 | thellungiella_halophilum\|11v1\|BE758566 | 6700 | 645 | 84.2 | globlastp |
| 3062 | thellungiella_halophilum\|11v1\|DN773306 | 6700 | 645 | 84.2 | globlastp |
| 3063 | jatropha\|09v1\|GO246712_P1 | 6701 | 645 | 84.1 | globlastp |
| 3064 | abies\|11v2\|SRR098676X116044_P1 | 6702 | 645 | 83.6 | globlastp |
| 3065 | catharanthus\|11v1\|EG560500_P1 | 6703 | 645 | 83.6 | globlastp |
| 3066 | pseudotsuga\|10v1\|SRR065119S0004272 | 6704 | 645 | 83.6 | globlastp |
| 3067 | sesame\|12v1\|BU668443 | 6705 | 645 | 83.6 | globlastp |
| 3068 | onion\|12v1\|SRR073446X105670D1_T1 | — | 645 | 83.55 | glotblastn |
| 3069 | cotton\|11v1\|BM360106_P1 | 6706 | 645 | 82.9 | globlastp |
| 3070 | mesostigma\|gb166\|DN254443_P1 | 6707 | 645 | 82.9 | globlastp |
| 3071 | mesostigma\|gb166\|EC726940_P1 | 6707 | 645 | 82.9 | globlastp |
| 3072 | rye\|12v1\|DRR001012.104533 | 6708 | 645 | 82.89 | glotblastn |
| 3073 | clover\|gb162\|BB909024_P1 | 6709 | 645 | 82.2 | globlastp |
| 3074 | euphorbia\|11v1\|DV115835_P1 | 6710 | 645 | 82.2 | globlastp |
| 3075 | taxus\|10v1\|SRR065067S0068476 | 6711 | 645 | 81 | globlastp |
| 3076 | arnica\|11v1\|SRR099034X109741_T1 | 6712 | 645 | 80.24 | glotblastn |
| 3077 | sugarcane\|10v1\|CA084616 | 6713 | 646 | 97.6 | globlastp |
| 3078 | maize\|10v1\|BG320850_P1 | 6714 | 646 | 95.6 | globlastp |
| 3079 | cynodon\|10v1\|ES297594_P1 | 6715 | 646 | 92.2 | globlastp |
| 3080 | switchgrass\|12v1\|FE655376_P1 | 6716 | 646 | 91.7 | globlastp |
| 3081 | switchgrass\|gb167\|FE655376 | 6716 | 646 | 91.7 | globlastp |
| 3082 | millet\|10v1\|EVO454PM004269_P1 | 6717 | 646 | 91.3 | globlastp |
| 3083 | foxtail_millet\|11v3\|PHY7SI036909M_P1 | 6718 | 646 | 90.8 | globlastp |
| 3084 | switchgrass\|gb167\|FE626525 | 6719 | 646 | 90.3 | globlastp |
| 3085 | switchgrass\|12v1\|FE626525_P1 | 6719 | 646 | 90.3 | globlastp |
| 3086 | oat\|11v1\|GO597382_P1 | 6720 | 646 | 86.9 | globlastp |
| 3087 | rye\|12v1\|DRR001012.143939 | 6721 | 646 | 86.9 | globlastp |
| 3088 | pseudoroegneria\|gb167\|FF340390 | 6722 | 646 | 86.4 | globlastp |
| 3089 | rye\|12v1\|DRR001012.114293 | 6723 | 646 | 86.4 | globlastp |
| 3090 | rye\|12v1\|DRR001013.157386 | 6724 | 646 | 85.9 | globlastp |
| 3091 | wheat\|12v3\|CA620038 | 6725 | 646 | 85.1 | globlastp |
| 3092 | rice\|11v1\|AT003489 | 6726 | 646 | 85 | globlastp |
| 3093 | barley\|12v1\|BF259164_P1 | 6727 | 646 | 84.5 | globlastp |
| 3094 | maize\|10v1\|CF650019_P1 | 6728 | 649 | 87.3 | globlastp |
| 3095 | maize\|10v1\|CF624028_P1 | 6729 | 650 | 87.6 | globlastp |
| 3096 | switchgrass\|12v1\|FL738039_P1 | 6730 | 650 | 84.8 | globlastp |
| 3097 | switchgrass\|gb167\|FL738039 | 6730 | 650 | 84.8 | globlastp |
| 3098 | foxtail_millet\|11v3\|PHY7SI031461M_P1 | 6731 | 650 | 82.8 | globlastp |
| 3099 | switchgrass\|12v1\|SRRI87769.1032533_P1 | 6732 | 650 | 82.1 | globlastp |
| 3100 | sugarcane\|10v1\|AA577651 | 6733 | 651 | 99.3 | globlastp |
| 3101 | maize\|10v1\|AI941968_P1 | 6734 | 651 | 98.9 | globlastp |
| 3102 | maize\|10v1\|BE453848_P1 | 6735 | 651 | 98.9 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 3103 | switchgrass\|gb167\|DN151885 | 6736 | 651 | 98.4 | globlastp |
| 3104 | foxtail_millet\|11v3\|PHY7SI001486M_P1 | 6737 | 651 | 97.9 | globlastp |
| 3105 | rice\|11v1\|BI806761 | 6738 | 651 | 97.7 | globlastp |
| 3106 | barley\|12v1\|BE412764_P1 | 6739 | 651 | 96.8 | globlastp |
| 3107 | oat\|11v1\|GO598315_P1 | 6740 | 651 | 96.8 | globlastp |
| 3108 | rye\|12v1\|DRR001012.116086 | 6739 | 651 | 96.8 | globlastp |
| 3109 | wheat\|12v3\|BI479831 | 6739 | 651 | 96.8 | globlastp |
| 3110 | brachypodium\|12v1\|BRADI2G10780_P1 | 6741 | 651 | 95.2 | globlastp |
| 3111 | cacao\|10v1\|CU477674_P1 | 6742 | 651 | 93.6 | globlastp |
| 3112 | castorbean\|12v1\|T14894_P1 | 6743 | 651 | 93.6 | globlastp |
| 3113 | clementine\|11v1\|CB291402_P1 | 6744 | 651 | 93.4 | globlastp |
| 3114 | poplar\|10v1\|BI125925 | 6745 | 651 | 93.4 | globlastp |
| 3115 | poplar\|13v1\|BI125925_P1 | 6745 | 651 | 93.4 | globlastp |
| 3116 | poplar\|10v1\|BU876008 | 6746 | 651 | 93.4 | globlastp |
| 3117 | poplar\|13v1\|BU876008_P1 | 6746 | 651 | 93.4 | globlastp |
| 3118 | prunus_mume\|13v1\|DY640313_P1 | 6747 | 651 | 93.2 | globlastp |
| 3119 | cotton\|11v1\|BG442148_P1 | 6748 | 651 | 93.2 | globlastp |
| 3120 | euphorbia\|11v1\|DV127470_P1 | 6749 | 651 | 93.2 | globlastp |
| 3121 | gossypium_raimondii\|12v1\|BG442148_P1 | 6748 | 651 | 93.2 | globlastp |
| 3122 | prunus\|10v1\|CN490622 | 6747 | 651 | 93.2 | globlastp |
| 3123 | grape\|11v1\|GSVIVT01025835001_P1 | 6750 | 651 | 92.9 | globlastp |
| 3124 | oil_palm\|11v1\|EY399362_P1 | 6751 | 651 | 92.9 | globlastp |
| 3125 | euonymus\|11v1\|SRR070038X10706_T1 | 6752 | 651 | 92.71 | glotblastn |
| 3126 | cotton\|11v1\|AI054691_P1 | 6753 | 651 | 92.7 | globlastp |
| 3127 | eucalyptus\|11v2\|AJ627799_P1 | 6754 | 651 | 92.7 | globlastp |
| 3128 | euonymus\|11v1\|SRR070038X109231_P1 | 6755 | 651 | 92.7 | globlastp |
| 3129 | nicotiana_benthamiana\|12v1\|EH623971_P1 | 6756 | 651 | 92.5 | globlastp |
| 3130 | amsonia\|11v1\|SRR098688X111941_P1 | 6757 | 651 | 92.5 | globlastp |
| 3131 | aristolochia\|10v1\|SRR039082S0015442_P1 | 6758 | 651 | 92.5 | globlastp |
| 3132 | monkeyflower\|10v1\|GR128396 | 6759 | 651 | 92.5 | globlastp |
| 3133 | monkeyflower\|12v1\|GR168616_P1 | 6759 | 651 | 92.5 | globlastp |
| 3134 | triphysaria\|10v1\|DR175197 | 6760 | 651 | 92.5 | globlastp |
| 3135 | phyla\|11v2\|SRR099037X112853_T1 | 6761 | 651 | 92.48 | glotblastn |
| 3136 | bean\|12v2\|CA898807_P1 | 6762 | 651 | 92.3 | globlastp |
| 3137 | nicotiana_benthamiana\|12v1\|EB428932_P1 | 6763 | 651 | 92.3 | globlastp |
| 3138 | ambrosia\|11v1\|SRR346935.110308_P1 | 6764 | 651 | 92.3 | globlastp |
| 3139 | ambrosia\|11v1\|SRR346935.164783_P1 | 6764 | 651 | 92.3 | globlastp |
| 3140 | banana\|12v1\|BBS742T3_P1 | 6765 | 651 | 92.3 | globlastp |
| 3141 | watermelon\|11v1\|AB029113 | 6766 | 651 | 92.3 | globlastp |
| 3142 | cucurbita\|11v1\|SRR091276X104159_P1 | 6767 | 651 | 92 | globlastp |
| 3143 | cassava\|09v1\|JGICASSAVA30380VALIDM1_P1 | 6768 | 651 | 91.8 | globlastp |
| 3144 | centaurea\|11v1\|EH717370_P1 | 6769 | 651 | 91.8 | globlastp |
| 3145 | centaurea\|gb166\|EH717370 | 6769 | 651 | 91.8 | globlastp |
| 3146 | cirsium\|11v1\|SRR346952.1001071_P1 | 6769 | 651 | 91.8 | globlastp |
| 3147 | cirsium\|11v1\|SRR346952.102960_P1 | 6770 | 651 | 91.8 | globlastp |
| 3148 | soybean\|11v1\|GLYMA03G00670 | 6771 | 651 | 91.8 | globlastp |
| 3149 | soybean\|12v1\|GLYMA03G00670_P1 | 6771 | 651 | 91.8 | globlastp |
| 3150 | sunflower\|12v1\|CD855006 | 6772 | 651 | 91.8 | globlastp |
| 3151 | olea\|13v1\|SRR014463X47856D1_P1 | 6773 | 651 | 91.6 | globlastp |
| 3152 | cichorium\|gb171\|DT213455_P1 | 6774 | 651 | 91.6 | globlastp |
| 3153 | flaveria\|11v1\|SRR149229.125719_P1 | 6775 | 651 | 91.6 | globlastp |
| 3154 | gossypium_raimondii\|12v1\|AI054691_P1 | 6776 | 651 | 91.6 | globlastp |
| 3155 | lettuce\|12v1\|DW058405_P1 | 6774 | 651 | 91.6 | globlastp |
| 3156 | pigeonpea\|11v1\|SRR054580X100816_P1 | 6777 | 651 | 91.6 | globlastp |
| 3157 | plantago\|11v2\|SRR066373X104231_P1 | 6778 | 651 | 91.6 | globlastp |
| 3158 | peanut\|10v1\|ES709894_T1 | 6779 | 651 | 91.57 | glotblastn |
| 3159 | flaveria\|11v1\|SRR149232.106043_T1 | 6780 | 651 | 91.34 | glotblastn |
| 3160 | soybean\|11v1\|GLYMA19G30100 | 6781 | 651 | 91.3 | globlastp |
| 3161 | soybean\|12v1\|GLYMA19G30100P1_P1 | 6781 | 651 | 91.3 | globlastp |
| 3162 | amborella\|12v3\|FD427212_P1 | 6782 | 651 | 91.1 | globlastp |
| 3163 | cassava\|09v1\|DV453089_P1 | 6783 | 651 | 91.1 | globlastp |
| 3164 | chestnut\|gb170\|SRR006295S0001803_P1 | 6784 | 651 | 91.1 | globlastp |
| 3165 | chickpea\|11v1\|SRR133517.102503 | 6785 | 651 | 91.1 | globlastp |
| 3166 | chickpea\|13v2\|SRR133517.102503_P1 | 6785 | 651 | 91.1 | globlastp |
| 3167 | oak\|10v1\|CU657187_P1 | 6784 | 651 | 91.1 | globlastp |
| 3168 | trigonella\|11v1\|SRR066194X138797 | 6786 | 651 | 91.1 | globlastp |
| 3169 | vinca\|11v1\|SRR098690X117502 | 6787 | 651 | 91.1 | globlastp |
| 3170 | potato\|10v1\|BF460323_P1 | 6788 | 651 | 90.9 | globlastp |
| 3171 | pseudotsuga\|10v1\|SRR065119S0025090 | 6789 | 651 | 90.9 | globlastp |
| 3172 | spruce\|11v1\|ES857077 | 6790 | 651 | 90.9 | globlastp |
| 3173 | tomato\|11v1\|BG133951 | 6791 | 651 | 90.9 | globlastp |
| 3174 | arnica\|11v1\|SRR099034X115269_T1 | 6792 | 651 | 90.89 | glotblastn |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 3175 | maritime_pine\|10v1\|AL750764_T1 | 6793 | 651 | 90.89 | glotblastn |
| 3176 | ambrosia\|11v1\|SRR346935.203357_P1 | 6794 | 651 | 90.7 | globlastp |
| 3177 | medicago\|12v1\|AL369598_P1 | 6795 | 651 | 90.7 | globlastp |
| 3178 | tripterygium\|11v1\|SRR098677X134816 | 6796 | 651 | 90.7 | globlastp |
| 3179 | valeriana\|11v1\|SRR099039X115968 | 6797 | 651 | 90.7 | globlastp |
| 3180 | abies\|11v2\|SRR098676X126999_T1 | 6798 | 651 | 90.66 | glotblastn |
| 3181 | poppy\|11v1\|SRR030259.100563_P1 | 6799 | 651 | 90.5 | globlastp |
| 3182 | onion\|12v1\|CF439443_P1 | 6800 | 651 | 90.4 | globlastp |
| 3183 | solanum_phureja\|09v1\|SPHBG133951 | 6801 | 651 | 90.4 | globlastp |
| 3184 | tomato\|11v1\|BG125980 | 6802 | 651 | 90.4 | globlastp |
| 3185 | vinca\|11v1\|SRR098690X102427 | 6803 | 651 | 90.4 | globlastp |
| 3186 | pine\|10v2\|AW064639_T1 | 6804 | 651 | 90.21 | glotblastn |
| 3187 | artemisia\|10v1\|GW330237_P1 | 6805 | 651 | 90.2 | globlastp |
| 3188 | millet\|10v1\|CD726085_P1 | 6806 | 651 | 90.2 | globlastp |
| 3189 | oak\|10v1\|CU656491_P1 | 6807 | 651 | 90.2 | globlastp |
| 3190 | solanum_phureja\|09v1\|SPHBG125980 | 6808 | 651 | 90.2 | globlastp |
| 3191 | phalaenopsis\|11v1\|CB033277XX1_T1 | 6809 | 651 | 90 | glotblastn |
| 3192 | strawberry\|11v1\|SRR034865S0022554 | 6810 | 651 | 90 | globlastp |
| 3193 | plantago\|11v2\|SRR066373X121450_T1 | 6811 | 651 | 89.98 | glotblastn |
| 3194 | sunflower\|12v1\|CD854950 | 6812 | 651 | 89.7 | globlastp |
| 3195 | aquilegia\|10v2\|DR926014_P1 | 6813 | 651 | 89.3 | globlastp |
| 3196 | silene\|11v1\|SRR096785X151884 | 6814 | 651 | 89.3 | globlastp |
| 3197 | soybean\|11v1\|GLYMA05G14170 | 6815 | 651 | 89.3 | globlastp |
| 3198 | soybean\|12v1\|GLYMA05G14170_P1 | 6815 | 651 | 89.3 | globlastp |
| 3199 | cephalotaxus\|11v1\|SRR064395X106738_P1 | 6816 | 651 | 89.1 | globlastp |
| 3200 | blueberry\|12v1\|SRR353282X16584D1_T1 | 6817 | 651 | 89.07 | glotblastn |
| 3201 | soybean\|11v1\|GLYMA19G17660 | 6818 | 651 | 88.8 | globlastp |
| 3202 | soybean\|12v1\|GLYMA19G17660_P1 | 6818 | 651 | 88.8 | globlastp |
| 3203 | solanum_phureja\|09v1\|SPHBQ518988 | 6819 | 651 | 88.6 | globlastp |
| 3204 | tomato\|11v1\|BQ518988 | 6820 | 651 | 88.4 | globlastp |
| 3205 | podocarpus\|10v1\|SRR065014S0020450_T1 | 6821 | 651 | 87.93 | glotblastn |
| 3206 | beech\|11v1\|SRR006293.18332_P1 | 6822 | 651 | 87.5 | globlastp |
| 3207 | pseudoroegneria\|gb167\|FF343185 | 6823 | 651 | 87.2 | globlastp |
| 3208 | ceratodon\|10v1\|SRR074890S0017271_P1 | 6824 | 651 | 87 | globlastp |
| 3209 | orange\|11v1\|CB291402_P1 | 6825 | 651 | 87 | globlastp |
| 3210 | spikemoss\|gb165\|FE459932 | 6826 | 651 | 87 | globlastp |
| 3211 | gnetum\|10v1\|SRR064399S0002380_P1 | 6827 | 651 | 86.8 | globlastp |
| 3212 | physcomitrella\|10v1\|BJ948943_P1 | 6828 | 651 | 86.8 | globlastp |
| 3213 | physcomitrella\|10v1\|BY951095_P1 | 6829 | 651 | 86.6 | globlastp |
| 3214 | sesame\|12v1\|SRR197996S268919 | 6830 | 651 | 86.6 | globlastp |
| 3215 | physcomitrella\|10v1\|BY959963_P1 | 6831 | 651 | 86.3 | globlastp |
| 3216 | safflower\|gb162\|EL373776 | 6832 | 651 | 86.3 | globlastp |
| 3217 | thellungiella_halophilum\|11v1\|DN776355 | 6833 | 651 | 85.4 | globlastp |
| 3218 | switchgrass\|12v1\|DN151885_P1 | 6834 | 651 | 84.7 | globlastp |
| 3219 | centaurea\|11v1\|EH755352_P1 | 6835 | 651 | 84.3 | globlastp |
| 3220 | arabidopsis_lyrata\|09v1\|JGIAL013630_P1 | 6836 | 651 | 84.3 | globlastp |
| 3221 | canola\|11v1\|DR697811_P1 | 6837 | 651 | 84.3 | globlastp |
| 3222 | pteridium\|11v1\|SRR043594X105728 | 6838 | 651 | 84.3 | globlastp |
| 3223 | radish\|gb164\|EV525450 | 6839 | 651 | 84.3 | globlastp |
| 3224 | thellungiella_parvulum\|11v1\|DN776355 | 6840 | 651 | 84.3 | globlastp |
| 3225 | b_juncea\|12v1\|E6ANDIZ01A2O2F_P1 | 6841 | 651 | 84.1 | globlastp |
| 3226 | b_rapa\|11v1\|CD836540_P1 | 6842 | 651 | 84.1 | globlastp |
| 3227 | arabidopsis\|10v1\|AT2G26990_P1 | 6843 | 651 | 83.8 | globlastp |
| 3228 | b_rapa\|11v1\|BQ791498_P1 | 6844 | 651 | 83.8 | globlastp |
| 3229 | canola\|11v1\|EE405876_P1 | 6844 | 651 | 83.8 | globlastp |
| 3230 | zostera\|10v1\|SRR057351S0016657 | 6845 | 651 | 83.48 | glotblastn |
| 3231 | zostera\|12v1\|SRR057351X16656D1_P1 | 6846 | 651 | 83.4 | globlastp |
| 3232 | canola\|11v1\|CN829705_P1 | 6847 | 651 | 82.9 | globlastp |
| 3233 | apple\|11v1\|CN903733_T1 | 6848 | 651 | 82.77 | glotblastn |
| 3234 | pine\|10v2\|DR181028_P1 | 6849 | 651 | 82.3 | globlastp |
| 3235 | b_juncea\|12v1\|E6ANDIZ01BK6Y2_P1 | 6850 | 651 | 82.2 | globlastp |
| 3236 | canola\|11v1\|ES956907_P1 | 6851 | 651 | 82.2 | globlastp |
| 3237 | phyla\|11v2\|SRR099035X113355_P1 | 6852 | 651 | 81.8 | globlastp |
| 3238 | maize\|10v1\|AI396488_P1 | 6853 | 652 | 95.1 | globlastp |
| 3239 | foxtail_millet\|11v3\|EC613545_P1 | 6854 | 652 | 91.5 | globlastp |
| 3240 | switchgrass\|12v1\|FL722154_P1 | 6855 | 652 | 91.4 | globlastp |
| 3241 | millet\|10v1\|EVO454PM005730_P1 | 6856 | 652 | 88.2 | globlastp |
| 3242 | rice\|11v1\|AU056143_P1 | 6857 | 652 | 84.4 | globlastp |
| 3243 | brachypodium\|12v1\|BRADI2G11490_P1 | 6858 | 652 | 81.3 | globlastp |
| 3244 | maize\|10v1\|CO521347_P1 | 6859 | 653 | 86.9 | globlastp |
| 3245 | maize\|10v1\|GRMZM2G013481T01_P1 | 6860 | 653 | 82.7 | globlastp |
| 3246 | foxtail_millet\|11v3\|PHY7SI001170M_P1 | 6861 | 653 | 81.7 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 3247 | switchgrass\|gb167\|FE597776 | 6862 | 653 | 81.7 | globlastp |
| 3248 | sugarcane\|10v1\|CA076988 | 6863 | 654 | 94.3 | globlastp |
| 3249 | switchgrass\|gb167\|DN143458 | 6864 | 654 | 87.3 | globlastp |
| 3250 | switchgrass\|gb167\|FL790768 | 6865 | 654 | 87.3 | globlastp |
| 3251 | switchgrass\|12v1\|DN143458_P1 | 6864 | 654 | 87.3 | globlastp |
| 3252 | maize\|10v1\|AI637145_P1 | 6866 | 654 | 86.9 | globlastp |
| 3253 | foxtail_millet\|11v3\|PHY7SI010718M_P1 | 6867 | 654 | 86.1 | globlastp |
| 3254 | millet\|10v1\|EVO454PM013400_P1 | 6868 | 654 | 80.9 | globlastp |
| 3255 | sugarcane\|10v1\|CA110549 | 6869 | 655 | 98.7 | globlastp |
| 3256 | switchgrass\|12v1\|FL936357_P1 | 6870 | 655 | 96.2 | globlastp |
| 3257 | maize\|10v1\|CF627898_P1 | 6871 | 655 | 93.8 | globlastp |
| 3258 | cynodon\|10v1\|ES298778_P1 | 6872 | 655 | 93.7 | globlastp |
| 3259 | sugarcane\|10v1\|CA116416 | 6873 | 655 | 93.7 | globlastp |
| 3260 | switchgrass\|12v1\|FE602476_P1 | 6874 | 655 | 92.8 | globlastp |
| 3261 | switchgrass\|gb167\|FE602476 | 6874 | 655 | 92.8 | globlastp |
| 3262 | millet\|10v1\|PMSLX0015697D1_P1 | 6875 | 655 | 92.4 | globlastp |
| 3263 | sorghum\|12v1\|SB03G001890 | 6876 | 655 | 92.4 | globlastp |
| 3264 | wheat\|12v3\|CA486543 | 6876 | 655 | 92.4 | globlastp |
| 3265 | maize\|10v1\|BG267487_P1 | 6877 | 655 | 91.1 | globlastp |
| 3266 | foxtail_millet\|11v3\|PHY7SI003590M_P1 | 6878 | 655 | 89.9 | globlastp |
| 3267 | sugarcane\|10v1\|CA300742 | 6879 | 655 | 88.61 | glotblastn |
| 3268 | switchgrass\|12v1\|FL770757_P1 | 6880 | 655 | 88.6 | globlastp |
| 3269 | switchgrass\|12v1\|DN144939_P1 | 6880 | 655 | 88.6 | globlastp |
| 3270 | switchgrass\|gb167\|DN144939 | 6880 | 655 | 88.6 | globlastp |
| 3271 | switchgrass\|12v1\|FL935819_P1 | 6880 | 655 | 88.6 | globlastp |
| 3272 | switchgrass\|gb167\|FL770757 | 6880 | 655 | 88.6 | globlastp |
| 3273 | rice\|11v1\|BX898318 | 6881 | 655 | 88.5 | globlastp |
| 3274 | foxtail_millet\|11v3\|SICRP041315_P1 | 6882 | 655 | 87.7 | globlastp |
| 3275 | rice\|11v1\|BM038666 | 6883 | 655 | 87.3 | globlastp |
| 3276 | barley\|12v1\|BE193278_P1 | 6884 | 655 | 84.7 | globlastp |
| 3277 | rye\|12v1\|DRR001012.106228 | 6885 | 655 | 84.7 | globlastp |
| 3278 | wheat\|12v3\|BE401123 | 6886 | 655 | 84.7 | globlastp |
| 3279 | oat\|11v1\|SRR020741.357758_T1 | 6887 | 655 | 81.61 | glotblastn |
| 3280 | brachypodium\|12v1\|BRADI2G06930_P1 | 6888 | 655 | 80.5 | globlastp |
| 3281 | sugarcane\|10v1\|CA154279 | 6889 | 656 | 82.2 | globlastp |
| 3282 | sugarcane\|10v1\|CA065678 | 6890 | 657 | 97 | globlastp |
| 3283 | maize\|10v1\|AI932203_P1 | 6891 | 657 | 96.7 | globlastp |
| 3284 | foxtail_millet\|11v3\|EC611910_T1 | 6892 | 657 | 92.7 | glotblastn |
| 3285 | switchgrass\|gb167\|DN150553 | 6893 | 657 | 92.3 | globlastp |
| 3286 | switchgrass\|12v1\|DN150553_P1 | 6894 | 657 | 92 | globlastp |
| 3287 | millet\|10v1\|EVO454PM011444_P1 | 6895 | 657 | 91.8 | globlastp |
| 3288 | switchgrass\|12v1\|DN151303_T1 | 6896 | 657 | 91.49 | glotblastn |
| 3289 | rice\|11v1\|AU057478 | 6897 | 657 | 88.9 | globlastp |
| 3290 | brachypodium\|12v1\|BRADI2G19326_P1 | 6898 | 657 | 88 | globlastp |
| 3291 | barley\|12v1\|BI947807_P1 | 6899 | 657 | 86.6 | globlastp |
| 3292 | rye\|12v1\|DRR001012.141872 | 6900 | 657 | 86.4 | globlastp |
| 3293 | rye\|12v1\|DRR001012.318622 | 6901 | 657 | 86.39 | glotblastn |
| 3294 | rye\|12v1\|DRR001012.254493 | 6902 | 657 | 84.8 | globlastp |
| 3295 | rye\|12v1\|DRR001013.258882 | 6903 | 657 | 82.72 | glotblastn |
| 3296 | brachypodium\|12v1\|BRADI2G49280_P1 | 6904 | 657 | 82.5 | globlastp |
| 3297 | rye\|12v1\|BE637307 | 6905 | 657 | 81.9 | globlastp |
| 3298 | rice\|11v1\|AU082277 | 6906 | 657 | 81.4 | globlastp |
| 3299 | maize\|10v1\|AI600686_P1 | 6907 | 657 | 81.1 | globlastp |
| 3300 | rye\|12v1\|DRR001012.142448 | 6908 | 657 | 80.84 | glotblastn |
| 3301 | switchgrass\|12v1\|FL712047_P1 | 6909 | 657 | 80.8 | globlastp |
| 3302 | barley\|12v1\|BF261099_P1 | 6910 | 657 | 80.6 | globlastp |
| 3303 | switchgrass\|12v1\|FL691024_P1 | 6911 | 657 | 80.4 | globlastp |
| 3304 | switchgrass\|gb167\|FL691024 | 6911 | 657 | 80.4 | globlastp |
| 3305 | wheat\|12v3\|BF474139 | 6912 | 657 | 80.4 | globlastp |
| 3306 | rye\|12v1\|DRR001012.142799 | 6913 | 657 | 80.3 | globlastp |
| 3307 | sorghum\|12v1\|SB03G034060 | 6914 | 657 | 80.27 | glotblastn |
| 3308 | millet\|10v1\|EVO454PM003766_P1 | 6915 | 657 | 80.2 | globlastp |
| 3309 | sugarcane\|10v1\|CA074352 | 6916 | 658 | 98.3 | globlastp |
| 3310 | switchgrass\|12v1\|DN151653_P1 | 6917 | 658 | 96.2 | globlastp |
| 3311 | switchgrass\|12v1\|FE628285_P1 | 6918 | 658 | 96.1 | globlastp |
| 3312 | foxtail_millet\|11v3\|PHY7SI005731M_P1 | 6919 | 658 | 95.9 | globlastp |
| 3313 | maize\|10v1\|AW066998_P1 | 6920 | 658 | 95.1 | globlastp |
| 3314 | switchgrass\|gb167\|FE630258 | 6921 | 658 | 93.7 | globlastp |
| 3315 | millet\|10v1\|EVO454PM002624_P1 | 6922 | 658 | 93 | globlastp |
| 3316 | rice\|11v1\|BE229866 | 6923 | 658 | 92.2 | globlastp |
| 3317 | brachypodium\|12v1\|BRADI1G46230_P1 | 6924 | 658 | 89.9 | globlastp |
| 3318 | rye\|12v1\|DRR001012.104803 | 6925 | 658 | 89 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 3319 | rye\|12v1\|DRR001012.109533 | 6925 | 658 | 89 | globlastp |
| 3320 | wheat\|12v3\|BE515801 | 6926 | 658 | 86.7 | globlastp |
| 3321 | rye\|12v1\|DRR001012.14078 | 6927 | 658 | 85.2 | globlastp |
| 3322 | wheat\|12v3\|BE429144_P1 | 6928 | 658 | 80.8 | globlastp |
| 3323 | foxtail_millet\|11v3\|PHY7SI005798M_P1 | 6929 | 659 | 82.2 | globlastp |
| 3324 | maize\|10v1\|SRR014549S0022069_P1 | 6930 | 659 | 81.7 | globlastp |
| 3325 | cowpea\|12v1\|FG938043_P1 | 6931 | 660 | 86.1 | globlastp |
| 3326 | soybean\|11v1\|GLYMA19G38100 | 6932 | 660 | 85.2 | globlastp |
| 3327 | soybean\|12v1\|GLYMA19G38100_P1 | 6932 | 660 | 85.2 | globlastp |
| 3328 | bean\|12v2\|CA915339_P1 | 6933 | 660 | 84.3 | globlastp |
| 3329 | bean\|12v1\|CA915339 | 6933 | 660 | 84.3 | globlastp |
| 3330 | lotus\|09v1\|GO019465_P1 | 6934 | 660 | 83.3 | globlastp |
| 3331 | pigeonpea\|11v2\|SRR054580X10059_P1 | 6935 | 660 | 83.3 | globlastp |
| 3332 | chickpea\|13v2\|SRR133517.575663_P1 | 6936 | 660 | 80.6 | globlastp |
| 3333 | peanut\|10v1\|GO342698_T1 | 6937 | 660 | 80.56 | glotblastn |
| 3334 | soybean\|11v1\|GLYMA04G43300 | 6938 | 661 | 97.8 | globlastp |
| 3335 | soybean\|12v1\|GLYMA04G43300T2_P1 | 6938 | 661 | 97.8 | globlastp |
| 3336 | pigeonpea\|11v1\|SRR054580X291223_P1 | 6939 | 661 | 97 | globlastp |
| 3337 | chickpea\|11v1\|SRR133517.1533 | 6940 | 661 | 95.6 | globlastp |
| 3338 | chickpea\|13v2\|SRR133517.224160_P1 | 6940 | 661 | 95.6 | globlastp |
| 3339 | cowpea\|12v1\|FF549703_P1 | 6941 | 661 | 95.6 | globlastp |
| 3340 | lotus\|09v1\|LLBI420463_P1 | 6942 | 661 | 95.6 | globlastp |
| 3341 | bean\|12v2\|SRR001334.164203_P1 | 6943 | 661 | 94.1 | globlastp |
| 3342 | liquorice\|gb171\|FS242023_P1 | 6944 | 661 | 94.1 | globlastp |
| 3343 | medicago\|12v1\|AL379894_P1 | 6945 | 661 | 94.1 | globlastp |
| 3344 | peanut\|10v1\|FF126206_P1 | 6946 | 661 | 94.1 | globlastp |
| 3345 | trigonella\|11v1\|SRR066194X108510 | 6945 | 661 | 94.1 | globlastp |
| 3346 | pea\|11v1\|FG535587_P1 | 6947 | 661 | 90.4 | globlastp |
| 3347 | cacao\|10v1\|CU475574_P1 | 6948 | 661 | 88.1 | globlastp |
| 3348 | castorbean\|12v1\|XM_002513790_P1 | 6949 | 661 | 87.4 | globlastp |
| 3349 | chestnut\|gb170\|SRR006295S0058141_P1 | 6950 | 661 | 87.4 | globlastp |
| 3350 | solanum_phureja\|09v1\|SPHB1210247 | 6951 | 661 | 86.8 | globlastp |
| 3351 | tobacco\|gb162\|DVI57543 | 6952 | 661 | 86.8 | globlastp |
| 3352 | beech\|11v1\|SRR006293.11243_P1 | 6953 | 661 | 86.7 | globlastp |
| 3353 | Clementine\|11v1\|CX640424_P1 | 6954 | 661 | 86.7 | globlastp |
| 3354 | cleome_spinosa\|10v1\|GR931729_P1 | 6955 | 661 | 86.7 | globlastp |
| 3355 | nax\|11v1\|JG022460_P1 | 6956 | 661 | 86.7 | globlastp |
| 3356 | nax\|11v1\|JG026610_P1 | 6957 | 661 | 86.7 | globlastp |
| 3357 | oak\|10v1\|FP042586_P1 | 6958 | 661 | 86.7 | globlastp |
| 3358 | tomato\|11v1\|BI210247 | 6959 | 661 | 86 | globlastp |
| 3359 | cucurbita\|11v1\|SRR091276X115885_T1 | 6960 | 661 | 85.93 | glotblastn |
| 3360 | cassava\|09v1\|JGICASSAVA36154VALIDM1_P1 | 6961 | 661 | 85.9 | globlastp |
| 3361 | cotton\|11v1\|DR459043_P1 | 6962 | 661 | 85.9 | globlastp |
| 3362 | cucumber\|09v1\|AM720808_P1 | 6963 | 661 | 85.9 | globlastp |
| 3363 | euphorbia\|11v1\|SRR098678X105121_P1 | 6964 | 661 | 85.9 | globlastp |
| 3364 | ipomoea_nil\|10v1\|BJ557095_P1 | 6965 | 661 | 85.9 | globlastp |
| 3365 | melon\|10v1\|AM720808_P1 | 6966 | 661 | 85.9 | globlastp |
| 3366 | orange\|11v1\|CX640424_P1 | 6967 | 661 | 85.9 | globlastp |
| 3367 | watermelon\|11v1\|AM740273 | 6966 | 661 | 85.9 | globlastp |
| 3368 | apple\|11v1\|CN488504_P1 | 6968 | 661 | 85.2 | globlastp |
| 3369 | cleome_gynandra\|10v1\|SRR015532S0011206_P1 | 6969 | 661 | 85.2 | globlastp |
| 3370 | cotton\|11v1\|DT569102XX2_P1 | 6970 | 661 | 85.2 | globlastp |
| 3371 | cucurbita\|11v1\|SRR091276X118557_P1 | 6971 | 661 | 85.2 | globlastp |
| 3372 | euonymus\|11v1\|SRR070038X125307_P1 | 6972 | 661 | 85.2 | globlastp |
| 3373 | gossypium_raimondii\|12v1\|DR459043_P1 | 6973 | 661 | 85.2 | globlastp |
| 3374 | nasturtium\|11v1\|SRR032558.107200_P1 | 6974 | 661 | 85.2 | globlastp |
| 3375 | strawberry\|11v1\|EX663963 | 6975 | 661 | 85.2 | globlastp |
| 3376 | tripterygium\|11v1\|SRR098677X125486 | 6976 | 661 | 85.2 | globlastp |
| 3377 | flaveria\|11v1\|SRR149244.84482_T1 | 6977 | 661 | 84.44 | glotblastn |
| 3378 | jatropha\|09v1\|GO247666_T1 | 6978 | 661 | 84.44 | glotblastn |
| 3379 | artemisia\|10v1\|EY070433_P1 | 6979 | 661 | 84.4 | globlastp |
| 3380 | artemisia\|10v1\|SRR019254S0100726_P1 | 6979 | 661 | 84.4 | globlastp |
| 3381 | cannabis\|12v1\|SOLX00051864_P1 | 6980 | 661 | 84.4 | globlastp |
| 3382 | chelidonium\|11v1\|SRR084752X19452_P1 | 6981 | 661 | 84.4 | globlastp |
| 3383 | cichorium\|gb171\|EH703976_P1 | 6982 | 661 | 84.4 | globlastp |
| 3384 | cotton\|11v1\|BG444423_P1 | 6983 | 661 | 84.4 | globlastp |
| 3385 | cotton\|11v1\|DW238196_P1 | 6984 | 661 | 84.4 | globlastp |
| 3386 | eucalyptus\|11v2\|SRR001658X6931_P1 | 6985 | 661 | 84.4 | globlastp |
| 3387 | flaveria\|11v1\|SRR149229.247145_P1 | 6986 | 661 | 84.4 | globlastp |
| 3388 | gossypium_raimondii\|12v1\|BG444423_P1 | 6983 | 661 | 84.4 | globlastp |
| 3389 | gossypium_raimondii\|12v1\|DT569102_P1 | 6987 | 661 | 84.4 | globlastp |
| 3390 | grape\|11v1\|GSVIVT01008943001_P1 | 6988 | 661 | 84.4 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 3391 | humulus\|11v1\|EX519738_P1 | 6980 | 661 | 84.4 | globlastp |
| 3392 | poplar\|10v1\|AI165677 | 6989 | 661 | 84.4 | globlastp |
| 3393 | poplar\|13v1\|AI165677_P1 | 6989 | 661 | 84.4 | globlastp |
| 3394 | poppy\|11v1\|FE964787_P1 | 6990 | 661 | 84.4 | globlastp |
| 3395 | poppy\|11v1\|SRR030259.167215_P1 | 6990 | 661 | 84.4 | globlastp |
| 3396 | poppy\|11v1\|SRR096789.113148_P1 | 6990 | 661 | 84.4 | globlastp |
| 3397 | thalictrum\|11v1\|SRR096787X154209 | 6991 | 661 | 84.4 | globlastp |
| 3398 | nicotiana_benthamiana\|gb162\|CN746865 | 6992 | 661 | 83.8 | globlastp |
| 3399 | amsonia\|11v1\|SRR098688X105761_P1 | 6993 | 661 | 83.7 | globlastp |
| 3400 | b_juncea\|12v1\|E6ANDIZ01C0JEQ_P1 | 6994 | 661 | 83.7 | globlastp |
| 3401 | b_juncea\|12v1\|E6ANDIZ01ENV7R_P1 | 6994 | 661 | 83.7 | globlastp |
| 3402 | b_rapa\|11v1\|AM385563_P1 | 6994 | 661 | 83.7 | globlastp |
| 3403 | canola\|11v1\|EE477425_P1 | 6994 | 661 | 83.7 | globlastp |
| 3404 | catharanthus\|11v1\|SRR098691X103316_P1 | 6995 | 661 | 83.7 | globlastp |
| 3405 | cirsium\|11v1\|SRR346952.102640_P1 | 6996 | 661 | 83.7 | globlastp |
| 3406 | dandelion\|10v1\|DY836116_P1 | 6997 | 661 | 83.7 | globlastp |
| 3407 | eschscholzia\|11v1\|SRR014116.124609_P1 | 6998 | 661 | 83.7 | globlastp |
| 3408 | euonymus\|11v1\|SRR070038X103789_P1 | 6999 | 661 | 83.7 | globlastp |
| 3409 | euonymus\|11v1\|SRR070038X443976_P1 | 7000 | 661 | 83.7 | globlastp |
| 3410 | euphorbia\|11v1\|DV126650_P1 | 7001 | 661 | 83.7 | globlastp |
| 3410 | spurge\|gb161\|DV126650 | 7001 | 661 | 83.7 | globlastp |
| 3411 | fagopyrum\|11v1\|SRR063703X103971_T1 | 7002 | 661 | 83.7 | glotblastn |
| 3412 | kiwi\|gb166\|FG410748_P1 | 7003 | 661 | 83.7 | globlastp |
| 3413 | lettuce\|12v1\|DW050122_P1 | 7004 | 661 | 83.7 | globlastp |
| 3414 | radish\|gb164\|EV529131 | 6994 | 661 | 83.7 | globlastp |
| 3415 | radish\|gb164\|EV544211 | 7005 | 661 | 83.7 | globlastp |
| 3416 | radish\|gb164\|EW725749 | 6994 | 661 | 83.7 | globlastp |
| 3417 | radish\|gb164\|EX770883 | 6994 | 661 | 83.7 | globlastp |
| 3418 | radish\|gb164\|FD970891 | 6994 | 661 | 83.7 | globlastp |
| 3419 | sunflower\|12v1\|EL487785 | 7006 | 661 | 83.7 | globlastp |
| 3420 | valeriana\|11v1\|SRR099039X124935 | 7007 | 661 | 83.7 | globlastp |
| 3421 | valeriana\|11v1\|SRR099039X36534 | 7007 | 661 | 83.7 | globlastp |
| 3422 | vinca\|11v1\|SRR098690X205121 | 7008 | 661 | 83.7 | globlastp |
| 3423 | centaurea\|11v1\|EH737429_P1 | 7009 | 661 | 83 | globlastp |
| 3424 | centaurea\|11v1\|EH785456_P1 | 7009 | 661 | 83 | globlastp |
| 3425 | peach\|gb157.2\|AJ823102_P1 | 7010 | 661 | 83 | globlastp |
| 3426 | ambrosia\|11v1\|SRR346943.179652_P1 | 7011 | 661 | 83 | globlastp |
| 3427 | arabidopsis_lyrata\|09v1\|JGIAL003809_P1 | 7012 | 661 | 83 | globlastp |
| 3428 | arabidopsis\|10v1\|AT1G36980_P1 | 7012 | 661 | 83 | globlastp |
| 3429 | aristolochia\|10v1\|FD752910_P1 | 7013 | 661 | 83 | globlastp |
| 3430 | b_oleracea\|gb161\|AM385563_P1 | 7014 | 661 | 83 | globlastp |
| 3431 | blueberry\|12v1\|SRR353282X16196D1_P1 | 7015 | 661 | 83 | globlastp |
| 3432 | centaurea\|gb166\|EH737429 | 7009 | 661 | 83 | globlastp |
| 3433 | cirsium\|11v1\|SRR346952.1027758_P1 | 7009 | 661 | 83 | globlastp |
| 3434 | cleomespinosa\|10v1\|GR930922_P1 | 7016 | 661 | 83 | globlastp |
| 3435 | euonymus\|11v1\|SRR070038X133921_P1 | 7017 | 661 | 83 | globlastp |
| 3436 | flaveria\|11v1\|SRR149245.189891_P1 | 7018 | 661 | 83 | globlastp |
| 3437 | guizotia\|10v1\|GE553450_P1 | 7019 | 661 | 83 | globlastp |
| 3438 | platanus\|11v1\|SRR096786X127458_P1 | 7020 | 661 | 83 | globlastp |
| 3439 | poplar\|10v1\|BU891793 | 7021 | 661 | 83 | globlastp |
| 3440 | poplar\|13v1\|BU891793_P1 | 7022 | 661 | 83 | globlastp |
| 3441 | prunus\|10v1\|CB819061 | 7010 | 661 | 83 | globlastp |
| 3442 | scabiosa\|11v1\|SRR063723X101694 | 7023 | 661 | 83 | globlastp |
| 3443 | tabernaemontana\|11v1\|SRR098689X101508 | 7024 | 661 | 83 | globlastp |
| 3444 | thellungiella_halophilum\|11v1\|BY807852 | 7025 | 661 | 83 | globlastp |
| 3445 | thellungiella_parvulum\|11v1\|BY807852 | 7026 | 661 | 83 | globlastp |
| 3446 | utricularia\|11v1\|SRR094438.100900 | 7027 | 661 | 83 | globlastp |
| 3447 | walnuts\|gb166\|CV198107 | 7028 | 661 | 83 | globlastp |
| 3448 | fagopyrum\|11v1\|SRR063689X106595_T1 | 7029 | 661 | 82.96 | glotblastn |
| 3449 | arnica\|11v1\|SRR099034X269189_T1 | — | 661 | 82.96 | glotblastn |
| 3450 | sunflower\|12v1\|EE635394 | 7030 | 661 | 82.4 | globlastp |
| 3451 | ambrosia\|11v1\|SRR346935.521531_T1 | 7031 | 661 | 82.22 | glotblastn |
| 3452 | sunflower\|12v1\|DY953735 | 7032 | 661 | 82.22 | glotblastn |
| 3453 | antirrhinum\|gb166\|AJ560024_P1 | 7033 | 661 | 82.2 | globlastp |
| 3454 | cynara\|gb167\|GE590748_P1 | 7034 | 661 | 82.2 | globlastp |
| 3455 | flaveria\|11v1\|SRR149229.213310_P1 | 7035 | 661 | 82.2 | globlastp |
| 3456 | plantago\|11v2\|SRR066373X102369_P1 | 7036 | 661 | 82.2 | globlastp |
| 3457 | rhizophora\|10v1\|SRR005793S0014453 | 7037 | 661 | 82.2 | globlastp |
| 3458 | silene\|11v1\|GH292314 | 7038 | 661 | 82.2 | globlastp |
| 3459 | silene\|11v1\|SRR096785X134112 | 7039 | 661 | 82.2 | globlastp |
| 3460 | tea\|10v1\|GE650230 | 7040 | 661 | 82.2 | globlastp |
| 3461 | beet\|12v1\|CK136709_P1 | 7041 | 661 | 81.5 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 3462 | radish\|gb164\|EW716990 | 7042 | 661 | 81.5 | globlastp |
| 3463 | rose\|12v1\|SRR397984.19572 | 7043 | 661 | 81.5 | globlastp |
| 3464 | sesame\|12v1\|SESI12V1242066 | 7044 | 661 | 81.5 | globlastp |
| 3465 | safflower\|gb162\|EL405269 | 7045 | 661 | 81.48 | glotblastn |
| 3466 | phyla\|11v2\|SRR099037X142101_T1 | 7046 | 661 | 80.74 | glotblastn |
| 3467 | triphysaria\|10v1\|SRR023500S0010336 | 7047 | 661 | 80.74 | glotblastn |
| 3468 | olea\|13v1\|SRR014464X2072D1_P1 | 7048 | 661 | 80.7 | globlastp |
| 3469 | amorphophallus\|11v2\|SRR089351X138647_P1 | 7049 | 661 | 80.7 | globlastp |
| 3470 | monkeyflower\|10v1\|GR037920 | 7050 | 661 | 80.7 | globlastp |
| 3471 | monkeyflower\|12v1\|GR037921_P1 | 7050 | 661 | 80.7 | globlastp |
| 3472 | orobanche\|10v1\|SRR023189S0020330_P1 | 7051 | 661 | 80.7 | globlastp |
| 3473 | phyla\|11v2\|SRR099035X106217_P1 | 7052 | 661 | 80.7 | globlastp |
| 3474 | platanus\|11v1\|SRR096786X123476_P1 | 7053 | 661 | 80.7 | globlastp |
| 3475 | fraxinus\|11v1\|SRR058827.107115_P1 | 7054 | 661 | 80.3 | globlastp |
| 3476 | bruguiera\|gb166\|BP945233_P1 | 7055 | 661 | 80 | globlastp |
| 3477 | primula\|11v1\|SRR098679X141285_T1 | 7056 | 661 | 80 | glotblastn |
| 3478 | sesame\|12v1\|SESI12V1255028 | 7057 | 661 | 80 | globlastp |
| 3479 | soybean\|11v1\|GLYMA08G22510 | 7058 | 662 | 82.8 | globlastp |
| 3480 | soybean\|12v1\|GLYMA08G22510_P1 | 7058 | 662 | 82.8 | globlastp |
| 3481 | soybean\|11v1\|GLYMA15G05100 | 7059 | 663 | 96.5 | globlastp |
| 3482 | soybean\|12v1\|GLYMA15G05100_P1 | 7059 | 663 | 96.5 | globlastp |
| 3483 | pigeonpea\|11v1\|SRR054580X121984_P1 | 7060 | 663 | 91.3 | globlastp |
| 3484 | cowpea\|12v1\|FF395717_P1 | 7061 | 663 | 89.6 | globlastp |
| 3485 | bean\|12v2\|CA913094_P1 | 7062 | 663 | 88.9 | globlastp |
| 3486 | bean\|12v1\|CA913094 | 7063 | 663 | 86.1 | globlastp |
| 3487 | medicago\|12v1\|AW685080_P1 | 7064 | 663 | 85.4 | globlastp |
| 3488 | peanut\|10v1\|ES720983_P1 | 7065 | 663 | 85.4 | globlastp |
| 3489 | trigonella\|11v1\|SRR066194X150097 | 7066 | 663 | 84.7 | globlastp |
| 3490 | chickpea\|11v1\|SRR133517.290513 | 7067 | 663 | 83.7 | globlastp |
| 3491 | chickpea\|13v2\|SRR133517.290513_P1 | 7067 | 663 | 83.7 | globlastp |
| 3492 | cacao\|10v1\|CA796237_P1 | 7068 | 663 | 80.2 | globlastp |
| 3493 | soybean\|11v1\|GLYMA07G09230 | 7069 | 664 | 99 | globlastp |
| 3494 | soybean\|12v1\|GLYMA07G09230_P1 | 7069 | 664 | 99 | globlastp |
| 3495 | cowpea\|12v1\|FF384990_P1 | 7070 | 664 | 95.6 | globlastp |
| 3496 | pigeonpea\|11v1\|GR466312_P1 | 7071 | 664 | 95.1 | globlastp |
| 3497 | bean\|12v2\|CA896990_P1 | 7072 | 664 | 91.3 | globlastp |
| 3498 | liquorice\|gb171\|FS245051_P1 | 7073 | 664 | 91.3 | globlastp |
| 3499 | chickpea\|13v2\|SRR133517.127065_P1 | 7074 | 664 | 89.8 | globlastp |
| 3500 | medicago\|12v1\|BF645221_P1 | 7075 | 664 | 88.8 | globlastp |
| 3501 | pigeonpea\|11v1\|SRR054580X311299_P1 | 7076 | 664 | 88.8 | globlastp |
| 3502 | trigonella\|11v1\|SRR066194X167645 | 7077 | 664 | 88.8 | globlastp |
| 3503 | chickpea\|11v1\|GR408372 | 7078 | 664 | 88.3 | globlastp |
| 3504 | chickpea\|13v2\|GR408372_P1 | 7078 | 664 | 88.3 | globlastp |
| 3505 | lotus\|09v1\|CB829390_P1 | 7079 | 664 | 85.9 | globlastp |
| 3506 | prunus\|10v1\|BU043083 | 7080 | 664 | 84.5 | globlastp |
| 3507 | apple\|11v1\|CN578871_T1 | 7081 | 664 | 84.47 | glotblastn |
| 3508 | prunus_mume\|13v1\|BU045798_P1 | 7082 | 664 | 84 | globlastp |
| 3509 | clementine\|11v1\|CB610770_P1 | 7083 | 664 | 84 | globlastp |
| 3510 | euphorbia\|11v1\|AW944689_P1 | 7084 | 664 | 84 | globlastp |
| 3511 | oak\|10v1\|SRR006307S0005449_P1 | 7085 | 664 | 84 | globlastp |
| 3512 | watermelon\|11v1\|DV633132 | 7086 | 664 | 83.6 | globlastp |
| 3513 | grape\|11v1\|GSVIVT01015349001_P1 | 7087 | 664 | 83.5 | globlastp |
| 3514 | humulus\|11v1\|SRR098683X103251_P1 | 7088 | 664 | 83.5 | globlastp |
| 3515 | tripterygium\|11v1\|SRR098677X11113 | 7089 | 664 | 83.5 | globlastp |
| 3516 | beech\|11v1\|SRR006293.30095_P1 | 7090 | 664 | 83 | globlastp |
| 3517 | chestnut\|gb170\|SRR006295S0023952_P1 | 7091 | 664 | 83 | globlastp |
| 3518 | nasturtium\|11v1\|SRR032558.248195_P1 | 7092 | 664 | 83 | globlastp |
| 3519 | beech\|11v1\|SRR006293.28912_P1 | 7093 | 664 | 82.5 | globlastp |
| 3520 | cacao\|10v1\|CA798448_P1 | 7094 | 664 | 82.5 | globlastp |
| 3521 | cotton\|11v1\|DV850036_P1 | 7095 | 664 | 82.5 | globlastp |
| 3522 | cotton\|11v1\|DW484523_P1 | 7095 | 664 | 82.5 | globlastp |
| 3523 | gossypium_raimondii\|12v1\|DV850036_P1 | 7095 | 664 | 82.5 | globlastp |
| 3524 | heritiera\|10v1\|SRR005794S0001798_P1 | 7096 | 664 | 82.5 | globlastp |
| 3525 | sesame\|12v1\|SESI12V1399863 | 7097 | 664 | 82.5 | globlastp |
| 3526 | flaveria\|11v1\|SRR149232.13754_T1 | 7098 | 664 | 82.04 | glotblastn |
| 3527 | cassava\|09v1\|DV448411_P1 | 7099 | 664 | 82 | globlastp |
| 3528 | euonymus\|11v1\|SRR070038X352059_P1 | 7100 | 664 | 82 | globlastp |
| 3529 | poplar\|10v1\|BI130347 | 7101 | 664 | 82 | globlastp |
| 3530 | poplar\|13v1\|BI130347_P1 | 7101 | 664 | 82 | globlastp |
| 3531 | castorbean\|12v1\|XM002514219_P1 | 7102 | 664 | 81.6 | globlastp |
| 3532 | olea\|13v1\|SRR014464X28214D1_P1 | 7103 | 664 | 81.6 | globlastp |
| 3533 | cannabis\|12v1\|SOLX00001727_P1 | 7104 | 664 | 81.6 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 3534 | castorbean\|11v1\|XM_002514219 | 7102 | 664 | 81.6 | globlastp |
| 3535 | cotton\|11v1\|AI726553_P1 | 7105 | 664 | 81.6 | globlastp |
| 3536 | tabernaemontana\|11v1\|SRR098689X137108 | 7106 | 664 | 81.6 | globlastp |
| 3537 | cannabis\|12v1\|SOLX00054706_T1 | 7107 | 664 | 81.55 | glotblastn |
| 3538 | eucalyptus\|11v2\|CT982143_T1 | 7108 | 664 | 81.55 | glotblastn |
| 3539 | melon\|10v1\|DV633132_P1 | 7109 | 664 | 81.2 | globlastp |
| 3540 | primula\|11v1\|SRR098679X10210_P1 | 7110 | 664 | 81.2 | globlastp |
| 3541 | olea\|13v1\|SRR014466X5637D1_P1 | 7111 | 664 | 81.1 | globlastp |
| 3542 | antirrhinum\|gb166\|AJ560029_P1 | 7112 | 664 | 81.1 | globlastp |
| 3543 | blueberry\|12v1\|CF811518_P1 | 7113 | 664 | 81.1 | globlastp |
| 3544 | kiwi\|gb166\|FG399558_P1 | 7114 | 664 | 81.1 | globlastp |
| 3545 | flaveria\|11v1\|SRR149229.174318_P1 | 7115 | 664 | 80.8 | globlastp |
| 3546 | sunflower\|12v1\|CD855541 | 7116 | 664 | 80.8 | globlastp |
| 3547 | sunflower\|12v1\|EE642451 | 7116 | 664 | 80.8 | globlastp |
| 3548 | cucumber\|09v1\|DV633132_P1 | 7117 | 664 | 80.7 | globlastp |
| 3549 | prunus_mume\|13v1\|PMBJFU12017632_P1 | 7118 | 664 | 80.6 | globlastp |
| 3550 | centaurea\|11v1\|EH780567_T1 | 7119 | 664 | 80.58 | glotblastn |
| 3551 | cirsium\|11v1\|SRR346952.1003427_T1 | 7119 | 664 | 80.58 | glotblastn |
| 3552 | cirsium\|11v1\|SRR346952.102086_T1 | 7120 | 664 | 80.58 | glotblastn |
| 3553 | fraxinus\|11v1\|SRR058827.171336_T1 | 7121 | 664 | 80.58 | glotblastn |
| 3554 | ambrosia\|11v1\|SRR346935.165509_P1 | 7122 | 664 | 80.3 | globlastp |
| 3555 | flaveria\|11v1\|SRR149229.499363_P1 | 7123 | 664 | 80.3 | globlastp |
| 3556 | centaurea\|11v1\|EH732220_T1 | 7124 | 664 | 80.1 | glotblastn |
| 3557 | b_juncea\|12v1\|E6ANDIZ01C390H_P1 | 7125 | 664 | 80.1 | globlastp |
| 3558 | b_juncea\|12v1\|E6ANDIZ01CPHEG_P1 | 7125 | 664 | 80.1 | globlastp |
| 3559 | b_oleracea\|gb161\|DY028354_P1 | 7125 | 664 | 80.1 | globlastp |
| 3560 | b_rapa\|11v1\|BG544180_P1 | 7125 | 664 | 80.1 | globlastp |
| 3561 | canola\|11v1\|CN726117_P1 | 7125 | 664 | 80.1 | globlastp |
| 3562 | canola\|11v1\|CN736264_P1 | 7125 | 664 | 80.1 | globlastp |
| 3563 | centaurea\|gb166\|EH732220 | 7126 | 664 | 80.1 | glotblastn |
| 3564 | lettuce\|12v1\|DW093096_T1 | 7127 | 664 | 80.1 | glotblastn |
| 3565 | monkeyflower\|10v1\|GR085098 | 7128 | 664 | 80.1 | globlastp |
| 3566 | monkeyflower\|12v1\|GR145075_P1 | 7128 | 664 | 80.1 | globlastp |
| 3567 | orobanche\|10v1\|SRR023189S0008854_P1 | 7129 | 664 | 80.1 | globlastp |
| 3568 | radish\|gb164\|EV528371 | 7125 | 664 | 80.1 | globlastp |
| 3569 | radish\|gb164\|EX750294 | 7125 | 664 | 80.1 | globlastp |
| 3570 | bean\|12v2\|CB539867_P1 | 7130 | 665 | 85.8 | globlastp |
| 3571 | pigeonpea\|11v1\|SRR054580X1192_P1 | 7131 | 665 | 82.1 | globlastp |
| 3572 | soybean\|12v1\|GLYMA17G05000_T1 | 7132 | 666 | 95.81 | glotblastn |
| 3573 | soybean\|11v1\|GLYMA17G05000 | 7133 | 666 | 88.4 | globlastp |
| 3574 | bean\|12v2\|FE897475_P1 | 7134 | 666 | 88.2 | globlastp |
| 3575 | bean\|12v1\|FE897475 | 7134 | 666 | 88.2 | globlastp |
| 3576 | lotus\|09v1\|AW428750_P1 | 7135 | 666 | 82.2 | globlastp |
| 3577 | pigeonpea\|11v1\|SRR054580X20040_P1 | 7136 | 667 | 89.4 | globlastp |
| 3578 | cowpea\|12v1\|FG851264_P1 | 7137 | 667 | 85 | globlastp |
| 3579 | bean\|12v2\|SRR001335.259534_P1 | 7138 | 667 | 84.3 | globlastp |
| 3580 | bean\|12v1\|SRR001334.257821 | 7138 | 667 | 84.3 | globlastp |
| 3581 | chickpea\|13v2\|SRR133517.17277_P1 | 7139 | 667 | 81.7 | globlastp |
| 3582 | chickpea\|11v1\|SRR133517.17277 | 7140 | 667 | 81.4 | globlastp |
| 3583 | bean\|12v2\|FE897233_P1 | 7141 | 668 | 89.6 | globlastp |
| 3584 | pigeonpea\|11v1\|SRR054580X108302_P1 | 7142 | 668 | 83.9 | globlastp |
| 3585 | lotus\|09v1\|GO023895_P1 | 7143 | 668 | 81.8 | globlastp |
| 3586 | soybean\|11v1\|GLYMA02G10470 | 7144 | 669 | 97.5 | globlastp |
| 3587 | soybean\|12v1\|GLYMA02G10470_P1 | 7144 | 669 | 97.5 | globlastp |
| 3588 | pigeonpea\|11v1\|SRR054580X101289_P1 | 7145 | 669 | 95.8 | globlastp |
| 3589 | bean\|12v2\|CA900637_P1 | 7146 | 669 | 94.7 | globlastp |
| 3590 | bean\|12v1\|CA900637 | 7146 | 669 | 94.7 | globlastp |
| 3591 | chickpea\|13v2\|CD766047_P1 | 7147 | 669 | 93.3 | globlastp |
| 3592 | medicago\|12v1\|AW171668_P1 | 7148 | 669 | 92.8 | globlastp |
| 3593 | soybean\|11v1\|GLYMA20G23200 | 7149 | 669 | 88.8 | globlastp |
| 3594 | soybean\|12v1\|GLYMA20G23200_P1 | 7149 | 669 | 88.8 | globlastp |
| 3595 | lotus\|09v1\|CRPLJ004964_P1 | 7150 | 669 | 88.2 | globlastp |
| 3596 | pigeonpea\|11v1\|SRR054580X108320_P1 | 7151 | 669 | 88.2 | globlastp |
| 3597 | bean\|12v2\|SRR001334.240240_P1 | 7152 | 669 | 87.9 | globlastp |
| 3598 | chickpea\|13v2\|FE673041_P1 | 7153 | 669 | 85.7 | globlastp |
| 3599 | watermelon\|11v1\|AM737897 | 7154 | 669 | 81.65 | glotblastn |
| 3600 | cucumber\|09v1\|DV737634_T1 | 7155 | 669 | 81.46 | glotblastn |
| 3601 | thellungiella_halophilum\|11v1\|DN776865 | 7156 | 669 | 80.4 | globlastp |
| 3602 | soybean\|11v1\|GLYMA16G04520 | 7157 | 670 | 97.3 | globlastp |
| 3603 | soybean\|12v1\|GLYMA16G04510_P1 | 7157 | 670 | 97.3 | globlastp |
| 3604 | pigeonpea\|11v1\|SRR054580X109447_T1 | 7158 | 670 | 91.21 | glotblastn |
| 3605 | bean\|12v2\|CA910607_P1 | 7159 | 670 | 90.8 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 3606 | chickpea\|13v2\|SRR133517.187864_P1 | 7160 | 670 | 84.1 | globlastp |
| 3607 | lotus\|09v1\|BW594470_P1 | 7161 | 670 | 82.7 | globlastp |
| 3608 | trigonella\|11v1\|SRR066194X185876 | 7162 | 670 | 82.37 | glotblastn |
| 3609 | pea\|11v1\|AF139187_P1 | 7163 | 670 | 82.3 | globlastp |
| 3610 | medicago\|12v1\|AW256421_P1 | 7164 | 670 | 81.4 | globlastp |
| 3611 | cowpea\|12v1\|FG818026_T1 | 7165 | 670 | 80.37 | glotblastn |
| 3612 | peanut\|10v1\|ES722519_P1 | 7166 | 670 | 80.2 | globlastp |
| 3613 | solanum_phureja\|09v1\|SPHAA824906 | 7167 | 672 | 99.3 | globlastp |
| 3614 | eggplant\|10v1\|FS017432_P1 | 7168 | 672 | 98.6 | globlastp |
| 3615 | tobacco\|gb162\|DW002909 | 7169 | 672 | 98.6 | globlastp |
| 3616 | pepper\|12v1\|BM064462_P1 | 7170 | 672 | 97.1 | globlastp |
| 3617 | petunia\|gb171\|CV292833_P1 | 7171 | 672 | 96.5 | globlastp |
| 3618 | ipomoea_nil\|10v1\|CJ754261_P1 | 7172 | 672 | 93.5 | globlastp |
| 3619 | nicotiana_benthamiana\|12v1\|DV158950_P1 | 7173 | 672 | 92.8 | globlastp |
| 3620 | nicotiana_benthamiana\|12v1\|GO612443_P1 | 7174 | 672 | 92.8 | globlastp |
| 3621 | eucalyptus\|11v2\|CD669763_P1 | 7175 | 672 | 92.8 | globlastp |
| 3622 | papaya\|gb165\|EX266017_P1 | 7176 | 672 | 92.8 | globlastp |
| 3623 | tobacco\|gb162\|DV158950 | 7173 | 672 | 92.8 | globlastp |
| 3624 | sarracenia\|11v1\|SRR192669.14552 | 7177 | 672 | 92 | globlastp |
| 3625 | tabernaemontana\|11v1\|SRR098689X102972 | 7178 | 672 | 92 | globlastp |
| 3626 | tripterygium\|11v1\|SRR098677X130152 | 7179 | 672 | 92 | globlastp |
| 3627 | vinca\|11v1\|SRR098690X322602 | 7180 | 672 | 92 | globlastp |
| 3628 | amsonia\|11v1\|SRR098688X129449_P1 | 7181 | 672 | 91.3 | globlastp |
| 3629 | beech\|11v1\|SRR006294.27495_P1 | 7182 | 672 | 91.3 | globlastp |
| 3630 | blueberry\|12v1\|SRR353282X12628D1_P1 | 7183 | 672 | 91.3 | globlastp |
| 3631 | cassava\|09v1\|DV451280_P1 | 7184 | 672 | 91.3 | globlastp |
| 3632 | chestnut\|gb170\|SRR006295S0028173_P1 | 7182 | 672 | 91.3 | globlastp |
| 3633 | euonymus\|11v1\|SRR070038X515004_P1 | 7185 | 672 | 91.3 | globlastp |
| 3634 | grape\|11v1\|GSVIVT01020782001_P1 | 7186 | 672 | 91.3 | globlastp |
| 3635 | grape\|11v1\|VVCRP029347_P1 | 7186 | 672 | 91.3 | globlastp |
| 3636 | oak\|10v1\|FP037758_P1 | 7182 | 672 | 91.3 | globlastp |
| 3637 | pigeonpea\|11v1\|GW359427_P1 | 7187 | 672 | 91.3 | globlastp |
| 3638 | poplar\|10v1\|AI161645 | 7188 | 672 | 91.3 | globlastp |
| 3639 | poplar\|13v1\|AI161645_P1 | 7188 | 672 | 91.3 | globlastp |
| 3640 | poplar\|10v1\|AI163089 | 7188 | 672 | 91.3 | globlastp |
| 3641 | poplar\|13v1\|AI163778_P1 | 7188 | 672 | 91.3 | globlastp |
| 3642 | sarracenia\|11v1\|SRR192669.105170 | 7189 | 672 | 91.3 | glotblastn |
| 3643 | soybean\|11v1\|GLYMA05G32260 | 7190 | 672 | 91.3 | globlastp |
| 3644 | soybean\|12v1\|GLYMA05G32260_P1 | 7190 | 672 | 91.3 | globlastp |
| 3645 | soybean\|11v1\|GLYMA16G09890 | 7191 | 672 | 91.3 | globlastp |
| 3646 | soybean\|12v1\|GLYMA16G09890_P1 | 7191 | 672 | 91.3 | globlastp |
| 3647 | bean\|12v2\|CA902328_P1 | 7192 | 672 | 90.6 | globlastp |
| 3648 | bean\|12v1\|CA902328 | 7192 | 672 | 90.6 | globlastp |
| 3649 | cassava\|09v1\|TMPLEG659528T1_P1 | 7193 | 672 | 90.6 | globlastp |
| 3650 | castorbean\|12v1\|EG659528_P1 | 7194 | 672 | 90.6 | globlastp |
| 3651 | clementine\|11v1\|CF835589_P1 | 7195 | 672 | 90.6 | globlastp |
| 3651 | orange\|11v1\|CK935472_P1 | 7195 | 672 | 90.6 | globlastp |
| 3652 | coffea\|10v1\|DV665605_P1 | 7196 | 672 | 90.6 | globlastp |
| 3653 | cowpea\|12v1\|FF390716_P1 | 7192 | 672 | 90.6 | globlastp |
| 3654 | cyamopsis\|10v1\|EG975056_P1 | 7197 | 672 | 90.6 | globlastp |
| 3655 | liquorice\|gb171\|FS258113_P1 | 7192 | 672 | 90.6 | globlastp |
| 3656 | lotus\|09v1\|GO019310_P1 | 7198 | 672 | 90.6 | globlastp |
| 3657 | soybean\|11v1\|GLYMA03G22220 | 7199 | 672 | 90.6 | globlastp |
| 3658 | soybean\|12v1\|GLYMA03G22220_P1 | 7199 | 672 | 90.6 | globlastp |
| 3659 | trigonella\|11v1\|SRR066194X126359 | 7198 | 672 | 90.6 | globlastp |
| 3660 | chickpea\|13v2\|GR913036_P1 | 7200 | 672 | 89.9 | globlastp |
| 3661 | chickpea\|13v2\|SRR133517.234652_P1 | 7200 | 672 | 89.9 | globlastp |
| 3662 | bruguiera\|gb166\|BP950443_P1 | 7201 | 672 | 89.9 | globlastp |
| 3663 | chickpea\|11v1\|GR913036 | 7200 | 672 | 89.9 | globlastp |
| 3664 | cotton\|11v1\|AI730065_P1 | 7202 | 672 | 89.9 | globlastp |
| 3665 | cotton\|11v1\|BQ410573_P1 | 7202 | 672 | 89.9 | globlastp |
| 3666 | cucurbita\|11v1\|SRR091276X110065_P1 | 7203 | 672 | 89.9 | globlastp |
| 3667 | cucurbita\|11v1\|SRR091276X231682_P1 | 7203 | 672 | 89.9 | globlastp |
| 3668 | fraxinus\|11v1\|SRR058827.107668_P1 | 7204 | 672 | 89.9 | globlastp |
| 3669 | gossypium_raimondii\|12v1\|AI730065_P1 | 7202 | 672 | 89.9 | globlastp |
| 3670 | gossypium_raimondii\|12v1\|BQ410573_P1 | 7202 | 672 | 89.9 | globlastp |
| 3671 | heritiera\|10v1\|SRR005795S0002072_P1 | 7202 | 672 | 89.9 | globlastp |
| 3672 | hornbeam\|12v1\|SRR364455.105030_P1 | 7205 | 672 | 89.9 | globlastp |
| 3673 | medicago\|12v1\|AW287968_P1 | 7206 | 672 | 89.9 | globlastp |
| 3674 | momordica\|10v1\|SRR071315S0006698_P1 | 7207 | 672 | 89.9 | globlastp |
| 3675 | olea\|11v1\|SRR014463.16031 | 7204 | 672 | 89.9 | globlastp |
| 3676 | olea\|13v1\|SRR014463X16031D1_P1 | 7204 | 672 | 89.9 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 3677 | peanut|10v1|CD038051_P1 | 7208 | 672 | 89.9 | globlastp |
| 3678 | petunia|gb171|CV298055_P1 | 7209 | 672 | 89.9 | globlastp |
| 3679 | phyla|11v2|SRR099037X109250_P1 | 7210 | 672 | 89.9 | globlastp |
| 3680 | sunflower|12v1|EE651559 | 7211 | 672 | 89.9 | globlastp |
| 3681 | walnuts|gb166|CV195160 | 7212 | 672 | 89.9 | globlastp |
| 3682 | rhizophora|10v1|SRR005792S0002572 | 7213 | 672 | 89.86 | glotblastn |
| 3683 | cacao|10v1|CU480658_P1 | 7214 | 672 | 89.1 | globlastp |
| 3684 | catharanthus|11v1|EG561727_P1 | 7215 | 672 | 89.1 | globlastp |
| 3685 | cichorium|gb171|EH699665_P1 | 7216 | 672 | 89.1 | globlastp |
| 3686 | cucurbita|11v1|SRR091276X11558_P1 | 7217 | 672 | 89.1 | globlastp |
| 3687 | euonymus|11v1|SRR070038X443151_P1 | 7218 | 672 | 89.1 | globlastp |
| 3688 | euphorbia|11v1|DV116081_P1 | 7219 | 672 | 89.1 | globlastp |
| 3689 | flaveria|11v1|SRR149229.149165XX2_P1 | 7220 | 672 | 89.1 | globlastp |
| 3690 | flaveria|11v1|SRR149232.124563_P1 | 7220 | 672 | 89.1 | globlastp |
| 3691 | flaveria|11v1|SRR149232.141798_P1 | 7220 | 672 | 89.1 | globlastp |
| 3692 | guizotia|10v1|GE563099_P1 | 7221 | 672 | 89.1 | globlastp |
| 3693 | nasturtium|11v1|SRR032558.175411_P1 | 7222 | 672 | 89.1 | globlastp |
| 3694 | spurge|gb161|DV116081 | 7219 | 672 | 89.1 | globlastp |
| 3695 | sunflower|12v1|AJ318322 | 7223 | 672 | 89.1 | globlastp |
| 3696 | sunflower|12v1|CF087693 | 7223 | 672 | 89.1 | globlastp |
| 3697 | watermelon|11v1|AM714594 | 7224 | 672 | 89.1 | globlastp |
| 3698 | aquilegia|10v2|JGIAC003626_P1 | 7225 | 672 | 88.5 | globlastp |
| 3699 | ambrosia|11v1|SRR346943.116345_P1 | 7226 | 672 | 88.4 | globlastp |
| 3700 | ambrosia|11v1|SRR346943.135917_P1 | 7226 | 672 | 88.4 | globlastp |
| 3701 | blueberry|12v1|CV190540_P1 | 7227 | 672 | 88.4 | globlastp |
| 3702 | blueberry|12v1|SRR353282X5502D1_P1 | 7227 | 672 | 88.4 | globlastp |
| 3703 | cucumber|09v1|AM714594_P1 | 7228 | 672 | 88.4 | globlastp |
| 3704 | lettuce|12v1|DW050615_P1 | 7229 | 672 | 88.4 | globlastp |
| 3705 | melon|10v1|AM714594_P1 | 7228 | 672 | 88.4 | globlastp |
| 3706 | nuphar|gb166|CK760631_P1 | 7230 | 672 | 88.4 | globlastp |
| 3707 | sunflower|12v1|CD847025 | 7231 | 672 | 88.4 | globlastp |
| 3708 | sunflower|12v1|DY935727 | 7232 | 672 | 88.4 | globlastp |
| 3709 | tragopogon|10v1|SRR020205S0012851 | 7233 | 672 | 88.4 | globlastp |
| 3710 | watermelon|11v1|VMEL08104207201030 | 7234 | 672 | 88.4 | globlastp |
| 3711 | valeriana|11v1|SRR099039X129790 | 7235 | 672 | 87.9 | globlastp |
| 3712 | flax|11v1|JG083843_P1 | 7236 | 672 | 87.7 | globlastp |
| 3713 | antirrhinum|gb166|AJ788528_T1 | 7237 | 672 | 87.68 | glotblastn |
| 3714 | amborella|12v3|SRR038635.101448_P1 | 7238 | 672 | 87.1 | globlastp |
| 3715 | dandelion|10v1|DR402437_P1 | 7239 | 672 | 87.1 | globlastp |
| 3716 | apple|11v1|CN445348_P1 | 7240 | 672 | 87 | globlastp |
| 3717 | artemisia|10v1|EF549581_P1 | 7241 | 672 | 87 | globlastp |
| 3718 | cleome_gynandra|10v1|SRR015532S0004149_P1 | 7242 | 672 | 87 | globlastp |
| 3719 | cleome_spinosa|10v1|SRR015531S0006728_P1 | 7243 | 672 | 87 | globlastp |
| 3720 | euphorbia|11v1|SRR098678X163100_P1 | 7244 | 672 | 87 | globlastp |
| 3721 | flax|11v1|JG023417_P1 | 7245 | 672 | 87 | globlastp |
| 3722 | oil_palm|11v1|EL683706_P1 | 7246 | 672 | 87 | globlastp |
| 3723 | prunus|10v1|BU043746 | 7247 | 672 | 87 | globlastp |
| 3724 | rose|12v1|BI978180 | 7248 | 672 | 87 | globlastp |
| 3725 | rose|12v1|EC588741 | 7248 | 672 | 87 | globlastp |
| 3726 | chelidonium|11v1|SRR084752X170599_T1 | 7249 | 672 | 86.96 | glotblastn |
| 3727 | primula|11v1|SRR098679X102937_T1 | 7250 | 672 | 86.96 | glotblastn |
| 3728 | banana|12v1|BBS2839T3_P1 | 7251 | 672 | 86.2 | globlastp |
| 3729 | eschscholzia|11v1|CK748022_P1 | 7252 | 672 | 86.2 | globlastp |
| 3730 | monkeyflower|10v1|CV518516 | 7253 | 672 | 86.2 | globlastp |
| 3731 | monkeyflower|12v1|CV518516_P1 | 7253 | 672 | 86.2 | globlastp |
| 3732 | centaurea|11v1|EH738332_P1 | 7254 | 672 | 85.7 | globlastp |
| 3733 | centaurea|11v1|EH752889_P1 | 7254 | 672 | 85.7 | globlastp |
| 3734 | centaurea|gb166|EH738332 | 7254 | 672 | 85.7 | globlastp |
| 3735 | cirsium|11v1|SRR346952.1024531_P1 | 7254 | 672 | 85.7 | globlastp |
| 3736 | olea|13v1|SRR014463X44251D1_T1 | 7255 | 672 | 85.61 | glotblastn |
| 3737 | aristolochia|10v1|FD750215_P1 | 7256 | 672 | 85.5 | globlastp |
| 3738 | bupleurum|11v1|SRR301254.123037_P1 | 7257 | 672 | 85.5 | globlastp |
| 3739 | cucumber|09v1|BGI454H0182627_P1 | 7258 | 672 | 85.5 | globlastp |
| 3740 | fagopyrum|11v1|SRR063689X101809_P1 | 7259 | 672 | 85.5 | globlastp |
| 3741 | fagopyrum|11v1|SRR063689X103813_P1 | 7259 | 672 | 85.5 | globlastp |
| 3742 | utricularia|11v1|SRR094438.101455 | 7260 | 672 | 85.5 | globlastp |
| 3743 | senecio|gb170|DY659690 | 7261 | 672 | 85.1 | globlastp |
| 3744 | centaurea|11v1|EH780576_P1 | 7262 | 672 | 85 | globlastp |
| 3745 | arabidopsis_lyrata|09v1|JGIAL020672_P1 | 7263 | 672 | 84.8 | globlastp |
| 3746 | arabidopsis|10v1|AT5G09920_P1 | 7264 | 672 | 84.8 | globlastp |
| 3747 | fagopyrum|11v1|SRR063703X131004_P1 | 7265 | 672 | 84.8 | globlastp |
| 3748 | sesame|12v1|SESI12V1356715 | 7266 | 672 | 84.8 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 3749 | euphorbia\|11v1\|BP960506_P1 | 7267 | 672 | 84.2 | globlastp |
| 3750 | b_rapa\|11v1\|CN730236_P1 | 7268 | 672 | 84.1 | globlastp |
| 3751 | b_rapa\|11v1\|H07557_P1 | 7268 | 672 | 84.1 | globlastp |
| 3752 | canola\|11v1\|CN730236_P1 | 7268 | 672 | 84.1 | globlastp |
| 3753 | canola\|11v1\|EE459982_P1 | 7268 | 672 | 84.1 | globlastp |
| 3754 | canola\|11v1\|EV041760_P1 | 7268 | 672 | 84.1 | globlastp |
| 3755 | canola\|11v1\|H07557_P1 | 7268 | 672 | 84.1 | globlastp |
| 3756 | humulus\|11v1\|SRR098683X106032_P1 | 7269 | 672 | 84.1 | globlastp |
| 3757 | radish\|gb164\|EV544637 | 7268 | 672 | 84.1 | globlastp |
| 3758 | thellungiella_parvulum\|11v1\|DN774731 | 7270 | 672 | 84.1 | globlastp |
| 3759 | cynara\|gb167\|GE586010_P1 | 7271 | 672 | 83.6 | globlastp |
| 3760 | radish\|gb164\|EW716919 | 7272 | 672 | 83.5 | globlastp |
| 3761 | radish\|gb164\|EX763962 | 7272 | 672 | 83.5 | globlastp |
| 3762 | curcuma\|10v1\|DY383869_T1 | 7273 | 672 | 83.33 | glotblastn |
| 3763 | aristolochia\|10v1\|SRR039082S0316312_P1 | 7274 | 672 | 83.3 | globlastp |
| 3764 | b_juncea\|12v1\|E6ANDIZ01B54CY_P1 | 7275 | 672 | 83.3 | globlastp |
| 3765 | b_juncea\|12v1\|E6ANDIZ01CNNVD_P1 | 7276 | 672 | 83.3 | globlastp |
| 3766 | boleracea\|gb161\|AM057678_P1 | 7276 | 672 | 83.3 | globlastp |
| 3767 | canola\|11v1\|CN828755_P1 | 7277 | 672 | 83.3 | globlastp |
| 3768 | phalaenopsis\|11v1\|SRR125771.1055688_P1 | 7278 | 672 | 83.3 | globlastp |
| 3769 | salvia\|10v1\|CV165847 | 7279 | 672 | 83.3 | globlastp |
| 3770 | strawberry\|11v1\|CO379850 | 7280 | 672 | 83.3 | globlastp |
| 3771 | safflower\|gb162\|EL387455 | 7281 | 672 | 82.9 | globlastp |
| 3772 | canola\|11v1\|EG019489_P1 | 7282 | 672 | 82.7 | globlastp |
| 3773 | b_rapa\|11v1\|CD811778_P1 | 7283 | 672 | 82.1 | globlastp |
| 3774 | canola\|11v1\|ES959288_P1 | 7283 | 672 | 82.1 | globlastp |
| 3775 | canola\|11v1\|FG570031_P1 | 7284 | 672 | 81.9 | globlastp |
| 3776 | fraxinus\|11v1\|SRR058827.104121_P1 | 7285 | 672 | 81.9 | globlastp |
| 3777 | thellungiella_halophilum\|11v1\|DN774731 | 7286 | 672 | 81.9 | globlastp |
| 3778 | phyla\|11v2\|SRR099035X34009_T1 | 7287 | 672 | 81.88 | glotblastn |
| 3779 | fagopyrum\|11v1\|SRR063689X155135_T1 | — | 672 | 81.88 | glotblastn |
| 3780 | cirsium\|11v1\|SRR346952.454216_P1 | 7288 | 672 | 81.4 | globlastp |
| 3781 | catharanthus\|11v1\|SRR098691X345081_T1 | 7289 | 672 | 80.43 | glotblastn |
| 3782 | cycas\|gb166\|EX920938_T1 | 7290 | 672 | 80.43 | glotblastn |
| 3783 | nicotiana_benthamiana\|12v1\|AJ718885_P1 | 7291 | 672 | 80.4 | globlastp |
| 3784 | potato\|10v1\|BG350925_P1 | 7292 | 673 | 97.9 | globlastp |
| 3785 | solanum_phureja\|09v1\|SPHBG630567 | 7292 | 673 | 97.9 | globlastp |
| 3786 | nicotiana_benthamiana\|12v1\|AF153277_P1 | 7293 | 673 | 95.8 | globlastp |
| 3787 | nicotiana_benthamiana\|12v1\|EH367819_P1 | 7293 | 673 | 95.8 | globlastp |
| 3788 | tobacco\|gb162\|AF153277 | 7293 | 673 | 95.8 | globlastp |
| 3789 | pepper\|12v1\|BM064474_P1 | 7294 | 673 | 95.1 | globlastp |
| 3790 | eggplant\|10v1\|FS029867_P1 | 7295 | 673 | 93.8 | globlastp |
| 3791 | tobacco\|gb162\|AM784837 | 7296 | 673 | 88.9 | globlastp |
| 3792 | monkeyflower\|10v1\|DV210285 | 7297 | 673 | 87.5 | globlastp |
| 3793 | monkeyflower\|12v1\|DV210285_P1 | 7297 | 673 | 87.5 | globlastp |
| 3794 | orobanche\|10v1\|SRR023189S0013058_P1 | 7298 | 673 | 87.5 | globlastp |
| 3795 | petunia\|gb171\|CV295124_P1 | 7299 | 673 | 87.5 | globlastp |
| 3796 | orobanche\|10v1\|SRR023189S0021390_P1 | 7300 | 673 | 86.8 | globlastp |
| 3797 | triphysaria\|10v1\|BM357267 | 7301 | 673 | 86.8 | globlastp |
| 3798 | olea\|13v1\|SRR014464X38751D1_P1 | 7302 | 673 | 86.1 | globlastp |
| 3799 | catharanthus\|11v1\|SRR098691X105656_P1 | 7303 | 673 | 86.1 | globlastp |
| 3800 | fraxinus\|11v1\|SRR058827.108943_P1 | 7304 | 673 | 86.1 | globlastp |
| 3801 | fraxinus\|11v1\|SRR058827.112759XX1_P1 | 7305 | 673 | 86.1 | globlastp |
| 3802 | olea\|11v1\|SRR014463.10448 | 7306 | 673 | 86.1 | globlastp |
| 3803 | olea\|13v1\|SRR014463X10448D1_P1 | 7307 | 673 | 86.1 | globlastp |
| 3804 | phyla\|11v2\|SRR099035X151618_P1 | 7308 | 673 | 86.1 | globlastp |
| 3805 | sesame\|12v1\|JK050928 | 7309 | 673 | 86.1 | globlastp |
| 3806 | phyla\|11v2\|SRR099037X276914_T1 | 7310 | 673 | 85.42 | glotblastn |
| 3807 | sesame\|12v1\|SESI12V1356115 | 7311 | 673 | 85.4 | globlastp |
| 3808 | triphysaria\|10v1\|EX997442 | 7312 | 673 | 85.4 | globlastp |
| 3809 | blueberry\|12v1\|CV191473_P1 | 7313 | 673 | 84.8 | globlastp |
| 3810 | blueberry\|12v1\|SRR353282X102149D1_P1 | 7313 | 673 | 84.8 | globlastp |
| 3811 | blueberry\|12v1\|SRR353282X17149D1_P1 | 7314 | 673 | 84.8 | globlastp |
| 3812 | blueberry\|12v1\|SRR353282X66118D1_P1 | 7314 | 673 | 84.8 | globlastp |
| 3813 | platanus\|11v1\|SRR096786X104548_P1 | 7315 | 673 | 84.8 | globlastp |
| 3814 | platanus\|11v1\|SRR096786X127843_P1 | 7316 | 673 | 84.8 | globlastp |
| 3815 | nicotiana_benthamiana\|12v1\|FG637079_T1 | 7317 | 673 | 84.72 | glotblastn |
| 3816 | cucurbita\|11v1\|SRR091276X10598_P1 | 7318 | 673 | 84.2 | globlastp |
| 3817 | phalaenopsis\|11v1\|CB034306_P1 | 7319 | 673 | 84.2 | globlastp |
| 3818 | sarracenia\|11v1\|SRR192669.141782 | 7320 | 673 | 84.2 | globlastp |
| 3819 | watermelon\|11v1\|VMEL00232223443500 | 7321 | 673 | 84.2 | globlastp |
| 3820 | fraxinus\|11v1\|SRR058827.115881_T1 | 7322 | 673 | 84.03 | glotblastn |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 3821 | coffea\|10v1\|DV672264_P1 | 7323 | 673 | 84 | globlastp |
| 3822 | phyla\|11v2\|SRR099037X112957_P1 | 7324 | 673 | 84 | globlastp |
| 3823 | vinca\|11v1\|SRR098690X103362 | 7325 | 673 | 84 | globlastp |
| 3824 | vinca\|11v1\|SRR098690X197340 | 7326 | 673 | 84 | globlastp |
| 3825 | melon\|10v1\|DV634597_P1 | 7327 | 673 | 83.6 | globlastp |
| 3826 | momordica\|10v1\|SRR071315S0002594_P1 | 7328 | 673 | 83.6 | globlastp |
| 3827 | pigeonpea\|11v1\|SRR054580X113200_P1 | 7329 | 673 | 83.6 | globlastp |
| 3828 | ambrosia\|11v1\|SRR346935.1550_P1 | 7330 | 673 | 83.4 | globlastp |
| 3829 | blueberry\|12v1\|SRR353282X101052D1_P1 | 7331 | 673 | 83.4 | globlastp |
| 3830 | chelidonium\|11v1\|SRR084752X106486_P1 | 7332 | 673 | 83.4 | globlastp |
| 3831 | onion\|12v1\|SRR073446X111946D1_P1 | 7333 | 673 | 83.4 | globlastp |
| 3832 | onion\|12v1\|SRR073446X346775D1_P1 | 7333 | 673 | 83.4 | globlastp |
| 3833 | parthenium\|10v1\|GW777925_P1 | 7330 | 673 | 83.4 | globlastp |
| 3834 | apple\|11v1\|CN994802_P1 | 7334 | 673 | 83.1 | globlastp |
| 3835 | oil_palm\|11v1\|EY404310_P1 | 7335 | 673 | 83 | globlastp |
| 3836 | bruguiera\|gb166\|BP942698_P1 | 7336 | 673 | 82.9 | globlastp |
| 3837 | euphorbia\|11v1\|BP955493_P1 | 7337 | 673 | 82.9 | globlastp |
| 3838 | flaveria\|11v1\|SRR149229.101882_P1 | 7338 | 673 | 82.9 | globlastp |
| 3839 | flaveria\|11v1\|SRR149232.120155_P1 | 7339 | 673 | 82.9 | globlastp |
| 3840 | oil_palm\|11v1\|SRR190698.121788_P1 | 7340 | 673 | 82.9 | globlastp |
| 3841 | sunflower\|12v1\|CD847151 | 7341 | 673 | 82.9 | globlastp |
| 3842 | sunflower\|12v1\|CF077747 | 7341 | 673 | 82.9 | globlastp |
| 3843 | watermelon\|11v1\|DV634597 | 7342 | 673 | 82.9 | globlastp |
| 3844 | kiwi\|gb166\|FG402684_P1 | 7343 | 673 | 82.8 | globlastp |
| 3845 | sunflower\|12v1\|AJ828557 | 7344 | 673 | 82.8 | globlastp |
| 3846 | sunflower\|12v1\|EE650599 | 7345 | 673 | 82.8 | globlastp |
| 3847 | fraxinus\|11v1\|SRR058827.129416_P1 | 7346 | 673 | 82.6 | globlastp |
| 3848 | lettuce\|12v1\|DW045150_P1 | 7347 | 673 | 82.3 | globlastp |
| 3849 | artemisia\|10v1\|EY046558_P1 | 7348 | 673 | 82.2 | globlastp |
| 3850 | banana\|12v1\|FF560328_P1 | 7349 | 673 | 82.2 | globlastp |
| 3851 | cassava\|09v1\|DV445147_P1 | 7350 | 673 | 82.2 | globlastp |
| 3852 | cucurbita\|11v1\|SRR091276X115032_P1 | 7351 | 673 | 82.2 | globlastp |
| 3853 | euphorbia\|11v1\|DV113111_P1 | 7352 | 673 | 82.2 | globlastp |
| 3853 | spurge\|gb161\|DV113111 | 7352 | 673 | 82.2 | globlastp |
| 3854 | poplar\|10v1\|AI162987 | 7353 | 673 | 82.2 | globlastp |
| 3855 | poplar\|13v1\|AI162987_P1 | 7353 | 673 | 82.2 | globlastp |
| 3856 | sunflower\|12v1\|EE653266 | 7354 | 673 | 82.2 | globlastp |
| 3857 | sarracenia\|11v1\|SRR192669.100134 | 7355 | 673 | 82.19 | glotblastn |
| 3858 | peach\|gb157.2\|DY639276_P1 | 7356 | 673 | 82.1 | globlastp |
| 3859 | prunus\|10v1\|CN994802 | 7356 | 673 | 82.1 | globlastp |
| 3860 | strawberry\|11v1\|EX658203 | 7357 | 673 | 82.1 | globlastp |
| 3861 | amsonia\|11v1\|SRR098688X106478_P1 | 7358 | 673 | 81.9 | globlastp |
| 3862 | antirrhinum\|gb166\|AJ790220_P1 | 7359 | 673 | 81.9 | globlastp |
| 3863 | ipomoea_nil\|10v1\|CJ745389_P1 | 7360 | 673 | 81.9 | globlastp |
| 3864 | cichorium\|gb171\|EH701034_P1 | 7361 | 673 | 81.6 | globlastp |
| 3865 | guizotia\|10v1\|GE561736_T1 | 7362 | 673 | 81.51 | glotblastn |
| 3866 | ambrosia\|11v1\|SRR346943.108668_P1 | 7363 | 673 | 81.5 | globlastp |
| 3867 | ambrosia\|11v1\|SRR346947.123392_P1 | 7364 | 673 | 81.5 | globlastp |
| 3868 | banana\|12v1\|FF558025_P1 | 7365 | 673 | 81.5 | globlastp |
| 3869 | cucumber\|09v1\|DV634597_P1 | 7366 | 673 | 81.5 | globlastp |
| 3870 | flaveria\|11v1\|SRR149229.46654_P1 | 7367 | 673 | 81.5 | globlastp |
| 3871 | aristolochia\|10v1\|SRR039082S0013912_P1 | 7368 | 673 | 81.4 | globlastp |
| 3872 | eucalyptus\|11v2\|CD669833_P1 | 7369 | 673 | 81.4 | globlastp |
| 3873 | grape\|11v1\|GSVIVT01010613001_P1 | 7370 | 673 | 81.4 | globlastp |
| 3874 | oak\|10v1\|FP027819_P1 | 7371 | 673 | 81.4 | globlastp |
| 3875 | onion\|12v1\|SRR073446X118851D1_P1 | 7372 | 673 | 81.4 | globlastp |
| 3876 | rose\|12v1\|SRR397984.109724 | 7373 | 673 | 81.4 | globlastp |
| 3877 | ginger\|gb164\|DY349157_T1 | 7374 | 673 | 81.38 | glotblastn |
| 3878 | gerbera\|09v1\|AJ754249_P1 | 7375 | 673 | 81.2 | globlastp |
| 3879 | primula\|11v1\|SRR098679X104604_P1 | 7376 | 673 | 81.2 | globlastp |
| 3880 | cassava\|09v1\|CK645566_P1 | 7377 | 673 | 80.8 | globlastp |
| 3881 | euonymus\|11v1\|SRR070038X136396_P1 | 7378 | 673 | 80.8 | globlastp |
| 3882 | euonymus\|11v1\|SRR070038X141580_P1 | 7379 | 673 | 80.8 | globlastp |
| 3883 | flaveria\|11v1\|SRR149241.115333_P1 | 7380 | 673 | 80.8 | globlastp |
| 3884 | pigeonpea\|11v1\|SRR054580X106914_P1 | 7381 | 673 | 80.8 | globlastp |
| 3885 | poplar\|10v1\|CK117372 | 7382 | 673 | 80.8 | globlastp |
| 3886 | poplar\|13v1\|CK117372_P1 | 7382 | 673 | 80.8 | globlastp |
| 3887 | tripterygium\|11v1\|SRR098677X118682 | 7383 | 673 | 80.8 | globlastp |
| 3888 | cirsium\|11v1\|SRR346952.116865_P1 | 7384 | 673 | 80.7 | globlastp |
| 3889 | eschscholzia\|11v1\|SRR014116.117187_P1 | 7385 | 673 | 80.7 | globlastp |
| 3890 | humulus\|11v1\|ES653528_P1 | 7386 | 673 | 80.7 | globlastp |
| 3891 | onion\|12v1\|SRR073446X11066D1_P1 | 7387 | 673 | 80.7 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 3892 | beech\|11v1\|SRR006293.23858_T1 | 7388 | 673 | 80.69 | glotblastn |
| 3893 | cirsium\|11v1\|SRR346952.1090555_P1 | 7389 | 673 | 80.3 | globlastp |
| 3894 | cynara\|gb167\|GE586553_P1 | 7390 | 673 | 80.3 | globlastp |
| 3895 | cynara\|gb167\|GE591412_P1 | 7391 | 673 | 80.3 | globlastp |
| 3896 | medicago\|12v1\|BE315728_P1 | 7392 | 673 | 80.3 | globlastp |
| 3897 | trigonella\|11v1\|SRR066194X152657 | 7393 | 673 | 80.3 | globlastp |
| 3898 | avocado\|10v1\|FD508333_T1 | 7394 | 673 | 80.27 | glotblastn |
| 3899 | clementine\|11v1\|CF417220_P1 | 7395 | 673 | 80.1 | globlastp |
| 3900 | euonymus\|11v1\|SRR070038X134316_P1 | 7396 | 673 | 80.1 | globlastp |
| 3901 | euonymus\|11v1\|SRR070038X175696_P1 | 7397 | 673 | 80.1 | globlastp |
| 3902 | foxtail_millet\|11v3\|PHY7SI037339M_P1 | 7398 | 673 | 80.1 | globlastp |
| 3903 | hornbeam\|12v1\|SRR364455.10539_P1 | 7399 | 673 | 80.1 | globlastp |
| 3904 | orange\|11v1\|CF417220_P1 | 7395 | 673 | 80.1 | globlastp |
| 3905 | rice\|11v1\|BI800003 | 7400 | 673 | 80.1 | globlastp |
| 3906 | walnuts\|gb166\|EL892024 | 7401 | 673 | 80.1 | globlastp |
| 3907 | prunus_mume\|13v1\|DY639276_P1 | 7402 | 673 | 80 | globlastp |
| 3908 | acacia\|10v1\|GR481215_P1 | 7403 | 673 | 80 | globlastp |
| 3909 | amorphophallus\|11v2\|SRR089351X121955_P1 | 7404 | 673 | 80 | globlastp |
| 3910 | aquilegia\|10v2\|JGIAC024478_T1 | 7405 | 673 | 80 | glotblastn |
| 3911 | chestnut\|gb170\|SRR006295S0000818_P1 | 7406 | 673 | 80 | globlastp |
| 3912 | eschscholzia\|11v1\|SRR014116.113832_P1 | 7407 | 673 | 80 | globlastp |
| 3913 | nasturtium\|11v1\|GH169570_P1 | 7408 | 673 | 80 | globlastp |
| 3914 | oak\|10v1\|DB997979_P1 | 7409 | 673 | 80 | globlastp |
| 3915 | solanum_phureja\|09v1\|SPHAW034456 | 7410 | 674 | 96.6 | globlastp |
| 3916 | potato\|10v1\|CK245349_P1 | 7411 | 674 | 94.9 | globlastp |
| 3917 | eggplant\|10v1\|FS007122_P1 | 7412 | 674 | 88.7 | globlastp |
| 3918 | nicotiana_benthamiana\|12v1\|BP745922_P1 | 7413 | 674 | 88.1 | globlastp |
| 3919 | nicotiana_benthamiana\|12v1\|EH369150_P1 | 7414 | 674 | 87.6 | globlastp |
| 3920 | pepper\|12v1\|GD060497_T1 | 7415 | 674 | 87.01 | glotblastn |
| 3921 | potato\|10v1\|BQ514168_P1 | 7416 | 675 | 98.1 | globlastp |
| 3922 | solanum_phureja\|09v1\|SPHAW617278 | 7417 | 675 | 97.2 | globlastp |
| 3923 | pepper\|12v1\|GD080968_P1 | 7418 | 675 | 89.3 | globlastp |
| 3924 | nicotiana_benthamiana\|12v1\|EB429811_P1 | 7419 | 675 | 87.1 | globlastp |
| 3925 | tobacco\|gb162\|EB429811 | 7420 | 675 | 85.19 | glotblastn |
| 3926 | potato\|10v1\|CV491855_P1 | 7421 | 676 | 92.5 | globlastp |
| 3927 | solanum_phureia\|09v1\|SPHBG136313 | 7422 | 676 | 92.5 | globlastp |
| 3928 | eggplant\|10v1\|FS056643_P1 | 7423 | 676 | 90 | globlastp |
| 3929 | pepper\|12v1\|GD064989_P1 | 7424 | 676 | 90 | globlastp |
| 3930 | tobacco\|gb162\|DW004195 | 7425 | 676 | 89.6 | globlastp |
| 3931 | nicotiana_benthamiana\|12v1\|FG642673_P1 | 7426 | 676 | 89.1 | globlastp |
| 3932 | nicotiana_benthamiana\|12v1\|DV999162_P1 | 7427 | 676 | 88.1 | globlastp |
| 3933 | potato\|10v1\|BG596489_P1 | 7428 | 677 | 98.8 | globlastp |
| 3934 | solanum_phureia\|09v1\|SPHBG734868 | 7429 | 677 | 98.8 | globlastp |
| 3935 | eggplant\|10v1\|FS016659_P1 | 7430 | 677 | 96.4 | globlastp |
| 3936 | tobacco\|gb162\|CV020268 | 7431 | 677 | 96.4 | globlastp |
| 3937 | nicotiana_benthamiana\|12v1\|CK990177_P1 | 7432 | 677 | 95.2 | globlastp |
| 3938 | pepper\|12v1\|CA515174_P1 | 7433 | 677 | 94.1 | globlastp |
| 3939 | petunia\|gb171\|CV299571_P1 | 7434 | 677 | 94 | globlastp |
| 3940 | coffea\|10v1\|DV692487_P1 | 7435 | 677 | 89.4 | globlastp |
| 3941 | olea\|13v1\|SRR014464X31367D1_P1 | 7436 | 677 | 89.3 | globlastp |
| 3942 | ipomoea_batatas\|10v1\|BU691677_P1 | 7437 | 677 | 89.3 | globlastp |
| 3943 | fraxinus\|11v1\|SRR058827.107993_P1 | 7438 | 677 | 88.1 | globlastp |
| 3944 | fraxinus\|11v1\|SRR058827.190612_P1 | 7438 | 677 | 88.1 | globlastp |
| 3945 | ipomoea_nil\|10v1\|BJ553531_P1 | 7439 | 677 | 88.1 | globlastp |
| 3946 | olea\|11v1\|SRR014463.11310 | 7438 | 677 | 88.1 | globlastp |
| 3947 | olea\|13v1\|SRR014463X11310D1_P1 | 7438 | 677 | 88.1 | globlastp |
| 3948 | lettuce\|12v1\|DW066365_P1 | 7440 | 677 | 87.1 | globlastp |
| 3949 | amsonia\|11v1\|SRR098688X117039_P1 | 7441 | 677 | 86.9 | globlastp |
| 3950 | catharanthus\|11v1\|SRR098691X137558_P1 | 7442 | 677 | 86.9 | globlastp |
| 3951 | centaurea\|gb166\|EH711371 | 7443 | 677 | 86.9 | globlastp |
| 3952 | centaurea\|11v1\|EH711371_T1 | 7444 | 677 | 86.9 | glotblastn |
| 3953 | centaurea\|gb166\|EH740490 | 7443 | 677 | 86.9 | globlastp |
| 3954 | cirsium\|11v1\|SRR346952.1000422T1 | 7445 | 677 | 86.9 | glotblastn |
| 3955 | cirsium\|11v1\|SRR346952.106666_P1 | 7443 | 677 | 86.9 | globlastp |
| 3956 | safflower\|gb162\|EL407633 | 7446 | 677 | 86.9 | globlastp |
| 3957 | sunflower\|12v1\|CD850724 | 7443 | 677 | 86.9 | globlastp |
| 3958 | tabernaemontana\|11v1\|SRR098689X105890 | 7447 | 677 | 86.9 | globlastp |
| 3959 | sunflower\|12v1\|CD849196 | 7448 | 677 | 86 | globlastp |
| 3960 | dandelion\|10v1\|DR399089_P1 | 7449 | 677 | 85.9 | globlastp |
| 3961 | artemisia\|10v1\|GW329794_T1 | 7450 | 677 | 85.88 | glotblastn |
| 3962 | fraxinus\|11v1\|SRR058827.105367_T1 | 7451 | 677 | 85.71 | glotblastn |
| 3963 | ipomoea_batatas\|10v1\|DV036634_T1 | 7452 | 677 | 85.71 | glotblastn |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 3964 | arabidopsis_lyrata\|09v1\|JGIAL016191_P1 | 7453 | 677 | 85.7 | globlastp |
| 3965 | aristolochia\|10v1\|SRR039083S0162197_P1 | 7454 | 677 | 85.7 | globlastp |
| 3966 | flaveria\|11v1\|SRR149244.111421_P1 | 7455 | 677 | 85.7 | globlastp |
| 3967 | guizotia\|10v1\|GE571049_P1 | 7456 | 677 | 85.7 | globlastp |
| 3968 | phyla\|11v2\|SRR099035X10210_P1 | 7457 | 677 | 85.7 | globlastp |
| 3969 | phyla\|11v2\|SRR099037X107040_P1 | 7458 | 677 | 85.7 | globlastp |
| 3970 | platanus\|11v1\|SRR096786X107756_P1 | 7459 | 677 | 84.7 | globlastp |
| 3971 | platanus\|11v1\|SRR096786X116200_P1 | 7460 | 677 | 84.7 | globlastp |
| 3972 | b_oleracea\|gb161\|AM394278_T1 | 7461 | 677 | 84.52 | glotblastn |
| 3973 | cacao\|10v1\|CA794604_T1 | 7462 | 677 | 84.52 | glotblastn |
| 3974 | ambrosia\|11v1\|SRR346943.10506_P1 | 7463 | 677 | 84.5 | globlastp |
| 3975 | b_juncea\|12v1\|E6ANDIZ01A7LR6_P1 | 7464 | 677 | 84.5 | globlastp |
| 3976 | blueberry\|12v1\|SRR353282X27890D1_P1 | 7465 | 677 | 84.5 | globlastp |
| 3977 | flaveria\|11v1\|SRR149229.103468_P1 | 7466 | 677 | 84.5 | globlastp |
| 3978 | monkeyflower\|10v1\|GO964950 | 7467 | 677 | 84.5 | globlastp |
| 3979 | monkeyflower\|12v1\|GO997762_P1 | 7467 | 677 | 84.5 | globlastp |
| 3980 | soybean\|11v1\|GLYMA03G37250 | 7468 | 677 | 84.5 | globlastp |
| 3981 | soybean\|12v1\|GLYMA03G37250_P1 | 7468 | 677 | 84.5 | globlastp |
| 3982 | thellungiella_halophilum\|11v1\|EHJGI11009624 | 7469 | 677 | 84.5 | globlastp |
| 3983 | thellungiella_parvulum\|11v1\|EPCRP016283 | 7470 | 677 | 84.5 | globlastp |
| 3984 | beech\|11v1\|SRR364434.196077_P1 | 7471 | 677 | 83.5 | globlastp |
| 3985 | chickpea\|11v1\|SRR133517.102541 | 7472 | 677 | 83.5 | globlastp |
| 3986 | chickpea\|13v2\|SRR133517.102541_P1 | 7472 | 677 | 83.5 | globlastp |
| 3987 | eucalyptus\|11v2\|SRR001659X130769_P1 | 7473 | 677 | 83.5 | globlastp |
| 3988 | tea\|10v1\|EU375562 | 7474 | 677 | 83.5 | globlastp |
| 3989 | castorbean\|12v1\|EE256065_T1 | 7475 | 677 | 83.33 | glotblastn |
| 3990 | antirrhinum\|gb166\|AJ790795_P1 | 7476 | 677 | 83.3 | globlastp |
| 3991 | arabidopsis_lyrata\|09v1\|TMPLAT3G62790T1_P1 | 7477 | 677 | 83.3 | globlastp |
| 3992 | arabidopsis\|10v1\|AT2G47690_P1 | 7478 | 677 | 83.3 | globlastp |
| 3993 | arabidopsis\|10v1\|AT3G62790_P1 | 7477 | 677 | 83.3 | globlastp |
| 3994 | b_oleracea\|gb161\|EE534469_P1 | 7479 | 677 | 83.3 | globlastp |
| 3995 | chestnut\|gb170\|SRR006295S0013415_P1 | 7480 | 677 | 83.3 | globlastp |
| 3996 | hornbeam\|12v1\|SRR364455.108791P1 | 7481 | 677 | 83.3 | globlastp |
| 3997 | orobanche\|10v1\|SRR023189S0000882_P1 | 7482 | 677 | 83.3 | globlastp |
| 3998 | salvia\|10v1\|SRR014553S0001603 | 7483 | 677 | 83.3 | globlastp |
| 3999 | sesame\|12v1\|SESI12Vl183062 | 7484 | 677 | 83.3 | globlastp |
| 4000 | thellungiella_halophilum\|11v1\|BY806974 | 7485 | 677 | 83.3 | globlastp |
| 4001 | ginseng\|10v1\|GR872098_P1 | 7486 | 677 | 82.8 | globlastp |
| 4002 | poplar\|10v1\|BU814197 | 7487 | 677 | 82.6 | globlastp |
| 4003 | poplar\|13v1\|BU814197_P1 | 7487 | 677 | 82.6 | globlastp |
| 4004 | castorbean\|12v1\|SRR020785.12360_P1 | 7488 | 677 | 82.4 | globlastp |
| 4005 | oil_palm\|11v1\|EL687328_P1 | 7489 | 677 | 82.4 | globlastp |
| 4006 | sarracenia\|11v1\|SRR192669.113844 | 7490 | 677 | 82.4 | globlastp |
| 4007 | bean\|12v2\|CA899125_P1 | 7491 | 677 | 82.1 | globlastp |
| 4008 | aquilegia\|10v2\|JGIAC017903_P1 | 7492 | 677 | 82.1 | globlastp |
| 4009 | arabidopsis_lyrata\|09v1\|JGIAL019629_P1 | 7493 | 677 | 82.1 | globlastp |
| 4010 | b_rapa\|11v1\|CD813402_P1 | 7494 | 677 | 82.1 | globlastp |
| 4011 | bean\|12v1\|CA899125 | 7491 | 677 | 82.1 | globlastp |
| 4012 | cleome_gynandra\|10v1\|SRR015532S0037183_P1 | 7495 | 677 | 82.1 | globlastp |
| 4013 | cleome_spinosa\|10v1\|GR933599_P1 | 7496 | 677 | 82.1 | globlastp |
| 4014 | cowpea\|12v1\|FF391544_P1 | 7497 | 677 | 82.1 | globlastp |
| 4015 | epimedium\|11v1\|SRR013502.18250_P1 | 7498 | 677 | 82.1 | globlastp |
| 4016 | euonymus\|11v1\|SRR070038X129578_P1 | 7499 | 677 | 82.1 | globlastp |
| 4017 | flaveria\|11v1\|SRR149241.351805_P1 | 7500 | 677 | 82.1 | globlastp |
| 4018 | liquorice\|gb171\|FS244458_P1 | 7501 | 677 | 82.1 | globlastp |
| 4019 | medicago\|12v1\|AL380702_P1 | 7502 | 677 | 82.1 | globlastp |
| 4020 | monkeyflower\|10v1\|DV212834 | 7503 | 677 | 82.1 | globlastp |
| 4021 | monkeyflower\|12v1\|DV212834_P1 | 7503 | 677 | 82.1 | globlastp |
| 4022 | oak\|10v1\|DN950929_P1 | 7504 | 677 | 82.1 | globlastp |
| 4023 | primula\|11v1\|SRR098681X50499_P1 | 7505 | 677 | 82.1 | globlastp |
| 4024 | radish\|gb164\|EV525126 | 7506 | 677 | 82.1 | globlastp |
| 4025 | soybean\|11v1\|GLYMA19G39860 | 7507 | 677 | 82.1 | globlastp |
| 4026 | soybean\|12v1\|GLYMA19G39860_P1 | 7507 | 677 | 82.1 | globlastp |
| 4027 | thellungiella_parvulum\|11v1\|BY806974 | 7494 | 677 | 82.1 | globlastp |
| 4028 | triphysaria\|10v1\|EY139435 | 7508 | 677 | 82.1 | globlastp |
| 4029 | triphysaria\|10v1\|SRR023500S0005824 | 7509 | 677 | 82.1 | globlastp |
| 4030 | humulus\|11v1\|ES653674_P1 | 7510 | 677 | 81.6 | globlastp |
| 4031 | utricularia\|11v1\|SRR094438.10063 | 7511 | 677 | 81.4 | globlastp |
| 4032 | amorphophallus\|11v2\|SRR089351X126092_P1 | 7512 | 677 | 81.2 | globlastp |
| 4033 | cassava\|09v1\|JGICASSAVA1175VALIDM1_P1 | 7513 | 677 | 81.2 | globlastp |
| 4034 | cotton\|11v1\|AI726094_P1 | 7514 | 677 | 81.2 | globlastp |
| 4035 | gossypium_raimondii\|12v1\|AI726094_P1 | 7514 | 677 | 81.2 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 4036 | heritiera\|10v1\|SRR005795S0009085_P1 | 7515 | 677 | 81.2 | globlastp |
| 4037 | pigeonpea\|11v1\|GW355058_P1 | 7516 | 677 | 81.2 | globlastp |
| 4038 | rose\|12v1\|EC587736 | 7517 | 677 | 81.2 | globlastp |
| 4039 | fraxinus\|11v1\|SRR058827.108012_T1 | 7518 | 677 | 81.18 | glotblastn |
| 4040 | acacia\|10v1\|GR482262_P1 | 7519 | 677 | 81 | globlastp |
| 4041 | b_juncea\|12v1\|E6ANDIZ01C6DZO_P1 | 7520 | 677 | 81 | globlastp |
| 4042 | canola\|11v1\|CN732165_P1 | 7521 | 677 | 81 | globlastp |
| 4043 | lotus\|09v1\|BF177508_P1 | 7522 | 677 | 81 | globlastp |
| 4044 | poppy\|11v1\|SRR030259.116296_P1 | 7523 | 677 | 81 | globlastp |
| 4045 | radish\|gb164\|EV538661 | 7524 | 677 | 81 | globlastp |
| 4046 | radish\|gb164\|EV543647 | 7525 | 677 | 81 | globlastp |
| 4047 | radish\|gb164\|EW723879 | 7526 | 677 | 81 | globlastp |
| 4048 | trigonella\|11v1\|SRR066194X114302 | 7527 | 677 | 81 | globlastp |
| 4049 | b_rapa\|11v1\|CD816662_T1 | 7528 | 677 | 80.95 | glotblastn |
| 4050 | b_rapa\|11v1\|CD817758_T1 | 7529 | 677 | 80.95 | glotblastn |
| 4051 | canola\|11v1\|DW999649XX2_T1 | 7530 | 677 | 80.95 | glotblastn |
| 4052 | cotton\|11v1\|BF274690_T1 | 7531 | 677 | 80.95 | glotblastn |
| 4053 | gossypium_raimondii\|12v1\|BF274690_T1 | 7532 | 677 | 80.95 | glotblastn |
| 4054 | grape\|11v1\|GSVIVT01035146001_P1 | 7533 | 677 | 80.5 | globlastp |
| 4055 | liquorice\|gb171\|FS239994_P1 | 7534 | 677 | 80.5 | globlastp |
| 4056 | apple\|11v1\|CN491129_P1 | 7535 | 677 | 80.2 | globlastp |
| 4057 | peach\|gb157.2\|AJ827105_T1 | 7536 | 677 | 80 | glotblastn |
| 4058 | prunus_mume\|13v1\|SRR345674.52578_T1 | 7536 | 677 | 80 | glotblastn |
| 4059 | b_juncea\|12v1\|E6ANDIZ01B371N_P1 | 7537 | 677 | 80 | globlastp |
| 4060 | cassava\|09v1\|DB924993_P1 | 7538 | 677 | 80 | globlastp |
| 4061 | chelidonium\|11v1\|SRR084752X13675_P1 | 7539 | 677 | 80 | globlastp |
| 4062 | cotton\|11v1\|BE053626_P1 | 7540 | 677 | 80 | globlastp |
| 4063 | cotton\|11v1\|SRR032367.1014115_P1 | 7540 | 677 | 80 | globlastp |
| 4064 | gossypium_raimondii\|12v1\|BE053626_P1 | 7540 | 677 | 80 | globlastp |
| 4065 | prunus\|10v1\|CN491129 | 7536 | 677 | 80 | glotblastn |
| 4066 | strawberry\|11v1\|DV439027 | 7541 | 677 | 80 | globlastp |
| 4067 | wheat\|12v3\|BE415081 | 7542 | 678 | 85.41 | glotblastn |
| 4068 | rye\|12v1\|BE636808 | 7543 | 678 | 85.3 | globlastp |
| 4069 | rye\|12v1\|DRR001012.266258 | 7544 | 678 | 85.3 | globlastp |
| 4070 | rye\|12v1\|DRR001012.1483 | 7545 | 678 | 81.59 | glotblastn |
| 4071 | barley\|12v1\|BE420812_P1 | 7546 | 679 | 98.5 | globlastp |
| 4072 | barley\|12v1\|BI950339_P1 | 7546 | 679 | 98.5 | globlastp |
| 4073 | leymus\|gb166\|CD809189_P1 | 7546 | 679 | 98.5 | globlastp |
| 4074 | rye\|12v1\|BE636868 | 7547 | 679 | 98.5 | globlastp |
| 4075 | rye\|12v1\|DRR001012.100149 | 7547 | 679 | 98.5 | globlastp |
| 4076 | rye\|12v1\|DRR001012.101034 | 7547 | 679 | 98.5 | globlastp |
| 4077 | rye\|12v1\|DRR001012.107227 | 7547 | 679 | 98.5 | globlastp |
| 4078 | rye\|12v1\|DRR001012.110963 | 7547 | 679 | 98.5 | globlastp |
| 4079 | rye\|12v1\|DRR001012.149209 | 7547 | 679 | 98.5 | globlastp |
| 4080 | rye\|12v1\|DRR001012.155634 | 7547 | 679 | 98.5 | globlastp |
| 4081 | rye\|12v1\|DRR001012.173348 | 7547 | 679 | 98.5 | globlastp |
| 4082 | wheat\|12v3\|BE213361 | 7547 | 679 | 98.5 | globlastp |
| 4083 | wheat\|12v3\|BE213541 | 7547 | 679 | 98.5 | globlastp |
| 4084 | wheat\|12v3\|BE217061 | 7547 | 679 | 98.5 | globlastp |
| 4085 | wheat\|12v3\|BE412383 | 7547 | 679 | 98.5 | globlastp |
| 4086 | wheat\|12v3\|BE417966 | 7547 | 679 | 98.5 | globlastp |
| 4087 | wheat\|12v3\|BE418325 | 7547 | 679 | 98.5 | globlastp |
| 4088 | wheat\|12v3\|BE425441 | 7547 | 679 | 98.5 | globlastp |
| 4089 | wheat\|12v3\|BE604046 | 7548 | 679 | 98.5 | globlastp |
| 4090 | wheat\|12v3\|BF478899 | 7547 | 679 | 98.5 | globlastp |
| 4091 | leymus\|gb166\|EG391011_P1 | 7549 | 679 | 98.1 | globlastp |
| 4092 | lolium\|10v1\|AU246390_P1 | 7550 | 679 | 98.1 | globlastp |
| 4093 | oat\|11v1\|CN818158_P1 | 7551 | 679 | 98.1 | globlastp |
| 4094 | oat\|11v1\|SRR020741.132872_P1 | 7551 | 679 | 98.1 | globlastp |
| 4095 | rye\|12v1\|DRR001012.882529 | 7552 | 679 | 98.1 | glotblastn |
| 4096 | wheat\|12v3\|BE213314 | 7553 | 679 | 98.1 | globlastp |
| 4097 | wheat\|12v3\|BG313648 | 7554 | 679 | 97.72 | glotblastn |
| 4098 | oat\|11v1\|CN818384_P1 | 7555 | 679 | 97.3 | globlastp |
| 4099 | rye\|12v1\|DRR001012.371748 | 7556 | 679 | 96.6 | globlastp |
| 4100 | wheat\|12v3\|BE425237 | 7557 | 679 | 96.6 | globlastp |
| 4101 | rye\|12v1\|DRR001012.338927 | 7558 | 679 | 94.72 | glotblastn |
| 4102 | rice\|11v1\|AF022739 | 7559 | 679 | 94.7 | globlastp |
| 4103 | switchgrass\|12v1\|SRR187768.89507_P1 | 7560 | 679 | 91.7 | globlastp |
| 4104 | maize\|10v1\|MZEORFI_P1 | 7561 | 679 | 91.7 | globlastp |
| 4105 | millet\|10v1\|EB410931_P1 | 7562 | 679 | 91.7 | globlastp |
| 4106 | switchgrass\|12v1\|DN143440_P1 | 7560 | 679 | 91.7 | globlastp |
| 4107 | switchgrass\|gb167\|DN143440 | 7560 | 679 | 91.7 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 4108 | foxtail_millet\|11v3\|PHY7SI037076M_P1 | 7563 | 679 | 91.3 | globlastp |
| 4109 | sorghum\|12v1\|AW283115 | 7564 | 679 | 91.3 | globlastp |
| 4110 | sorghum\|12v1\|SB01G015400 | 7564 | 679 | 91.3 | globlastp |
| 4111 | switchgrass\|12v1\|DN144083_T1 | 7565 | 679 | 90.57 | glotblastn |
| 4112 | switchgrass\|12v1\|DN147434_T1 | 7566 | 679 | 90.57 | glotblastn |
| 4113 | cynodon\|10v1\|ES292265_P1 | 7567 | 679 | 90.5 | globlastp |
| 4114 | lovegrass\|gb167\|DN480829_P1 | 7568 | 679 | 89 | globlastp |
| 4115 | oil_palm\|11v1\|SRR190698.280201_P1 | 7569 | 679 | 89 | globlastp |
| 4116 | antirrhinum\|gb166\|AJ568367_P1 | 7570 | 679 | 88.8 | globlastp |
| 4117 | aristolochia\|10v1\|SRR039085S0197472_P1 | 7571 | 679 | 88.7 | globlastp |
| 4118 | cucurbita\|11v1\|SRR091276X104071_P1 | 7572 | 679 | 88.7 | globlastp |
| 4119 | kiwi\|gb166\|FG397198_P1 | 7573 | 679 | 88.3 | globlastp |
| 4120 | liriodendron\|gb166\|CK767175_P1 | 7574 | 679 | 88.3 | globlastp |
| 4121 | cucumber\|09v1\|AA660116_P1 | 7575 | 679 | 88 | globlastp |
| 4122 | flaveria\|11v1\|SRR149232.119275_P1 | 7576 | 679 | 88 | globlastp |
| 4123 | poplar\|10v1\|AI164040 | 7577 | 679 | 88 | globlastp |
| 4124 | tea\|10v1\|CV013768 | 7578 | 679 | 88 | globlastp |
| 4125 | wheat\|12v3\|CJ716221 | 7579 | 679 | 87.8 | globlastp |
| 4126 | poplar\|13v1\|AI162183_P1 | 7580 | 679 | 87.6 | globlastp |
| 4127 | ambrosia\|11v1\|SRR346943.12315_P1 | 7581 | 679 | 87.6 | globlastp |
| 4128 | cannabis\|12v1\|EW700699_P1 | 7582 | 679 | 87.6 | globlastp |
| 4129 | cannabis\|12v1\|GR221144_P1 | 7582 | 679 | 87.6 | globlastp |
| 4130 | chestnut\|gb170\|AF417304_P1 | 7583 | 679 | 87.6 | globlastp |
| 4131 | eschscholzia\|11v1\|CK764821_P1 | 7584 | 679 | 87.6 | globlastp |
| 4132 | flaveria\|11v1\|SRR149229.103066_P1 | 7585 | 679 | 87.6 | globlastp |
| 4133 | flaveria\|11v1\|SRR149229.133211_P1 | 7585 | 679 | 87.6 | globlastp |
| 4134 | flaveria\|11v1\|SRR149229.26461XX1_P1 | 7585 | 679 | 87.6 | globlastp |
| 4135 | flaveria\|11v1\|SRR149232.115148_P1 | 7585 | 679 | 87.6 | globlastp |
| 4136 | flaveria\|11v1\|SRR149232.145844_P1 | 7586 | 679 | 87.6 | globlastp |
| 4137 | flaveria\|11v1\|SRR149232.190929_P1 | 7585 | 679 | 87.6 | globlastp |
| 4138 | flaveria\|11v1\|SRR149241.10181_P1 | 7585 | 679 | 87.6 | globlastp |
| 4139 | grape\|11v1\|GSVIVT01030053001_P1 | 7587 | 679 | 87.6 | globlastp |
| 4140 | jatropha\|09v1\|GH295683_P1 | 7588 | 679 | 87.6 | globlastp |
| 4141 | melon\|10v1\|CF674904_P1 | 7589 | 679 | 87.6 | globlastp |
| 4142 | oak\|10v1\|CU657887_P1 | 7583 | 679 | 87.6 | globlastp |
| 4143 | oak\|10v1\|CU657896_P1 | 7583 | 679 | 87.6 | globlastp |
| 4144 | oak\|10v1\|DB996682_P1 | 7583 | 679 | 87.6 | globlastp |
| 4145 | oak\|10v1\|DB998065_P1 | 7583 | 679 | 87.6 | globlastp |
| 4146 | oak\|10v1\|FN718861_P1 | 7583 | 679 | 87.6 | globlastp |
| 4147 | oak\|10v1\|FP045120_P1 | 7583 | 679 | 87.6 | globlastp |
| 4148 | oak\|10v1\|SRR006307S0007311_P1 | 7583 | 679 | 87.6 | globlastp |
| 4149 | oak\|10v1\|SRR039734S0015335_P1 | 7583 | 679 | 87.6 | globlastp |
| 4150 | oak\|10v1\|SRR039734S0080903_P1 | 7583 | 679 | 87.6 | globlastp |
| 4151 | oak\|10v1\|SRR039734S0086911_P1 | 7583 | 679 | 87.6 | globlastp |
| 4152 | oak\|10v1\|SRR039736S0009196_P1 | 7583 | 679 | 87.6 | globlastp |
| 4153 | oak\|10v1\|SRR039736S0072306_P1 | 7583 | 679 | 87.6 | globlastp |
| 4154 | oak\|10v1\|SRR039740S0045447_P1 | 7583 | 679 | 87.6 | globlastp |
| 4155 | orange\|11v1\|AF312227_P1 | 7590 | 679 | 87.6 | globlastp |
| 4156 | papaya\|gb165\|EX248933_P1 | 7591 | 679 | 87.6 | globlastp |
| 4157 | tripterygium\|11v1\|SRR098677X103515 | 7592 | 679 | 87.6 | globlastp |
| 4158 | poplar\|13v1\|BI069694_P1 | 7593 | 679 | 87.6 | globlastp |
| 4159 | scabiosa\|11v1\|SRR063723X100037 | 7594 | 679 | 87.5 | globlastp |
| 4160 | scabiosa\|11v1\|SRR063723X100386 | 7595 | 679 | 87.5 | globlastp |
| 4161 | clementine\|11v1\|AF312227_P1 | 7596 | 679 | 87.3 | globlastp |
| 4162 | sesame\|12v1\|SESI12V1397389 | 7597 | 679 | 87.3 | globlastp |
| 4163 | flaveria\|11v1\|SRR149232.287040_T1 | 7598 | 679 | 87.22 | glotblastn |
| 4164 | flaveria\|11v1\|SRR149232.443407_T1 | 7599 | 679 | 87.22 | glotblastn |
| 4165 | oak\|10v1\|FN755430_T1 | 7600 | 679 | 87.22 | glotblastn |
| 4166 | oak\|10v1\|SRR006309S0041356_T1 | 7601 | 679 | 87.22 | glotblastn |
| 4167 | peach\|gb157.2\|BU039212_P1 | 7602 | 679 | 87.2 | globlastp |
| 4168 | prunus_mume\|13v1\|BI203091_P1 | 7603 | 679 | 87.2 | globlastp |
| 4169 | ambrosia\|11v1\|SRR346935.117253_P1 | 7604 | 679 | 87.2 | globlastp |
| 4170 | ambrosia\|11v1\|SRR346935.147253_P1 | 7605 | 679 | 87.2 | globlastp |
| 4171 | apple\|11v1\|CN861354_P1 | 7606 | 679 | 87.2 | globlastp |
| 4172 | catharanthus\|11v1\|EG554220_P1 | 7607 | 679 | 87.2 | globlastp |
| 4173 | flaveria\|11v1\|SRR149229.166261_P1 | 7608 | 679 | 87.2 | globlastp |
| 4174 | fraxinus\|11v1\|SRR058827.100981_P1 | 7609 | 679 | 87.2 | globlastp |
| 4175 | onion\|12v1\|CF435462_P1 | 7610 | 679 | 87.2 | globlastp |
| 4176 | poplar\|10v1\|BI069694 | 7611 | 679 | 87.2 | globlastp |
| 4177 | primula\|11v1\|SRR098679X101097_P1 | 7612 | 679 | 87.2 | globlastp |
| 4178 | prunus\|10v1\|BI203091 | 7602 | 679 | 87.2 | globlastp |
| 4179 | sunflower\|12v1\|CD846630 | 7613 | 679 | 87.2 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 4180 | tobacco\|gb162\|CO046503 | 7614 | 679 | 87.2 | globlastp |
| 4181 | tobacco\|gb162\|CV015951 | 7615 | 679 | 87.2 | globlastp |
| 4182 | flaveria\|11v1\|SRR149229.102100_T1 | 7616 | 679 | 87.17 | glotblastn |
| 4183 | oak\|10v1\|DB998558_P1 | 7617 | 679 | 86.9 | globlastp |
| 4184 | oak\|10v1\|FP025055_P1 | 7617 | 679 | 86.9 | globlastp |
| 4185 | flaveria\|11v1\|SRR149241.235250_T1 | 7618 | 679 | 86.84 | glotblastn |
| 4186 | olea\|13v1\|SRR014463X10518D1_P1 | 7619 | 679 | 86.8 | globlastp |
| 4187 | ambrosia\|11v1\|SRR346935.103321_P1 | 7620 | 679 | 86.8 | globlastp |
| 4188 | apple\|11v1\|CN493989_P1 | 7621 | 679 | 86.8 | globlastp |
| 4189 | artemisia\|10v1\|EY033550_P1 | 7622 | 679 | 86.8 | globlastp |
| 4190 | chelidonium\|11v1\|SRR084752X101005_P1 | 7623 | 679 | 86.8 | globlastp |
| 4191 | cotton\|11v1\|AI055533_P1 | 7624 | 679 | 86.8 | globlastp |
| 4192 | cotton\|11v1\|CA992753_P1 | 7625 | 679 | 86.8 | globlastp |
| 4193 | cotton\|11v1\|SRR032799.214106_P1 | 7626 | 679 | 86.8 | globlastp |
| 4194 | dandelion\|10v1\|DY815081_P1 | 7627 | 679 | 86.8 | globlastp |
| 4195 | flaveria\|11v1\|SRR149232.100184_P1 | 7628 | 679 | 86.8 | globlastp |
| 4196 | flaveria\|11v1\|SRR149232.140133_P1 | 7629 | 679 | 86.8 | globlastp |
| 4197 | flaveria\|11v1\|SRR149232.26769_P1 | 7629 | 679 | 86.8 | globlastp |
| 4198 | flaveria\|11v1\|SRR149238.14417_P1 | 7629 | 679 | 86.8 | globlastp |
| 4199 | flaveria\|11v1\|SRR149238.21025_P1 | 7630 | 679 | 86.8 | globlastp |
| 4200 | flaveria\|11v1\|SRR149241.107004_P1 | 7629 | 679 | 86.8 | globlastp |
| 4201 | gossypium_raimondii\|12v1\|AI055533_P1 | 7624 | 679 | 86.8 | globlastp |
| 4202 | gossypium_raimondii\|12v1\|CA992753_P1 | 7631 | 679 | 86.8 | globlastp |
| 4203 | kiwi\|gb166\|FG403363_P1 | 7632 | 679 | 86.8 | globlastp |
| 4204 | nicotiana_benthamiana\|12v1\|CN655121_P1 | 7633 | 679 | 86.8 | globlastp |
| 4205 | nicotiana_benthamiana\|gb162\|CN655121 | 7633 | 679 | 86.8 | globlastp |
| 4206 | olea\|11v1\|SRR014463.10518 | 7634 | 679 | 86.8 | globlastp |
| 4207 | petunia\|gb171\|CV299277_P1 | 7635 | 679 | 86.8 | globlastp |
| 4208 | potato\|10v1\|BI405771_P1 | 7636 | 679 | 86.8 | globlastp |
| 4209 | solanum_phureja\|09v1\|SPHTOMCAB4A | 7636 | 679 | 86.8 | globlastp |
| 4210 | tobacco\|gb162\|AY219853 | 7637 | 679 | 86.8 | globlastp |
| 4211 | tripterygium\|11v1\|SRR098677X100129 | 7638 | 679 | 86.8 | globlastp |
| 4212 | walnuts\|gb166\|EL890970 | 7639 | 679 | 86.8 | globlastp |
| 4213 | watermelon\|11v1\|AA660116 | 7640 | 679 | 86.8 | globlastp |
| 4214 | watermelon\|11v1\|DV632407 | 7640 | 679 | 86.8 | globlastp |
| 4215 | eggplant\|10v1\|FS008108_P1 | 7641 | 679 | 86.7 | globlastp |
| 4216 | oak\|10v1\|FN726305_P1 | 7642 | 679 | 86.6 | globlastp |
| 4217 | oak\|10v1\|FN733084_P1 | 7642 | 679 | 86.6 | globlastp |
| 4218 | oak\|10v1\|FP041636_P1 | 7642 | 679 | 86.6 | globlastp |
| 4219 | oak\|10v1\|SRR039739S0093167_T1 | 7643 | 679 | 86.57 | glotblastn |
| 4220 | ambrosia\|11v1\|GW917892_P1 | 7644 | 679 | 86.5 | globlastp |
| 4221 | artemisia\|10v1\|GW328360_P1 | 7645 | 679 | 86.5 | globlastp |
| 4222 | artemisia\|10v1\|SRR019254S0010163_P1 | 7646 | 679 | 86.5 | globlastp |
| 4223 | cleome_gynandra\|10v1\|SRR015532S0001436_P1 | 7647 | 679 | 86.5 | globlastp |
| 4224 | cotton\|11v1\|CO070637_P1 | 7648 | 679 | 86.5 | globlastp |
| 4225 | cotton\|11v1\|CO088170_P1 | 7649 | 679 | 86.5 | globlastp |
| 4226 | euonymus\|11v1\|SRR070038X100346_P1 | 7650 | 679 | 86.5 | globlastp |
| 4227 | euonymus\|11v1\|SRR070038X126789_P1 | 7650 | 679 | 86.5 | globlastp |
| 4228 | fraxinus\|11v1\|SRR058827.78550_P1 | 7651 | 679 | 86.5 | globlastp |
| 4229 | gossypium_raimondii\|12v1\|EX167041_P1 | 7648 | 679 | 86.5 | globlastp |
| 4230 | humulus\|11v1\|ES437745_P1 | 7652 | 679 | 86.5 | globlastp |
| 4231 | monkeyflower\|10v1\|DV206930 | 7653 | 679 | 86.5 | globlastp |
| 4232 | parthenium\|10v1\|GW777165_P1 | 7654 | 679 | 86.5 | globlastp |
| 4233 | phyla\|11v2\|SRR099035X122028_P1 | 7655 | 679 | 86.5 | globlastp |
| 4234 | primula\|11v1\|SRR098679X100066_P1 | 7656 | 679 | 86.5 | globlastp |
| 4235 | primula\|11v1\|SRR098679X10006_P1 | 7657 | 679 | 86.5 | globlastp |
| 4236 | primula\|11v1\|SRR098679X100570_P1 | 7656 | 679 | 86.5 | globlastp |
| 4237 | primula\|11v1\|SRR098679X116775_P1 | 7656 | 679 | 86.5 | globlastp |
| 4238 | tobacco\|gb162\|BU673944 | 7658 | 679 | 86.5 | globlastp |
| 4239 | nicotiana_benthamiana\|12v1\|AY219853_P1 | 7659 | 679 | 86.5 | globlastp |
| 4240 | castorbean\|11v1\|EE254310 | 7660 | 679 | 86.47 | glotblastn |
| 4241 | castorbean\|12v1\|EE254128_T1 | 7660 | 679 | 86.47 | glotblastn |
| 4242 | flaveria\|11v1\|SRR149239.140984_T1 | 7661 | 679 | 86.47 | glotblastn |
| 4243 | flaveria\|11v1\|SRR149241.127580XX1_T1 | 7662 | 679 | 86.47 | glotblastn |
| 4244 | flaveria\|11v1\|SRR149229.10104_T1 | 7663 | 679 | 86.42 | glotblastn |
| 4245 | artemisia\|10v1\|EY031992_P1 | 7664 | 679 | 86.4 | globlastp |
| 4246 | beet\|12v1\|Y13865_P1 | 7665 | 679 | 86.4 | globlastp |
| 4247 | blueberry\|12v1\|SRR353282X11622D1_P1 | 7666 | 679 | 86.4 | globlastp |
| 4248 | hornbeam\|12v1\|SRR364455.101039_P1 | 7667 | 679 | 86.4 | globlastp |
| 4249 | wheat\|12v3\|TA12V3CRP193058 | 7665 | 679 | 86.4 | globlastp |
| 4250 | blueberry\|12v1\|SRR353282X14069D1_T1 | 7668 | 679 | 86.36 | glotblastn |
| 4251 | leymus\|gb166\|CD808679_P1 | 7669 | 679 | 86.3 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 4252 | flaveria\|11v1\|SRR149232.118398_P1 | 7670 | 679 | 86.2 | globlastp |
| 4253 | oak\|10v1\|SRR039742S0071982_T1 | 7671 | 679 | 86.19 | glotblastn |
| 4254 | apple\|11v1\|CV128668_T1 | 7672 | 679 | 86.14 | glotblastn |
| 4255 | amsonia\|11v1\|SRR098688X118176_P1 | 7673 | 679 | 86.1 | globlastp |
| 4256 | cirsium\|11v1\|SRR346952.11999_P1 | 7674 | 679 | 86.1 | globlastp |
| 4257 | coffea\|10v1\|DV663455_P1 | 7675 | 679 | 86.1 | globlastp |
| 4258 | euonymus\|11v1\|SRR070038X104689_P1 | 7676 | 679 | 86.1 | globlastp |
| 4259 | euonymus\|11v1\|SRR070038X117540_P1 | 7677 | 679 | 86.1 | globlastp |
| 4260 | euonymus\|11v1\|SRR070038X120123_P1 | 7678 | 679 | 86.1 | globlastp |
| 4261 | ginseng\|10v1\|AB236867_P1 | 7679 | 679 | 86.1 | globlastp |
| 4262 | ipomoea_batatas\|10v1\|CB330898_P1 | 7680 | 679 | 86.1 | globlastp |
| 4263 | nicotiana_benthamiana\|12v1\|CN655392_P1 | 7681 | 679 | 86.1 | globlastp |
| 4264 | nicotiana_benthamiana\|gb162\|CN655392 | 7681 | 679 | 86.1 | globlastp |
| 4265 | nicotiana_benthamiana\|gb162\|CN744088 | 7682 | 679 | 86.1 | globlastp |
| 4266 | pepper\|12v1\|BM059797_P1 | 7683 | 679 | 86.1 | globlastp |
| 4267 | pteridium\|11v1\|SRR043594X100088 | 7684 | 679 | 86.1 | globlastp |
| 4268 | spurge\|gb161\|BG467374 | 7685 | 679 | 86.1 | globlastp |
| 4269 | strawberry\|11v1\|COS16850 | 7686 | 679 | 86.1 | globlastp |
| 4270 | tomato\|11v1\|TOMCAB4A | 7687 | 679 | 86.1 | globlastp |
| 4271 | flaveria\|11v1\|SRR149232.106135_T1 | 7688 | 679 | 86.09 | glotblastn |
| 4272 | flaveria\|11v1\|SRR149244.184810_T1 | 7689 | 679 | 86.09 | glotblastn |
| 4273 | primula\|11v1\|SRR098679X102577_T1 | 7690 | 679 | 86.09 | glotblastn |
| 4274 | nicotiana_benthamiana\|12v1\|CN742096_P1 | 7691 | 679 | 86 | globlastp |
| 4275 | nicotiana_benthamiana\|gb162\|CN742025 | 7691 | 679 | 86 | globlastp |
| 4276 | flaveria\|11v1\|SRR149232.261626_T1 | 7692 | 679 | 85.71 | glotblastn |
| 4277 | gossypium_raimondii\|12v1\|SRR032881.377381_T1 | 7693 | 679 | 85.71 | glotblastn |
| 4278 | amborella\|12v3\|FD430431_P1 | 7694 | 679 | 85.7 | globlastp |
| 4279 | arnica\|11v1\|SRR099034X100993_P1 | 7695 | 679 | 85.7 | globlastp |
| 4280 | arnica\|11v1\|SRR099034X104794_P1 | 7696 | 679 | 85.7 | globlastp |
| 4281 | artemisia\|10v1\|EY036084_P1 | 7697 | 679 | 85.7 | globlastp |
| 4282 | b_juncea\|12v1\|E6ANDIZ01A5Z1E_P1 | 7698 | 679 | 85.7 | globlastp |
| 4283 | b_oleracea\|gb161\|DY029975_P1 | 7699 | 679 | 85.7 | globlastp |
| 4284 | beech\|11v1\|DT317612_P1 | 7700 | 679 | 85.7 | globlastp |
| 4285 | canola\|11v1\|CN730788_P1 | 7699 | 679 | 85.7 | globlastp |
| 4286 | cotton\|11v1\|CO073198_P1 | 7701 | 679 | 85.7 | globlastp |
| 4287 | eucalyptus\|11v2\|ES588412_P1 | 7702 | 679 | 85.7 | globlastp |
| 4288 | gossypium_raimondii\|12v1\|BM359605_P1 | 7701 | 679 | 85.7 | globlastp |
| 4289 | ipomoea_nil\|10v1\|BJ555028_P1 | 7703 | 679 | 85.7 | globlastp |
| 4290 | lotus\|09v1\|AI967689_P1 | 7704 | 679 | 85.7 | globlastp |
| 4291 | nasturtium\|11v1\|SRR032558.110591_P1 | 7705 | 679 | 85.7 | globlastp |
| 4292 | plantago\|11v2\|SRR066373X153324_P1 | 7706 | 679 | 85.7 | globlastp |
| 4293 | platanus\|11v1\|SRR096786X100930_P1 | 7707 | 679 | 85.7 | globlastp |
| 4294 | radish\|gb164\|EV539160 | 7708 | 679 | 85.7 | globlastp |
| 4295 | rose\|12v1\|BQ105419 | 7709 | 679 | 85.7 | globlastp |
| 4296 | soybean\|11v1\|GLYMA02G47560 | 7710 | 679 | 85.7 | globlastp |
| 4297 | soybean\|12v1\|GLYMA02G47560_P1 | 7710 | 679 | 85.7 | globlastp |
| 4298 | tragopogon\|10v1\|SRR020205S0000345 | 7711 | 679 | 85.7 | globlastp |
| 4299 | zamia\|gb166\|DY031222 | 7712 | 679 | 85.61 | glotblastn |
| 4300 | switchgrass\|gb167\|DN144083 | 7713 | 679 | 85.6 | globlastp |
| 4301 | wheat\|12v3\|BJ243829 | 7714 | 679 | 85.55 | glotblastn |
| 4302 | triphysaria\|10v1\|EX982551 | 7715 | 679 | 85.4 | globlastp |
| 4303 | wheat\|12v3\|BE213396 | 7716 | 679 | 85.4 | globlastp |
| 4304 | flaveria\|11v1\|SRR149240.400347_T1 | 7717 | 679 | 85.34 | glotblastn |
| 4305 | b_juncea\|12v1\|E6ANDIZ01A1QOA_P1 | 7718 | 679 | 85.3 | globlastp |
| 4306 | b_juncea\|12v1\|E6ANDIZ01A1X7Z_P1 | 7719 | 679 | 85.3 | globlastp |
| 4307 | b_rapa\|11v1\|CN729524_P1 | 7718 | 679 | 85.3 | globlastp |
| 4308 | banana\|12v1\|DN238651_P1 | 7720 | 679 | 85.3 | globlastp |
| 4309 | flaveria\|11v1\|SRR149232.100433_P1 | 7721 | 679 | 85.3 | globlastp |
| 4310 | oil_palm\|11v1\|SRR190698.104272_P1 | 7722 | 679 | 85.3 | globlastp |
| 4311 | onion\|12v1\|CF435798_P1 | 7723 | 679 | 85.3 | globlastp |
| 4312 | potato\|10v1\|AW096885_P1 | 7724 | 679 | 85.3 | globlastp |
| 4313 | sarracenia\|11v1\|SRR192669.104211 | 7725 | 679 | 85.3 | globlastp |
| 4314 | solanum_phureja\|09v1\|SPHTOMCAB5A | 7726 | 679 | 85.3 | globlastp |
| 4315 | tomato\|11v1\|TOMCAB5A | 7727 | 679 | 85.3 | globlastp |
| 4316 | flaveria\|11v1\|SRR149232.101185_P1 | 7728 | 679 | 85.2 | globlastp |
| 4317 | b_juncea\|12v1\|E6ANDIZ01A12AY_P1 | 7729 | 679 | 85 | globlastp |
| 4318 | b_juncea\|12v1\|E6ANDIZ01A1WNX_P1 | 7730 | 679 | 85 | globlastp |
| 4319 | b_rapa\|11v1\|H07776_P1 | 7730 | 679 | 85 | globlastp |
| 4320 | canola\|11v1\|DQ068137_P1 | 7731 | 679 | 85 | globlastp |
| 4321 | cleome_spinosa\|10v1\|SRR015531S0000194_P1 | 7732 | 679 | 85 | globlastp |
| 4322 | curcuma\|10v1\|DY384030_P1 | 7733 | 679 | 85 | globlastp |
| 4323 | euphorbia\|11v1\|SRR098678X11662_P1 | 7734 | 679 | 85 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 4324 | flax\|11v1\|CV478200_P1 | 7735 | 679 | 85 | globlastp |
| 4325 | ginger\|gb164\|DY345128_P1 | 7736 | 679 | 85 | globlastp |
| 4326 | pepper\|12v1\|BM064264_P1 | 7737 | 679 | 85 | globlastp |
| 4327 | phalaenopsis\|11v1\|SRR125771.1001461_P1 | 7738 | 679 | 85 | globlastp |
| 4328 | phalaenopsis\|11v1\|SRR125771.1037297_P1 | 7738 | 679 | 85 | globlastp |
| 4329 | phalaenopsis\|11v1\|SRR125771.1105138XX1_P1 | 7739 | 679 | 85 | globlastp |
| 4330 | pigeonpea\|11v1\|GR472384_P1 | 7740 | 679 | 85 | globlastp |
| 4331 | silene\|11v1\|SRR096785X165309 | 7741 | 679 | 85 | globlastp |
| 4332 | soybean\|11v1\|GLYMA14G01130 | 7742 | 679 | 85 | globlastp |
| 4333 | soybean\|12v1\|GLYMA14G01130_P1 | 7742 | 679 | 85 | globlastp |
| 4334 | thellungiella_parvulum\|11v1\|DN773146 | 7743 | 679 | 85 | globlastp |
| 4335 | vinca\|11v1\|SRR098690X102339 | 7744 | 679 | 85 | globlastp |
| 4336 | flaveria\|11v1\|SRR149232.121548_T1 | 7745 | 679 | 84.96 | glotblastn |
| 4337 | platanus\|11v1\|SRR096786X100804_T1 | 7746 | 679 | 84.91 | glotblastn |
| 4338 | podocarpus\|10v1\|SRR065014S0000148_P1 | 7747 | 679 | 84.9 | globlastp |
| 4339 | tamarix\|gb166\|CF199718 | 7748 | 679 | 84.9 | globlastp |
| 4340 | bean\|12v2\|CB280487_P1 | 7749 | 679 | 84.6 | globlastp |
| 4341 | arabidopsis_lyrata\|09v1\|JGIAL011472_P1 | 7750 | 679 | 84.6 | globlastp |
| 4342 | arabidopsis_lyrata\|09v1\|JGIAL016921_P1 | 7751 | 679 | 84.6 | globlastp |
| 4343 | arabidopsis\|10v1\|AT2G05070_P1 | 7752 | 679 | 84.6 | globlastp |
| 4344 | arabidopsis\|10v1\|AT2G05100_P1 | 7753 | 679 | 84.6 | globlastp |
| 4345 | arabidopsis\|10v1\|AT3G27690_P1 | 7754 | 679 | 84.6 | globlastp |
| 4346 | b_juncea\|12v1\|E6ANDIZ01A03AV_P1 | 7755 | 679 | 84.6 | globlastp |
| 4347 | b_juncea\|12v1\|E6ANDIZ01A0Z2K_P1 | 7756 | 679 | 84.6 | globlastp |
| 4348 | b_juncea\|12v1\|E6ANDIZ01A1N6D_P1 | 7755 | 679 | 84.6 | globlastp |
| 4349 | b_juncea\|12v1\|E6ANDIZ01A1NND_P1 | 7757 | 679 | 84.6 | globlastp |
| 4350 | b_juncea\|12v1\|E6ANDIZ01A1R82_P1 | 7755 | 679 | 84.6 | globlastp |
| 4351 | b_juncea\|12v1\|E6ANDIZ01A1TII_P1 | 7755 | 679 | 84.6 | globlastp |
| 4352 | b_juncea\|12v1\|E6ANDIZ01A306F_P1 | 7758 | 679 | 84.6 | globlastp |
| 4353 | b_juncea\|12v1\|E6ANDIZ01A3850_P1 | 7755 | 679 | 84.6 | globlastp |
| 4354 | b_rapa\|11v1\|CD841551_P1 | 7755 | 679 | 84.6 | globlastp |
| 4355 | b_rapa\|11v1\|H07528_P1 | 7755 | 679 | 84.6 | globlastp |
| 4356 | bean\|12v1\|CB280487 | 7749 | 679 | 84.6 | globlastp |
| 4357 | canola\|11v1\|CN728926_P1 | 7759 | 679 | 84.6 | globlastp |
| 4358 | canola\|11v1\|CN735221_P1 | 7755 | 679 | 84.6 | globlastp |
| 4359 | canola\|11v1\|EE498384_P1 | 7760 | 679 | 84.6 | globlastp |
| 4360 | cowpea\|12v1\|AF279248_P1 | 7761 | 679 | 84.6 | globlastp |
| 4361 | flax\|11v1\|EH791162XX1_P1 | 7762 | 679 | 84.6 | globlastp |
| 4362 | peanut\|10v1\|CD037580_P1 | 7763 | 679 | 84.6 | globlastp |
| 4363 | primula\|11v1\|SRR098679X100468_P1 | 7764 | 679 | 84.6 | globlastp |
| 4364 | radish\|gb164\|EV566349 | 7765 | 679 | 84.6 | globlastp |
| 4365 | tabernaemontana\|11v1\|SRR098689X100234 | 7766 | 679 | 84.6 | globlastp |
| 4366 | thellungiella_parvulum\|11v1\|EPCRP010282 | 7767 | 679 | 84.6 | globlastp |
| 4367 | trigonella\|11v1\|SRR066194X107056 | 7768 | 679 | 84.6 | globlastp |
| 4368 | vinca\|11v1\|SRR098690X102987 | 7769 | 679 | 84.6 | globlastp |
| 4369 | bruguiera\|gb166\|BP938701_T1 | 7770 | 679 | 84.59 | glotblastn |
| 4370 | euphorbia\|11v1\|BG467374_T1 | 7771 | 679 | 84.59 | glotblastn |
| 4371 | naveria\|11v1\|SRR149232.382755_T1 | 7772 | 679 | 84.59 | glotblastn |
| 4372 | distylium\|11v1\|SRR065077X100508_P1 | 7773 | 679 | 84.5 | globlastp |
| 4373 | rye\|12v1\|DRR001012.124233 | 7774 | 679 | 84.41 | glotblastn |
| 4374 | pseudoroegneria\|gb167\|FF344287 | 7775 | 679 | 84.4 | globlastp |
| 4375 | b_juncea\|12v1\|E6ANDIZ01A030U_P1 | 7776 | 679 | 84.3 | globlastp |
| 4376 | b_juncea\|12v1\|E6ANDIZ01A3ULG_P1 | 7777 | 679 | 84.3 | globlastp |
| 4377 | canola\|11v1\|CN728765_P1 | 7778 | 679 | 84.3 | globlastp |
| 4378 | canola\|11v1\|H07668_P1 | 7778 | 679 | 84.3 | globlastp |
| 4379 | phalaenopsis\|11v1\|SRR125771.1028146_T1 | 7779 | 679 | 84.27 | glotblastn |
| 4380 | acacia\|10v1\|GR481547_P1 | 7780 | 679 | 84.2 | globlastp |
| 4381 | canola\|11v1\|DW998983_P1 | 7781 | 679 | 84.2 | globlastp |
| 4382 | clover\|gb162\|BB902546_P1 | 7782 | 679 | 84.2 | globlastp |
| 4383 | medicago\|12v1\|AW698691_P1 | 7783 | 679 | 84.2 | globlastp |
| 4384 | pea\|11v1\|X06822_P1 | 7784 | 679 | 84.2 | globlastp |
| 4385 | tamarix\|gb166\|EH048487 | 7785 | 679 | 84.15 | glotblastn |
| 4386 | conyza\|10v1\|SRR035294S0000873_P1 | 7786 | 679 | 84.1 | globlastp |
| 4387 | nasturtium\|11v1\|SRR032558.100687P1 | 7787 | 679 | 84.1 | globlastp |
| 4388 | flaveria\|11v1\|SRR149229.203075_T1 | 7788 | 679 | 84.03 | glotblastn |
| 4389 | b_juncea\|12v1\|E6ANDIZ01B5EYF_P1 | 7789 | 679 | 83.9 | globlastp |
| 4390 | phalaenopsis\|11v1\|SRR125771.1067548_T1 | 7790 | 679 | 83.9 | glotblastn |
| 4391 | thellungiella_halophilum\|11v1\|DN773488 | 7791 | 679 | 83.9 | globlastp |
| 4392 | b_rapa\|11v1\|H07520_T1 | 7792 | 679 | 83.83 | glotblastn |
| 4393 | flaveria\|11v1\|SRR149241.1012_T1 | 7793 | 679 | 83.83 | glotblastn |
| 4394 | chickpea\|13v2\|FE670525_P1 | 7794 | 679 | 83.8 | globlastp |
| 4395 | chickpea\|13v2\|SRR133517.116766_P1 | 7794 | 679 | 83.8 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 4396 | zostera\|12v1\|AM766581_P1 | 7795 | 679 | 83.8 | globlastp |
| 4397 | zostera\|12v1\|AM766700_P1 | 7796 | 679 | 83.8 | globlastp |
| 4398 | zostera\|12v1\|AM767071_P1 | 7796 | 679 | 83.8 | globlastp |
| 4399 | zostera\|12v1\|AM771182_P1 | 7796 | 679 | 83.8 | globlastp |
| 4400 | zostera\|12v1\|AM772561_P1 | 7796 | 679 | 83.8 | globlastp |
| 4401 | zostera\|12v1\|SRR057351X10159D1_P1 | 7796 | 679 | 83.8 | globlastp |
| 4402 | zostera\|12v1\|SRR057351X113049D1_P1 | 7796 | 679 | 83.8 | globlastp |
| 4403 | zostera\|12v1\|SRR057351X12377D1_P1 | 7796 | 679 | 83.8 | globlastp |
| 4404 | zostera\|12v1\|SRR057351X138286D1_P1 | 7796 | 679 | 83.8 | globlastp |
| 4405 | zostera\|12v1\|SRR057351X192166D1_P1 | 7796 | 679 | 83.8 | globlastp |
| 4406 | zostera\|12v1\|SRR057351X20043D1_P1 | 7796 | 679 | 83.8 | globlastp |
| 4407 | zostera\|12v1\|SRR057351X384031D1_P1 | 7796 | 679 | 83.8 | globlastp |
| 4408 | zostera\|12v1\|SRR057351X497879D1_P1 | 7796 | 679 | 83.8 | globlastp |
| 4409 | zostera\|12v1\|SRR287819X138665D1_P1 | 7796 | 679 | 83.8 | globlastp |
| 4410 | zostera\|12v1\|SRR287819X35431D1_P1 | 7796 | 679 | 83.8 | globlastp |
| 4411 | chickpea\|11v1\|SRR133517.1121 | 7794 | 679 | 83.8 | globlastp |
| 4412 | pine\|10v2\|H75042_P1 | 7797 | 679 | 83.8 | globlastp |
| 4413 | pseudotsuga\|10v1\|SRR065119S0008709 | 7798 | 679 | 83.8 | globlastp |
| 4414 | silene\|11v1\|DV768290 | 7799 | 679 | 83.8 | globlastp |
| 4415 | zostera\|10v1\|AM766581 | 7796 | 679 | 83.8 | globlastp |
| 4416 | chickpea\|13v2\|FE668437_P1 | 7794 | 679 | 83.8 | globlastp |
| 4417 | zostera\|12v1\|SRR057351X182694D1_T1 | 7800 | 679 | 83.77 | glotblastn |
| 4418 | tripterygium\|11v1\|SRR098677X347520 | 7801 | 679 | 83.71 | glotblastn |
| 4419 | radish\|gb164\|EW715183 | 7802 | 679 | 83.58 | glotblastn |
| 4420 | b_rapa\|11v1\|CB686314_T1 | 7803 | 679 | 83.52 | glotblastn |
| 4421 | canola\|11v1\|H07528_T1 | 7804 | 679 | 83.52 | glotblastn |
| 4422 | canola\|11v1\|SRR019558.17346_T1 | 7805 | 679 | 83.52 | glotblastn |
| 4423 | chickpea\|13v2\|FE668894_P1 | 7806 | 679 | 83.5 | globlastp |
| 4424 | chickpea\|13v2\|SRR133517.1121_P1 | 7806 | 679 | 83.5 | globlastp |
| 4425 | aquilegia\|10v2\|DR947630_P1 | 7807 | 679 | 83.5 | globlastp |
| 4426 | spruce\|11v1\|AF247178XX2 | 7808 | 679 | 83.46 | glotblastn |
| 4427 | zostera\|12v1\|SRR057351X382862D1_T1 | 7809 | 679 | 83.4 | glotblastn |
| 4428 | zostera\|12v1\|SRR057351X453918D1_T1 | 7810 | 679 | 83.4 | glotblastn |
| 4429 | zostera\|12v1\|SRR287819X118789D1_T1 | 7811 | 679 | 83.4 | glotblastn |
| 4430 | zostera\|12v1\|SRR287819X139486D1_T1 | 7812 | 679 | 83.4 | glotblastn |
| 4431 | iceplant\|gb164\|BE034672_P1 | 7813 | 679 | 83.4 | globlastp |
| 4432 | epimedium\|11v1\|SRR013502.1002_P1 | 7814 | 679 | 83.3 | globlastp |
| 4433 | flax\|11v1\|JG103153_P1 | 7815 | 679 | 83.3 | globlastp |
| 4434 | senecio\|gb170\|CO553206 | 7816 | 679 | 83.3 | globlastp |
| 4435 | cedrus\|11v1\|SRR065007X101826_P1 | 7817 | 679 | 83.1 | globlastp |
| 4436 | euphorbia\|11v1\|DV116721_P1 | 7818 | 679 | 83.1 | globlastp |
| 4437 | maritime_pine\|10v1\|AL749749_P1 | 7819 | 679 | 83.1 | globlastp |
| 4438 | phalaenopsis\|11v1\|SRR125771.1001581_P1 | 7820 | 679 | 83.1 | globlastp |
| 4439 | poppy\|11v1\|SRR030259.10434_P1 | 7821 | 679 | 83.1 | globlastp |
| 4440 | poppy\|11v1\|SRR030259.230238_P1 | 7821 | 679 | 83.1 | globlastp |
| 4441 | poppy\|11v1\|SRR030259.77777XX2_P1 | 7821 | 679 | 83.1 | globlastp |
| 4442 | poppy\|11v1\|SRR030259.83862_P1 | 7821 | 679 | 83.1 | globlastp |
| 4443 | spruce\|11v1\|ES667439XX2 | 7822 | 679 | 83.1 | globlastp |
| 4444 | chickpea\|13v2\|FE670924_T1 | 7823 | 679 | 83.08 | glotblastn |
| 4445 | spruce\|11v1\|AF247178XX1 | 7824 | 679 | 83.08 | glotblastn |
| 4446 | zostera\|12v1\|SRR057351X345894D1_T1 | 7825 | 679 | 83.02 | glotblastn |
| 4447 | zostera\|12v1\|SRR057351X495982D1_T1 | 7826 | 679 | 83.02 | glotblastn |
| 4448 | zostera\|12v1\|SRR287819X80644D1_T1 | 7827 | 679 | 83.02 | glotblastn |
| 4449 | zostera\|12v1\|SRR287819X117482D1_T1 | 7828 | 679 | 83.02 | globlastp |
| 4450 | taxus\|10v1\|SRR032523S0000608 | 7829 | 679 | 83 | globlastp |
| 4451 | flaveria\|11v1\|SRR149232.103725_T1 | 7830 | 679 | 82.95 | glotblastn |
| 4452 | valeriana\|11v1\|SRR099041X150486 | 7831 | 679 | 82.9 | globlastp |
| 4453 | cichorium\|gb171\|EH694526_T1 | 7832 | 679 | 82.89 | glotblastn |
| 4454 | flaveria\|11v1\|SRR149229.460712_T1 | 7833 | 679 | 82.89 | glotblastn |
| 4455 | flaveria\|11v1\|SRR149238.103830_T1 | 7834 | 679 | 82.89 | glotblastn |
| 4456 | b_rapa\|11v1\|L33601_T1 | 7835 | 679 | 82.84 | glotblastn |
| 4457 | abies\|11v2\|SRR098676X10263_P1 | 7836 | 679 | 82.8 | globlastp |
| 4458 | b_juncea\|12v1\|E6ANDIZ01AO4N7_P1 | 7837 | 679 | 82.8 | globlastp |
| 4459 | cedrus\|11v1\|SRR065007X10066_P1 | 7838 | 679 | 82.8 | globlastp |
| 4460 | artemisia\|10v1\|EY043666_T1 | 7839 | 679 | 82.71 | glotblastn |
| 4461 | spruce\|11v1\|ES866284XX1 | 7840 | 679 | 82.71 | glotblastn |
| 4462 | cedrus\|11v1\|SRR065007X100115_P1 | 7841 | 679 | 82.7 | globlastp |
| 4463 | cedrus\|11v1\|SRR065007X100351_P1 | 7842 | 679 | 82.7 | globlastp |
| 4464 | cedrus\|11v1\|SRR065007X102605XX1_P1 | 7841 | 679 | 82.7 | globlastp |
| 4465 | maritime_pine\|10v1\|BX681281_P1 | 7841 | 679 | 82.7 | globlastp |
| 4466 | pine\|10v2\|AL749749_P1 | 7843 | 679 | 82.7 | globlastp |
| 4467 | pine\|10v2\|X13407_P1 | 7844 | 679 | 82.7 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 4468 | poppy\|11v1\|SRR030260.101101_P1 | 7845 | 679 | 82.7 | globlastp |
| 4469 | pseudotsuga\|10v1\|SRR065119S0002848 | 7846 | 679 | 82.7 | globlastp |
| 4470 | spruce\|11v1\|ES245009XX2 | 7847 | 679 | 82.7 | globlastp |
| 4471 | zostera\|12v1\|SRR287819X106739D1_T1 | 7848 | 679 | 82.64 | glotblastn |
| 4472 | blueberry\|12v1\|SRR353282X1205D1_P1 | 7849 | 679 | 82.6 | globlastp |
| 4473 | cephalotaxus\|11v1\|SRR064395X100438_P1 | 7850 | 679 | 82.6 | globlastp |
| 4474 | epimedium\|11v1\|SRR013502.1083_P1 | 7851 | 679 | 82.6 | globlastp |
| 4475 | poppy\|11v1\|SRR030259.16930_P1 | 7852 | 679 | 82.6 | globlastp |
| 4476 | zostera\|12v1\|SRR287819X116036D1_T1 | 7853 | 679 | 82.51 | glotblastn |
| 4477 | cycas\|gb166\|CB089403_P1 | 7854 | 679 | 82.5 | globlastp |
| 4478 | flaveria\|11v1\|SRR149229.105154_P1 | 7855 | 679 | 82.5 | globlastp |
| 4479 | flaveria\|11v1\|SRR149229.128816_P1 | 7855 | 679 | 82.5 | globlastp |
| 4480 | silene\|11v1\|SIPCAB | 7856 | 679 | 82.5 | globlastp |
| 4481 | thellungiella_halophilum\|11v1\|DN773146 | — | 679 | 82.46 | glotblastn |
| 4482 | abies\|11v2\|SRR098676X103819_P1 | 7857 | 679 | 82.4 | globlastp |
| 4483 | b_juncea\|12v1\|E6ANDIZ01A5T96_P1 | 7858 | 679 | 82.4 | globlastp |
| 4484 | poppy\|11v1\|SRR030260.126583XX2_T1 | 7859 | 679 | 82.33 | glotblastn |
| 4485 | spruce\|11v1\|GT885731 | 7860 | 679 | 82.33 | glotblastn |
| 4486 | flaveria\|11v1\|SRR149239.62768_P1 | 7861 | 679 | 82.3 | globlastp |
| 4487 | maritime_pine\|10v1\|AJ309102_P1 | 7862 | 679 | 82.3 | globlastp |
| 4488 | poppy\|11v1\|SRR030259.10584_P1 | 7863 | 679 | 82.3 | globlastp |
| 4489 | poppy\|11v1\|SRR030261.48143_P1 | 7864 | 679 | 82.3 | globlastp |
| 4490 | poppy\|11v1\|SRR030265.257384_P1 | 7865 | 679 | 82.3 | globlastp |
| 4491 | spruce\|11v1\|ES245009XX1 | 7866 | 679 | 82.3 | globlastp |
| 4492 | spruce\|11v1\|ES667997XX1 | 7867 | 679 | 82.3 | globlastp |
| 4493 | spruce\|11v1\|FD739232XX2 | 7868 | 679 | 82.3 | globlastp |
| 4494 | zostera\|12v1\|SRR287822X109188D1_T1 | 7869 | 679 | 82.26 | glotblastn |
| 4495 | zostera\|12v1\|SRR287822X91863D1_T1 | 7870 | 679 | 82.26 | glotblastn |
| 4496 | zostera\|12v1\|SRR287908X123712D1_T1 | 7871 | 679 | 82.26 | glotblastn |
| 4497 | flax\|11v1\|JG103521_P1 | 7872 | 679 | 82.2 | globlastp |
| 4498 | sequoia\|10v1\|SRR065044S0005034 | 7873 | 679 | 82.2 | globlastp |
| 4499 | flaveria\|11v1\|SRR149241.121618_T1 | 7874 | 679 | 82.13 | glotblastn |
| 4500 | flaveria\|11v1\|SRR149241.14885_T1 | 7875 | 679 | 82.13 | glotblastn |
| 4501 | oak\|10v1\|FP025890_T1 | 7876 | 679 | 81.95 | glotblastn |
| 4502 | spruce\|11v1\|ES667073XX1 | 7877 | 679 | 81.95 | glotblastn |
| 4503 | spruce\|11v1\|ES667273XX2 | 7878 | 679 | 81.95 | glotblastn |
| 4504 | flaveria\|11v1\|SRR149232.223435_T1 | 7879 | 679 | 81.82 | glotblastn |
| 4505 | ambrosia\|11v1\|SRR346943.117749_P1 | 7880 | 679 | 81.7 | globlastp |
| 4506 | oak\|10v1\|FP025574_P1 | 7881 | 679 | 81.7 | globlastp |
| 4507 | spikemoss\|gb65IDN838028 | 7882 | 679 | 81.65 | glotblastn |
| 4508 | zostera\|12v1\|SRR057351X785286D1_P1 | 7883 | 679 | 81.6 | globlastp |
| 4509 | zostera\|12v1\|SRR287822X123050D1_P1 | 7883 | 679 | 81.6 | globlastp |
| 4510 | zostera\|12v1\|SRR287828X1935D1_P1 | 7884 | 679 | 81.6 | globlastp |
| 4511 | centaurea\|11v1\|EH725583_P1 | 7885 | 679 | 81.6 | globlastp |
| 4512 | poppy\|11v1\|SRR030259.128803_P1 | 7886 | 679 | 81.6 | globlastp |
| 4513 | senecio\|gb170\|DY659329 | 7887 | 679 | 81.6 | globlastp |
| 4514 | spruce\|11v1\|EX396361XX1 | 7888 | 679 | 81.6 | globlastp |
| 4515 | sequoia\|10v1\|SRR065044S0052503 | 7889 | 679 | 81.41 | glotblastn |
| 4516 | monkeyflower\|12v1\|DV206485_P1 | 7890 | 679 | 81.4 | globlastp |
| 4517 | spruce\|11v1\|EX424733XX1 | 7891 | 679 | 81.37 | glotblastn |
| 4518 | spruce\|11v1\|ES661748XX1 | 7892 | 679 | 81.3 | globlastp |
| 4519 | chickpea\|13v2\|SRR133521.241946_T1 | 7893 | 679 | 81.2 | globlastp |
| 4520 | artemisia\|10v1\|EY065972_T1 | 7894 | 679 | 81.2 | glotblastn |
| 4521 | cedrus\|11v1\|SRR065007X100555_T1 | 7895 | 679 | 81.2 | glotblastn |
| 4522 | fern\|gb171\|DK944111_P1 | 7896 | 679 | 81.2 | globlastp |
| 4523 | pine\|10v2\|PPU51634_T1 | 7897 | 679 | 81.2 | glotblastn |
| 4524 | pteridium\|11v1\|SRR043594X100886 | 7898 | 679 | 81.2 | globlastp |
| 4525 | cenchrus\|gb166\|EB670451_P1 | 7899 | 679 | 81.1 | globlastp |
| 4526 | pteridium\|11v1\|GW574843 | 7900 | 679 | 81.1 | globlastp |
| 4527 | euphorbia\|11v1\|SRR098678X113578_T1 | 7901 | 679 | 81.06 | glotblastn |
| 4528 | euphorbia\|11v1\|SRR098678X18309_T1 | 7902 | 679 | 81.06 | glotblastn |
| 4529 | artemisia\|10v1\|EY045804_P1 | 7903 | 679 | 81 | globlastp |
| 4530 | zostera\|12v1\|SRR287908X101490D1_T1 | 7904 | 679 | 80.97 | glotblastn |
| 4531 | canola\|11v1\|EG020467_T1 | 7905 | 679 | 80.9 | glotblastn |
| 4532 | chickpea\|13v2\|SRR133517.104734_T1 | 7906 | 679 | 80.83 | glotblastn |
| 4533 | cynara\|gb167\|GE591421_T1 | 7907 | 679 | 80.83 | glotblastn |
| 4534 | zostera\|12v1\|SRR287819X123850D1_T1 | 7908 | 679 | 80.75 | glotblastn |
| 4535 | cryptomeria\|gb166\|BW994897_P1 | 7909 | 679 | 80.7 | globlastp |
| 4536 | flaveria\|11v1\|SRR149238.332042_T1 | 7910 | 679 | 80.61 | glotblastn |
| 4537 | radish\|gb164\|EV542239 | 7911 | 679 | 80.61 | glotblastn |
| 4538 | chickpea\|13v2\|SRR133517.100453_P1 | 7912 | 679 | 80.5 | globlastp |
| 4539 | zostera\|12v1\|SRR287819X52076D1_T1 | 7913 | 679 | 80.45 | glotblastn |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 4540 | zostera\|12v1\|SRR287819X57215D1_T1 | 7914 | 679 | 80.23 | glotblastn |
| 4541 | phalaenopsis\|11v1\|SRR125771.1148769_T1 | 7915 | 679 | 80.23 | glotblastn |
| 4542 | spruce\|11v1\|ES262162XX1 | 7916 | 679 | 80.23 | glotblastn |
| 4543 | euphorbia\|11v1\|DV137035_P1 | 7917 | 679 | 80.2 | globlastp |
| 4543 | spurge\|gb161\|DV137035 | 7917 | 679 | 80.2 | globlastp |
| 4544 | nasturtium\|11v1\|SRR032558.14184_P1 | 7918 | 679 | 80.2 | globlastp |
| 4545 | chickpea\|11v1\|SRR133517.105445 | 7919 | 679 | 80.08 | glotblastn |
| 4546 | flaveria\|11v1\|SRR149232.123511_T1 | 7920 | 679 | 80.08 | glotblastn |
| 4547 | strawberry\|11v1\|EX663159 | 7921 | 679 | 80.08 | glotblastn |
| 4548 | zostera\|12v1\|SRR287828X38246D1_T1 | 7922 | 679 | 80 | glotblastn |
| 4549 | barley\|12v1\|CX631446_P1 | 7923 | 681 | 85 | globlastp |
| 4550 | foxtail_millet\|11v3\|PHY7SI009670M_P1 | 7924 | 681 | 83.8 | globlastp |
| 4551 | rice\|11v1\|D48912 | 7925 | 681 | 83.7 | globlastp |
| 4552 | rye\|12v1\|DRR001012.143434 | 7926 | 681 | 83.4 | glotblastn |
| 4553 | sorghum\|12v1\|SB06G017470 | 7927 | 681 | 82.2 | globlastp |
| 4554 | switchgrass\|12v1\|SRR187767.630949_P1 | 7928 | 681 | 82 | globlastp |
| 4555 | switchgrass\|12v1\|FL916996_P1 | 7929 | 681 | 81.2 | globlastp |
| 4556 | maize\|10v1\|BG833646_T1 | 7930 | 681 | 80.69 | glotblastn |
| 4557 | foxtail_millet\|11v3\|PHY7SI036906M_P1 | 7931 | 682 | 82.7 | globlastp |
| 4558 | switchgrass\|12v1\|DN140973_P1 | 7932 | 682 | 82.3 | globlastp |
| 4559 | switchgrass\|gb167\|DN140777 | 7933 | 682 | 81.9 | globlastp |
| 4560 | switchgrass\|12v1\|DN140777_P1 | 7934 | 682 | 81.6 | globlastp |
| 4561 | switchgrass\|gb167\|DN140973 | 7935 | 682 | 81 | glotblastn |
| 4562 | millet\|10v1\|CD725024_P1 | 7936 | 682 | 80.5 | globlastp |
| 4563 | solanum_phureja\|09v1\|SPHAW154852 | 7937 | 683 | 89.4 | globlastp |
| 4564 | eggplant\|10v1\|FS004080_P1 | 7938 | 683 | 83.8 | globlastp |
| 4565 | wheat\|12v3\|BE443100 | 7939 | 693 | 95.7 | globlastp |
| 4566 | rye\|12v1\|DRR001012.168798 | 7940 | 693 | 92.8 | globlastp |
| 4567 | foxtail_millet\|11v3\|PHY7SI022926M_T1 | 7941 | 693 | 82.89 | glotblastn |
| 4568 | rice\|11v1\|D40052 | 7942 | 693 | 81.3 | globlastp |
| 4569 | switchgrass\|gb167\|FE642104 | 7943 | 693 | 81.2 | globlastp |
| 4570 | switchgrass\|12v1\|FL863086_T1 | 7944 | 693 | 81.01 | glotblastn |
| 4571 | foxtail_millet\|11v3\|PHY7SI005388M_P1 | 7945 | 693 | 80.4 | globlastp |
| 4572 | sorghum\|12v1\|SB03G044860 | 7946 | 693 | 80.08 | glotblastn |
| 4573 | pseudoroegneria\|gb167\|FF342114 | 7947 | 694 | 81.8 | globlastp |
| 4574 | wheat\|12v3\|SRR073321X137372D1 | 7948 | 695 | 92.38 | glotblastn |
| 4575 | wheat\|12v3\|SRR400820X100753D1 | 7949 | 695 | 92.38 | glotblastn |
| 4576 | wheat\|12v3\|CA740981 | 7950 | 695 | 91.43 | glotblastn |
| 4577 | wheat\|12v3\|AL810901 | 7951 | 695 | 90.48 | glotblastn |
| 4578 | wheat\|12v3\|CJ543873 | 7952 | 695 | 89.52 | glotblastn |
| 4579 | wheat\|12v3\|SRR073322X395399D1 | 7953 | 695 | 89.52 | glotblastn |
| 4580 | wheat\|12v3\|CD920952 | 7954 | 695 | 86.67 | glotblastn |
| 4581 | rye\|12v1\|DRR001012.620799 | 7955 | 695 | 85.71 | glotblastn |
| 4582 | pseudoroegneria\|gb167\|FF344783 | 7956 | 695 | 84.1 | globlastp |
| 4583 | wheat\|12v3\|CA649000 | 7957 | 696 | 83.05 | glotblastn |
| 4584 | wheat\|12v3\|CJ540376 | 7958 | 696 | 81.88 | glotblastn |
| 4585 | oat\|11v1\|GR351065_T1 | 7959 | 697 | 88.04 | glotblastn |
| 4586 | rice\|11v1\|AT003532 | 7960 | 697 | 87.5 | glotblastn |
| 4587 | foxtail_millet\|11v3\|PHY7SI023571M_T1 | 7961 | 697 | 85.1 | glotblastn |
| 4588 | maize\|10v1\|AW455707_T1 | 7962 | 697 | 85.1 | glotblastn |
| 4589 | sugarcane\|10v1\|CA075702 | 7963 | 697 | 84.62 | glotblastn |
| 4590 | switchgrass\|gb167\|DN145223 | 7964 | 697 | 84.13 | glotblastn |
| 4591 | switchgrass\|12v1\|DN145223_T1 | 7965 | 697 | 83.65 | glotblastn |
| 4592 | sorghum\|12v1\|SB08G013180 | 7966 | 697 | 83.65 | glotblastn |
| 4593 | millet\|10v1\|EVO454PM010844_T1 | 7967 | 697 | 83.17 | glotblastn |
| 4594 | switchgrass\|12v1\|FE598880_T1 | 7968 | 697 | 82.21 | glotblastn |
| 4595 | rice\|11v1\|BI804923 | 7969 | 700 | 84.93 | glotblastn |
| 4596 | brachypodium\|12v1\|BRADI1G58250_T1 | 7970 | 700 | 84.08 | glotblastn |
| 4597 | wheat\|12v3\|BQ172325 | 7971 | 700 | 84.07 | glotblastn |
| 4598 | switchgrass\|12v1\|HO258167_T1 | 7972 | 700 | 82.48 | glotblastn |
| 4599 | foxtail_millet\|11v3\|EC611896_P1 | 7973 | 701 | 94.1 | globlastp |
| 4600 | switchgrass\|12v1\|FE633580_P1 | 7974 | 701 | 89.3 | globlastp |
| 4601 | switchgrass\|gb167\|FE633580 | 7975 | 701 | 82.1 | globlastp |
| 4602 | brachypodium\|12v1\|BRADI1G01870_T1 | 7976 | 701 | 80.37 | glotblastn |
| 4603 | sorghum\|12v1\|SB06G032510 | 7977 | 702 | 88.5 | globlastp |
| 4604 | switchgrass\|12v1\|SRR187769.1040771_P1 | 7978 | 702 | 87.8 | globlastp |
| 4605 | maize\|10v1\|CD949464_P1 | 7979 | 702 | 86.5 | globlastp |
| 4606 | sorghum\|12v1\|SB06G032490 | 7980 | 702 | 86.5 | globlastp |
| 4607 | wheat\|12v3\|CA617374 | 7981 | 702 | 83.3 | globlastp |
| 4608 | switchgrass\|12v1\|FE622730_P1 | 7982 | 703 | 86.2 | globlastp |
| 4609 | foxtail_millet\|11v3\|PHY7SI029253M_T1 | 7983 | 703 | 86.08 | glotblastn |
| 4610 | switchgrass\|12v1\|FL727202_T1 | 7984 | 703 | 85.46 | glotblastn |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 4611 | millet\|10v1\|EVO454PM027881_P1 | 7985 | 703 | 84.1 | globlastp |
| 4612 | sugarcane\|10v1\|CA068859 | 704 | 704 | 100 | globlastp |
| 4613 | sorghum\|12v1\|SB08G019790 | 7986 | 704 | 99.4 | globlastp |
| 4614 | foxtail_millet\|11v3\|EC612562_P1 | 7987 | 704 | 96.7 | globlastp |
| 4615 | switchgrass\|12v1\|DN141026_P1 | 7988 | 704 | 96.1 | globlastp |
| 4616 | switchgrass\|gb167\|DN141026 | 7988 | 704 | 96.1 | globlastp |
| 4617 | switchgrass\|12v1\|FE614174_P1 | 7989 | 704 | 96.1 | globlastp |
| 4618 | switchgrass\|gb167\|FE614174 | 7990 | 704 | 95.6 | globlastp |
| 4619 | millet\|10v1\|EVO454PM015232_P1 | 7991 | 704 | 95 | globlastp |
| 4620 | cynodon\|10v1\|ES302192_P1 | 7992 | 704 | 91.7 | globlastp |
| 4621 | lovegrass\|gb167\|DN480722_T1 | 7993 | 704 | 91.67 | glotblastn |
| 4622 | brachypodium\|12v1\|BRADI4G03060_T1 | 7994 | 704 | 88.33 | glotblastn |
| 4623 | oat\|11v1\|GO582551_P1 | 7995 | 704 | 87.9 | globlastp |
| 4624 | oat\|11v1\|GO582656_P1 | 7995 | 704 | 87.9 | globlastp |
| 4625 | wheat\|12v3\|TAU22442 | 7996 | 704 | 87.9 | globlastp |
| 4626 | leymus\|gb166\|EG383427_P1 | 7997 | 704 | 87.4 | globlastp |
| 4627 | pseudoroegneria\|gb167\|FF342320 | 7998 | 704 | 87.4 | globlastp |
| 4628 | lolium\|10v1\|AU248479_P1 | 7999 | 704 | 86.8 | globlastp |
| 4629 | rye\|12v1\|BE587862 | 8000 | 704 | 86.8 | globlastp |
| 4630 | eucalyptus\|11v2\|CT983413_P1 | 8001 | 704 | 84.2 | globlastp |
| 4631 | trigonella\|11v1\|SRR066194X122729 | 8002 | 704 | 84.2 | globlastp |
| 4632 | rice\|11v1\|BE039706 | 8003 | 704 | 83.96 | glotblastn |
| 4633 | euphorbia\|11v1\|SRR098678X164620_P1 | 8004 | 704 | 83.9 | globlastp |
| 4634 | chickpea\|11v1\|GR390844 | 8005 | 704 | 83.6 | globlastp |
| 4635 | chickpea\|13v2\|GR390844_P1 | 8005 | 704 | 83.6 | globlastp |
| 4636 | oil_palm\|11v1\|EL691105_P1 | 8006 | 704 | 83.6 | globlastp |
| 4637 | tomato\|11v1\|BG123164 | 8007 | 704 | 83.6 | globlastp |
| 4638 | fraxinus\|11v1\|SRR058827.164804_T1 | 8008 | 704 | 83.33 | glotblastn |
| 4639 | antirrhinum\|gb166\|AJ568560_P1 | 8009 | 704 | 83.3 | globlastp |
| 4640 | primula\|11v1\|SRR098679X101388_P1 | 8010 | 704 | 83.3 | globlastp |
| 4641 | medicago\|12v1\|AW127578_P1 | 8011 | 704 | 83.2 | globlastp |
| 4642 | curcuma\|10v1\|DY388752_P1 | 8012 | 704 | 83.1 | globlastp |
| 4643 | peanut\|10v1\|GO323872_P1 | 8013 | 704 | 83.1 | globlastp |
| 4644 | olea\|13v1\|SRR014463X35572D1_T1 | 8014 | 704 | 82.87 | glotblastn |
| 4645 | nicotiana_benthamiana\|12v1\|CN742663_P1 | 8015 | 704 | 82.2 | globlastp |
| 4646 | eggplant\|10v1\|FS000347_P1 | 8016 | 704 | 82.2 | globlastp |
| 4647 | lotus\|09v1\|BI418063_P1 | 8017 | 704 | 82.2 | globlastp |
| 4648 | phalaenopsis\|11v1\|SRR125771.1037360_P1 | 8018 | 704 | 82.1 | globlastp |
| 4649 | platanus\|11v1\|SRR096786X128388_P1 | 8019 | 704 | 82 | globlastp |
| 4650 | hornbeam\|12v1\|SRR364455.120478_T1 | 8020 | 704 | 81.72 | glotblastn |
| 4651 | blueberry\|12v1\|CF810435_P1 | 8021 | 704 | 81.7 | globlastp |
| 4652 | fraxinus\|11v1\|SRR058827.121081_T1 | 8022 | 704 | 81.67 | glotblastn |
| 4653 | orobanche\|10v1\|SRR023189S0019436_T1 | 8023 | 704 | 81.67 | glotblastn |
| 4654 | onion\|12v1\|SRR073446X110681D1_P1 | 8024 | 704 | 81.6 | globlastp |
| 4655 | tobacco\|gb162\|DV158342 | 8025 | 704 | 81.6 | globlastp |
| 4656 | flax\|11v1\|EU828929_P1 | 8026 | 704 | 81.5 | globlastp |
| 4657 | flax\|11v1\|JG090232_P1 | 8027 | 704 | 81.5 | globlastp |
| 4658 | ambrosia\|11v1\|SRR346943.137299_P1 | 8028 | 704 | 81.4 | globlastp |
| 4659 | cucurbita\|11v1\|FG227219XX1_P1 | 8029 | 704 | 81.4 | globlastp |
| 4660 | phalaenopsis\|11v1\|SRR125771.1054625_T1 | 8030 | 704 | 81.32 | glotblastn |
| 4661 | bean\|12v2\|CA896575_T1 | 8031 | 704 | 81.18 | glotblastn |
| 4662 | bean\|12v1\|CA896575 | 8031 | 704 | 81.18 | glotblastn |
| 4663 | aquilegia\|10v2\|JGIAC006472_T1 | 8032 | 704 | 81.11 | glotblastn |
| 4664 | soybean\|11v1\|GLYMA06G04850 | 8033 | 704 | 81.11 | glotblastn |
| 4665 | soybean\|12v1\|GLYMA06G04850_T1 | 8033 | 704 | 81.11 | glotblastn |
| 4666 | tabernaemontana\|11v1\|SRR098689X124415 | 8034 | 704 | 81.11 | glotblastn |
| 4667 | tragopogon\|10v1\|SRR020205S0035974 | 8035 | 704 | 81.11 | glotblastn |
| 4668 | tobacco\|gb162\|CV021615 | 8036 | 704 | 81.1 | globlastp |
| 4669 | olea\|13v1\|SRR014463X30554D1_P1 | 8037 | 704 | 81.1 | globlastp |
| 4670 | pepper\|12v1\|BM059712_P1 | 8038 | 704 | 81 | globlastp |
| 4671 | amorphophallus\|11v2\|SRR089351X125225_T1 | 8039 | 704 | 80.98 | glotblastn |
| 4672 | grape\|11v1\|GSVIVT01009358001_P1 | 8040 | 704 | 80.9 | globlastp |
| 4673 | cleome_spinosa\|10v1\|GR931673_T1 | 8041 | 704 | 80.87 | glotblastn |
| 4674 | phalaenopsis\|11v1\|SRR125771.1037068XX1_T1 | 8030 | 704 | 80.77 | glotblastn |
| 4675 | poppy\|11v1\|FE964711_P1 | 8042 | 704 | 80.7 | globlastp |
| 4676 | cleome_spinosa\|10v1\|GR930987_P1 | 8043 | 704 | 80.6 | globlastp |
| 4677 | clover\|gb162\|BB929026_P1 | 8044 | 704 | 80.6 | globlastp |
| 4678 | ambrosia\|11v1\|SRR346935.316071_T1 | 8045 | 704 | 80.56 | glotblastn |
| 4679 | centaurea\|gb166\|EH717726 | 8046 | 704 | 80.56 | glotblastn |
| 4680 | cirsium\|11v1\|SRR346952.11256_T1 | 8047 | 704 | 80.56 | glotblastn |
| 4681 | cowpea\|12v1\|FF387663_T1 | 8048 | 704 | 80.56 | glotblastn |
| 4682 | ipomoea_batatas\|10v1\|DV034551_T1 | 8049 | 704 | 80.56 | glotblastn |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 4683 | poppy\|11v1\|SRR030259.103371_T1 | 8050 | 704 | 80.56 | glotblastn |
| 4684 | poppy\|11v1\|SRR030260.169771_T1 | 8051 | 704 | 80.56 | glotblastn |
| 4685 | thalictrum\|11v1\|SRR096787X108014 | 8052 | 704 | 80.56 | glotblastn |
| 4686 | thalictrum\|11v1\|SRR096787X11261 | 8053 | 704 | 80.56 | glotblastn |
| 4687 | vinca\|11v1\|SRR098690X110157 | 8054 | 704 | 80.56 | glotblastn |
| 4688 | petunia\|gb171\|CV301011_P1 | 8055 | 704 | 80.5 | globlastp |
| 4689 | solanum_phureja\|09v1\|SPHBG123164 | 8056 | 704 | 80.5 | globlastp |
| 4690 | soybean\|11v1\|GLYMA04G04770 | 8057 | 704 | 80.43 | glotblastn |
| 4691 | soybean\|12v1\|GLYMA04G04770_T1 | 8057 | 704 | 80.43 | glotblastn |
| 4692 | beech\|11v1\|SRR006293.20456_P1 | 8058 | 704 | 80.4 | globlastp |
| 4693 | poplar\|10v1\|AI163073 | 8059 | 704 | 80.4 | globlastp |
| 4694 | poplar\|13v1\|AI162099_P1 | 8059 | 704 | 80.4 | globlastp |
| 4695 | spruce\|11v1\|ES878106 | 8059 | 704 | 80.4 | globlastp |
| 4696 | cannabis\|12v1\|SOLX00055197_T1 | 8060 | 704 | 80.33 | glotblastn |
| 4697 | apple\|11v1\|CN444425_P1 | 8061 | 704 | 80.3 | globlastp |
| 4698 | cucurbita\|11v1\|SRR091276X112897_P1 | 8062 | 704 | 80.3 | globlastp |
| 4699 | euphorbia\|11v1\|BP958713_P1 | 8063 | 704 | 80.3 | globlastp |
| 4700 | sunflower\|12v1\|CD848609 | 8064 | 704 | 80.3 | globlastp |
| 4701 | sunflower\|12v1\|DY928392 | 8064 | 704 | 80.3 | globlastp |
| 4702 | pigeonpea\|11v1\|SRR054580X108129_T1 | 8065 | 704 | 80.11 | glotblastn |
| 4703 | valeriana\|11v1\|SRR099039X123814 | 8066 | 704 | 80.1 | globlastp |
| 4704 | nicotiana_benthamiana\|12v1\|DV161035_T1 | 8067 | 704 | 80 | glotblastn |
| 4705 | b_juncea\|12v1\|E6ANDIZ01BABOV_T1 | 8068 | 704 | 80 | globlastp |
| 4706 | clementine\|11v1\|CB292000_P1 | 8069 | 704 | 80 | globlastp |
| 4707 | flaveria\|11v1\|SRR149229.140630_T1 | 8070 | 704 | 80 | glotblastn |
| 4708 | maritime_pine\|10v1\|BX250460_T1 | 8071 | 704 | 80 | glotblastn |
| 4709 | monkeyflower\|10v1\|DV210529 | 8072 | 704 | 80 | glotblastn |
| 4710 | monkeyflower\|12v1\|DV210529_T1 | 8072 | 704 | 80 | glotblastn |
| 4711 | olea\|11v1\|SRR014463.30554 | 8073 | 704 | 80 | globlastp |
| 4712 | orange\|11v1\|CB292000_P1 | 8069 | 704 | 80 | globlastp |
| 4713 | phyla\|11v2\|SRR099035X104250_T1 | 8074 | 704 | 80 | glotblastn |
| 4714 | pine\|10v2\|AW056696_T1 | 8071 | 704 | 80 | glotblastn |
| 4715 | potato\|10v1\|AJ487457_P1 | 8075 | 704 | 80 | globlastp |
| 4716 | triphysaria\|10v1\|EX988218 | 8076 | 704 | 80 | globlastp |
| 4717 | tripterygium\|11v1\|SRR098677X101252 | 8077 | 704 | 80 | glotblastn |
| 4718 | maize\|10v1\|BM500443_P1 | 8078 | 705 | 92.8 | globlastp |
| 4719 | sorghum\|12v1\|SB10G021930_P1 | 8079 | 705 | 91 | globlastp |
| 4720 | maize\|10v1\|ZMCRP2V110874_P1 | 8080 | 707 | 98 | globlastp |
| 4721 | sorghum\|12v1\|SB07G004810 | 8081 | 707 | 94.08 | glotblastn |
| 4722 | rice\|11v1\|BI809598 | 8082 | 707 | 84.2 | glotblastn |
| 4723 | rice\|11v1\|CB209742 | 8083 | 707 | 83.76 | glotblastn |
| 4724 | rice\|11v1\|AU057895 | 8084 | 707 | 82.2 | glotblastn |
| 4725 | foxtail_millet\|11v3\|PHY7SI009239M_T1 | 8085 | 707 | 81.79 | glotblastn |
| 4726 | brachypodium\|12v1\|BRADI5G23367_T1 | 8086 | 707 | 80.86 | glotblastn |
| 4727 | switchgrass\|12v1\|FE616344_T1 | 8087 | 707 | 80.59 | glotblastn |
| 4728 | maize\|10v1\|T23354_T1 | 8088 | 707 | 80.37 | glotblastn |
| 4729 | sorghum\|12v1\|SB10G028730 | 8089 | 710 | 84.1 | globlastp |
| 4730 | soybean\|11v1\|GLYMA14G24660 | 8090 | 711 | 88.06 | globlastp |
| 4731 | soybean\|12v1\|GLYMA14G24660T2_P1 | 8091 | 711 | 86.4 | globlastp |
| 4732 | brachypodium\|12v1\|BRADI4G29730_P1 | 8092 | 713 | 86.1 | globlastp |
| 4733 | barley\|12v1\|BE411017_T1 | 8093 | 713 | 83.12 | glotblastn |
| 4734 | switchgrass\|gb167\|DN145699 | 8094 | 713 | 80.1 | globlastp |
| 4735 | rice\|11v1\|BI306619 | 8095 | 713 | 80 | globlastp |
| 4736 | wheat\|12v3\|BE417065_P1 | 8096 | 715 | 91.8 | globlastp |
| 4737 | rye\|12v1\|DRR001012.157648_P1 | 8097 | 715 | 91.3 | globlastp |
| 4738 | wheat\|12v3\|AL823091 | 8098 | 719 | 95.2 | globlastp |
| 4739 | rye\|12v1\|DRR001012.107133 | 8099 | 719 | 95.14 | glotblastn |
| 4740 | brachypodium\|12v1\|BRADI3G37350_P1 | 8100 | 719 | 84.2 | globlastp |
| 4741 | rice\|11v1\|AU108306 | 8101 | 719 | 80 | globlastp |
| 4742 | wheat\|12v3\|BE488612 | 8102 | 721 | 92.7 | globlastp |
| 4743 | rye\|12v1\|DRR001012.125660 | 8103 | 721 | 91.2 | globlastp |
| 4744 | pseudoroegneria\|gb167\|FF340927 | 8104 | 721 | 90.8 | globlastp |
| 4745 | wheat\|12v3\|CD863372 | 8105 | 725 | 96.4 | globlastp |
| 4746 | wheat\|12v3\|AK330727 | 8106 | 725 | 96.3 | globlastp |
| 4747 | wheat\|12v3\|SRR043326X28070D1 | 8107 | 725 | 95.93 | glotblastn |
| 4748 | wheat\|12v3\|CA639363 | 8108 | 725 | 94.6 | globlastp |
| 4749 | wheat\|12v3\|SRR073321X143332D1 | 8109 | 725 | 88.9 | globlastp |

TABLE 2-continued

Homologues (e.g., orthologues) of the identified genes/polypeptides for increasing yield, harvest index, fiber yield, fiber quality, photosynthetic capacity, vigor, biomass, growth rate, abiotic stress tolerance, nitrogen use efficiency, water use efficiency and fertilizer use efficiency of a plant

| P.N. SEQ ID NO: | Organism/cluster name | P.P. SEQ ID NO: | Hom. to SEQ ID NO: | % global iden. | Algor. |
|---|---|---|---|---|---|
| 4750 | wheat\|12v3\|CD863371 | 8110 | 725 | 85.06 | glotblastn |
| 4751 | rice\|11v1\|CA998145 | 8111 | 725 | 82.3 | globlastp |
| 4752 | rye\|12v1\|DRR001012.117306 | 8112 | 727 | 96 | globlastp |
| 4753 | wheat\|12v3\|BM134597 | 8113 | 727 | 94.1 | globlastp |
| 4754 | brachypodium\|12v1\|BRADI3G50150_P1 | 8114 | 727 | 90.9 | globlastp |
| 4755 | wheat\|12v3\|AL826717 | 8115 | 727 | 84.6 | glotblastn |
| 4756 | rice\|11v1\|CK061379 | 8116 | 727 | 84.5 | globlastp |
| 4757 | switchgrass\|12v1\|FE608601_P1 | 8117 | 727 | 83.6 | globlastp |
| 4758 | switchgrass\|12v1\|FE623318_P1 | 8118 | 727 | 83.6 | globlastp |
| 4759 | foxtail_millet\|11v3\|PHY7SI016281M_P1 | 8119 | 727 | 83.3 | globlastp |
| 4760 | maize\|10v1\|AW066736_P1 | 8120 | 727 | 82.2 | globlastp |
| 4761 | rye\|12v1\|DRR001013.102 | 8121 | 730 | 83.9 | globlastp |
| 4762 | switchgrass\|gb167\|FE639307 | 8122 | 733 | 87.8 | globlastp |
| 4763 | switchgrass\|gb167\|FL868802 | 8123 | 733 | 86.2 | globlastp |
| 4764 | sorghum\|12v1\|SB07G026630 | 8124 | 733 | 83 | globlastp |
| 4765 | millet\|10v1\|PMSLX0018649D1_T1 | 8125 | 735 | 80.11 | glotblastn |
| 4766 | switchgrass\|12v1\|FL802295_P1 | 8126 | 736 | 87.5 | globlastp |
| 4767 | switchgrass\|12v1\|FE638239_P1 | 8127 | 736 | 84.8 | globlastp |
| 4768 | sugarcane\|10v1\|CA133855_P1 | 8128 | 736 | 80.5 | globlastp |
| 4769 | maize\|10v1\|W49426_P1 | 8129 | 737 | 95.7 | globlastp |
| 4770 | switchgrass\|gb167\|FE649778 | 8130 | 737 | 85.9 | globlastp |
| 4771 | cenchrus\|gb166\|EB659527_P1 | 8131 | 738 | 84.9 | globlastp |
| 4772 | sorghum\|12v1\|SB06G024550 | 8132 | 740 | 94.6 | globlastp |
| 4773 | rice\|11v1\|BE040488 | 8133 | 740 | 87.5 | globlastp |
| 4774 | rice\|11v1\|D39716 | 8134 | 740 | 81.8 | globlastp |
| 4775 | rice\|11v1\|BE230101 | 8135 | 740 | 81.3 | glotblastn |
| 4776 | barley\|12v1\|AJ432549_P1 | 8136 | 740 | 80.5 | globlastp |
| 4777 | sorghum\|12v1\|SB03G002350 | 8137 | 742 | 89.86 | glotblastn |
| 4778 | switchgrass\|12v1\|FL844034_T1 | 8138 | 742 | 84.29 | glotblastn |
| 4779 | switchgrass\|gb167\|FL844034 | 8139 | 742 | 84.29 | glotblastn |
| 4780 | switchgrass\|12v1\|FE603085_T1 | 8140 | 742 | 80.28 | glotblastn |
| 4781 | maize\|10v1\|BM500226_P1 | 8141 | 745 | 80.2 | globlastp |
| 4782 | switchgrass\|12v1\|FL754128_P1 | 8142 | 746 | 90.4 | globlastp |
| 4783 | barley\|12v1\|DN155880_P1 | 8143 | 746 | 80 | globlastp |
| 4784 | rice\|11v1\|BI807776 | 8144 | 746 | 80 | globlastp |
| 4785 | maize\|10v1\|BM501045_P1 | 8145 | 748 | 94 | globlastp |
| 4786 | sorghum\|12v1\|SB01G007850 | 8146 | 748 | 94 | globlastp |
| 4787 | millet\|10v1\|EVO454PM001162_P1 | 8147 | 748 | 91.3 | globlastp |
| 4788 | switchgrass\|12v1\|FL702906_P1 | 8148 | 748 | 89.5 | globlastp |
| 4789 | rice\|11v1\|GFXAF141942X1 | 8149 | 748 | 87.6 | globlastp |
| 4790 | sorghum\|12v1\|SB01G048260 | 8150 | 749 | 94.4 | globlastp |
| 4791 | maize\|10v1\|AI491652_P1 | 8151 | 749 | 93.7 | globlastp |
| 4792 | switchgrass\|12v1\|FE656148_P1 | 8152 | 749 | 87.4 | globlastp |
| 4793 | foxtail_millet\|11v3\|PHY7SI035085M_P1 | 8153 | 749 | 87.4 | globlastp |
| 4794 | switchgrass\|12v1\|FL696332_P1 | 8154 | 749 | 86.7 | globlastp |
| 4795 | switchgrass\|gb167\|FE656148 | 8155 | 749 | 85.66 | glotblastn |
| 4796 | rice\|11v1\|BI795865 | 8156 | 749 | 81.1 | globlastp |
| 4797 | brachypodium\|12v1\|BRADI1G76321_P1 | 8157 | 749 | 80.4 | globlastp |
| 4798 | brachypodium\|12v1\|BRADI1G76314_P1 | 8158 | 749 | 80 | globlastp |
| 4799 | foxtail_millet\|11v3\|PHY7SI013180M_P1 | 8159 | 750 | 84.2 | globlastp |
| 4800 | switchgrass\|12v1\|FL691835_P1 | 8160 | 750 | 83.3 | globlastp |
| 4801 | sugarcane\|10v1\|CA073362 | 8161 | 751 | 84.31 | glotblastn |
| 4802 | sorghum\|12v1\|SB02G024920 | 8162 | 751 | 84.06 | glotblastn |
| 4803 | maize\|10v1\|DR795538_T1 | 8163 | 751 | 83.5 | glotblastn |
| 4804 | foxtail_millet\|11v3\|PHY7SI029454M_P1 | 8164 | 754 | 80.7 | globlastp |
| 4805 | foxtail_millet\|11v3\|PHY7SI030299M_P1 | 8165 | 756 | 80.1 | globlastp |

Provided are the homologous (e.g., orthologues) polypeptides and polynucleotides of the genes for increasing yield (e.g., oil yield, seed yield, fiber yield and/or quality), growth rate, vigor, photosynthetic capacity, biomass, abiotic stress tolerance, nitrogen use efficiency, water use efficiency and fertilizer use efficiency genes of a plant which are listed in Table 1 above.
Homology was calculated as % of identity over the aligned sequences.
The query sequences were polynucleotide sequences SEQ ID NOs: 1-473; and polypeptide SEQ ID NOs: 474-760 and the subject sequences are protein sequences identified in the database based on greater than 80% global identity to the predicted translated sequences of the query nucleotide sequences or to the polypeptide sequences.
"P.N." = polynucleotide; "P.P." = polypeptide; "Algor." = algorithm (used for sequence alignment and determination of percent homology); "Hom."—homology; "iden."—identity.

The output of the functional genomics approach described herein is a set of genes highly predicted to improve yield and/or other agronomic important traits such as growth rate, harvest index, leaf area, vigor, oil content, fiber yield and/or quality, biomass, photosynthetic capacity, growth rate, abiotic stress tolerance, nitrogen use efficiency, water use efficiency and fertilizer use efficiency of a plant by increasing their expression. Although each gene is predicted to have its own impact, modifying the mode of expression of more than one gene is expected to provide an additive or synergistic effect on the plant yield and/or other agronomic important yields performance. Altering the expression of each gene described here alone or set of genes together increases the overall yield and/or other agronomic important traits, hence expects to increase agricultural productivity.

Example 3

Production of Barley Transcriptome and High Throughput Correlation Analysis Using 44K Barley Oligonucleotide Micro-Array In order to produce a high throughput correlation analysis, the present inventors utilized a Barley oligonucleotide micro-array, produced by Agilent Technologies [chem.(dot)agilent(dot)com/Scripts/PDS(dot)asp?1Page=50879]. The array oligonucleotide represents about 47,500 Barley genes and transcripts. In order to define correlations between the levels of RNA expression and yield or vigor related parameters, various plant characteristics of 25 different Barley accessions were analyzed. Among them, 13 accessions encompassing the observed variance were selected for RNA expression analysis. The correlation between the RNA levels and the characterized parameters was analyzed using Pearson correlation test [davidmlane(dot)com/hyperstat/A34739(dot)html].

Experimental Procedures

Four tissues at different developmental stages [meristem, flowering spike, booting spike, stem], representing different plant characteristics, were sampled and RNA was extracted as described hereinabove under "GENERAL EXPERIMENTAL AND BIOINFORMATICS METHODS".

For convenience, each micro-array expression information tissue type has received a Set ID as summarized in Table 3 below.

TABLE 3

Barley transcriptome expression sets

| Expression Set | Set ID |
| --- | --- |
| booting spike at flowering stage | 1 |
| flowering spike at flowering stage | 2 |
| Meristem at flowering stage | 3 |
| stem at flowering stage | 4 |

Provided are the identification (ID) letters of each of the Barley expression sets.

Barley yield components and vigor related parameters assessment—13 Barley accessions in 4 repetitive blocks (named A, B, C, and D), each containing 4 plants per plot were grown at net house. Plants were phenotyped on a daily basis following the standard descriptor of barley (Table 4, below). Harvest was conducted while 50% of the spikes were dry to avoid spontaneous release of the seeds. Plants were separated to the vegetative part and spikes, of them, 5 spikes were threshed (grains were separated from the glumes) for additional grain analysis such as size measurement, grain count per spike and grain yield per spike. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih(dot)gov/]. Next, analyzed data was saved to text files and processed using the JMP statistical analysis software (SAS institute).

TABLE 4

Barley standard descriptors

| Trait | Parameter | Range | Description |
| --- | --- | --- | --- |
| Growth habit | Scoring | 1-9 | Prostrate (1) or Erect (9) |
| Hairiness of basal leaves | Scoring | P (Presence)/ A (Absence) | Absence (1) or Presence (2) |
| Stem pigmentation | Scoring | 1-5 | Green (1), Basal only or Half or more (5) |
| Days to Flowering | Days | | Days from sowing to emergence of awns |
| Plant height | Centimeter (cm) | | Height from ground level to top of the longest spike excluding awns |
| Spikes per plant | Number | | Terminal Counting |
| Spike length | Centimeter (cm) | | Terminal Counting 5 spikes per plant |
| Grains per spike | Number | | Terminal Counting 5 spikes per plant |
| Vegetative dry weight | Gram | | Oven-dried for 48 hours at 70° C. |
| Spikes dry weight | Gram | | Oven-dried for 48 hours at 30° C. |

At the end of the experiment (50% of the spikes were dry) all spikes from plots within blocks A-D were collected, and the following measurements were performed:

(i) Grains per spike—The total number of grains from 5 spikes that were manually threshed was counted. The average grain per spike was calculated by dividing the total grain number by the number of spikes.

(ii) Grain average size (cm)—The total grains from 5 spikes that were manually threshed were scanned and images were analyzed using the digital imaging system. Grain scanning was done using Brother scanner (model DCP-135), at the 200 dpi resolution and analyzed with Image J software. The average grain size was calculated by dividing the total grain size by the total grain number.

(iii) Grain average weight (mgr)—The total grains from 5 spikes that were manually threshed were counted and weight. The average weight was calculated by dividing the total weight by the total grain number.

(iv) Grain yield per spike (gr) (=seed yield of 5 spikes)—The total grains from 5 spikes that were manually threshed were weight. The grain yield was calculated by dividing the total weight by the spike number.

(v) Spike length analysis—The five chosen spikes per plant were measured using measuring tape excluding the awns.

(vi) Spike number analysis—The spikes per plant were counted.

Additional parameters were measured as follows:

Growth habit scoring—At growth stage 10 (booting), each of the plants was scored for its growth habit nature. The scale that was used was 1 for prostate nature till 9 for erect.

Hairiness of basal leaves—At growth stage 5 (leaf sheath strongly erect; end of tillering), each of the plants was scored for its hairiness nature of the leaf before the last. The scale that was used was 1 for prostate nature till 9 for erect.

Plant height—At harvest stage (50% of spikes were dry), each of the plants was measured for its height using measuring tape. Height was measured from ground level to top of the longest spike excluding awns.

Days to flowering—Each of the plants was monitored for flowering date. Days of flowering was calculated from sowing date till flowering date.

Stem pigmentation—At growth stage 10 (booting), each of the plants was scored for its stem color. The scale that was used was 1 for green till 5 for full purple.

Vegetative dry weight and spike yield—At the end of the experiment (50% of the spikes were dry) all spikes and vegetative material from plots within blocks A-D are collected. The biomass and spikes weight of each plot was separated, measured and divided by the number of plants.

Dry weight=total weight of the vegetative portion above ground (excluding roots) after drying at 70° C. in oven for 48 hours;

Spike yield per plant=total spike weight per plant (gr) after drying at 30° C. in oven for 48 hours.

TABLE 5

Barley correlated parameters (vectors)

| Correlated parameter with | Correlation ID |
|---|---|
| Grain weight (milligrams) | 1 |
| Grains size (mm$^2$) | 2 |
| Grains per spike (numbers) | 3 |
| Growth habit (scores 1-9) | 4 |
| Hairiness of basal leaves (scoring 1-2) | 5 |
| Plant height (cm) | 6 |

TABLE 5-continued

Barley correlated parameters (vectors)

| Correlated parameter with | Correlation ID |
|---|---|
| Seed yield of 5 spikes (gr) | 7 |
| Spike length (cm) | 8 |
| Spikes per plant (numbers) | 9 |
| Stem pigmentation (scoring 1-5) | 10 |
| Vegetative dry weight (gram) | 11 |
| Days to flowering (days) | 12 |

Provided are the Barley correlated parameters (vectors).

Experimental Results 13 different Barley accessions were grown and characterized for 12 parameters as described above. The average for each of the measured parameter was calculated using the JMP software and values are summarized in Tables 6 and 7 below. Subsequent correlation analysis between the various transcriptome expression sets (Table 3) and the average parameters was conducted. Follow, results were integrated to the database (Table 8 below).

TABLE 6

Measured parameters of correlation IDs in Barley accessions

| Ecotype/Treatment | Line-1 | Line-2 | Line-3 | Line-4 | Line-5 | Line-6 | Line-7 |
|---|---|---|---|---|---|---|---|
| 1 | 35.05 | 28.06 | 28.76 | 17.87 | 41.22 | 29.73 | 25.22 |
| 2 | 0.27 | 0.23 | 0.24 | 0.17 | 0.29 | 0.28 | 0.22 |
| 3 | 20.23 | 17.98 | 17.27 | 17.73 | 14.47 | 16.78 | 12.12 |
| 4 | 2.60 | 2.00 | 1.92 | 3.17 | 4.33 | 2.69 | 3.60 |
| 5 | 1.53 | 1.33 | 1.69 | 1.08 | 1.42 | 1.69 | 1.30 |
| 6 | 134.27 | 130.50 | 138.77 | 114.58 | 127.75 | 129.38 | 103.89 |
| 7 | 3.56 | 2.54 | 2.58 | 1.57 | 3.03 | 2.52 | 1.55 |
| 8 | 12.04 | 10.93 | 11.83 | 9.90 | 11.68 | 11.53 | 8.86 |
| 9 | 48.85 | 48.27 | 37.42 | 61.92 | 33.27 | 41.69 | 40.00 |
| 10 | 1.13 | 2.50 | 1.69 | 1.75 | 2.33 | 2.31 | 1.70 |
| 11 | 78.87 | 66.14 | 68.49 | 53.39 | 68.30 | 74.17 | 35.35 |
| 12 | 62.40 | 64.08 | 65.15 | 58.92 | 63.00 | 70.54 | 52.80 |

Provided are the values of each of the parameters measured in Barley accessions according to the correlation identifications (see Table 5).

TABLE 7

Barley accessions, additional measured parameters

| Ecotype/Treatment | Line-8 | Line-9 | Line-10 | Line-11 | Line-12 | Line-13 |
|---|---|---|---|---|---|---|
| 1 | 34.99 | 20.58 | 27.50 | 37.13 | 29.56 | 19.58 |
| 2 | 0.28 | 0.19 | 0.22 | 0.27 | 0.27 | 0.18 |
| 3 | 14.07 | 21.54 | 12.10 | 13.40 | 15.28 | 17.07 |
| 4 | 3.50 | 3.00 | 3.67 | 2.47 | 3.50 | 3.00 |
| 5 | 1.19 | 1.00 | 1.17 | 1.60 | 1.08 | 1.17 |
| 6 | 121.63 | 126.80 | 99.83 | 121.40 | 118.42 | 117.17 |
| 7 | 2.62 | 2.30 | 1.68 | 2.68 | 2.35 | 1.67 |
| 8 | 11.22 | 11.11 | 8.58 | 10.18 | 10.51 | 9.80 |
| 9 | 40.63 | 62.00 | 49.33 | 50.60 | 43.09 | 51.40 |
| 10 | 2.19 | 2.30 | 1.83 | 3.07 | 1.58 | 2.17 |
| 11 | 58.33 | 62.23 | 38.32 | 68.31 | 56.15 | 42.68 |
| 12 | 60.88 | 58.10 | 53.00 | 60.40 | 64.58 | 56.00 |

Provided are the values of each of the parameters measured in Barley accessions according to the correlation identifications (see Table 5).

TABLE 8

Correlation between the expression level of the selected polynucleotides of the invention and their homologues in specific tissues or developmental stages and the phenotypic performance across Barley accessions

| Gene Name | R | P value | Exp. set | Corr. Set ID | Gene Name | R | P value | Exp. set | Corr. Set ID |
|---|---|---|---|---|---|---|---|---|---|
| LYM1018 | 0.71 | 1.44E−02 | 3 | 9 | LYM1018 | 0.86 | 5.95E−04 | 3 | 3 |
| LYM1018 | 0.79 | 3.73E−03 | 3 | 12 | LYM1019 | 0.73 | 1.01E−02 | 1 | 2 |
| LYM1019 | 0.71 | 1.48E−02 | 1 | 1 | LYM1020 | 0.82 | 2.04E−03 | 3 | 9 |
| LYM1024 | 0.73 | 1.58E−02 | 2 | 2 | LYM1026 | 0.76 | 6.97E−03 | 3 | 10 |
| LYM1027 | 0.83 | 1.63E−03 | 3 | 9 | LYM1029 | 0.70 | 1.62E−02 | 1 | 2 |
| LYM1029 | 0.71 | 1.37E−02 | 1 | 1 | LYM1029 | 0.70 | 1.60E−02 | 1 | 7 |
| LYM1029 | 0.72 | 1.31E−02 | 3 | 7 | LYM1029 | 0.88 | 3.86E−04 | 3 | 11 |
| LYM1030 | 0.79 | 3.61E−03 | 1 | 2 | LYM1030 | 0.77 | 5.34E−03 | 1 | 1 |
| LYM1030 | 0.74 | 9.84E−03 | 1 | 7 | LYM1040 | 0.86 | 6.47E−04 | 1 | 1 |
| LYM1040 | 0.85 | 8.84E−04 | 1 | 2 | LYM1040 | 0.73 | 1.09E−02 | 1 | 5 |
| LYM1040 | 0.84 | 1.09E−03 | 1 | 7 | LYM1060 | 0.79 | 3.94E−03 | 1 | 6 |
| LYM1040 | 0.76 | 6.56E−03 | 3 | 9 | LYM1060 | 0.76 | 6.99E−03 | 1 | 7 |
| LYM1051 | 0.72 | 1.94E−02 | 2 | 4 | LYM1060 | 0.73 | 1.14E−02 | 1 | 3 |
| LYM1060 | 0.78 | 4.36E−03 | 1 | 8 | LYM1062 | 0.70 | 1.56E−02 | 3 | 9 |
| LYM1060 | 0.74 | 9.49E−03 | 1 | 11 | LYM1071 | 0.74 | 9.11E−03 | 1 | 4 |
| LYM1060 | 0.78 | 4.38E−03 | 3 | 9 | LYM1072 | 0.71 | 1.54E−02 | 1 | 9 |
| LYM1074 | 0.71 | 1.52E−02 | 3 | 9 | LYM1074 | 0.73 | 1.02E−02 | 1 | 9 |
| LYM1071 | 0.83 | 1.65E−03 | 3 | 9 | LYM1075 | 0.85 | 1.03E−03 | 3 | 9 |
| LYM1072 | 0.83 | 1.39E−03 | 3 | 9 | | | | | |

Provided are the correlations (R) and p-values (P) between the expression levels of selected genes of some embodiments of the invention in various tissues or developmental stages (Expression sets) and the phenotypic performance in various yield (seed yield, oil yield, oil content), biomass, growth rate and/or vigor components [Correlation (Corr.) vector (Vec.) Expression (Exp.)] Corr. Vector = correlation vector specified in Tables 5, 6 and 7; Exp. Set = expression set specified in Table 3.

Example 4

Production of Sorghum Transcriptome and High Throughput Correlation Analysis with ABST Related Parameters Using 44K Sorghum Oligonucleotide Micro-Arrays In order to produce a high throughput correlation analysis between plant phenotype and gene expression level, the present inventors utilized a sorghum oligonucleotide microarray, produced by Agilent Technologies [chem.(dot)agilent (dot)com/Scripts/PDS(dot)asp?1Page=50879]. The array oligonucleotide represents about 44,000 sorghum genes and transcripts. In order to define correlations between the levels of RNA expression with ABST, yield and NUE components or vigor related parameters, various plant characteristics of 17 different sorghum hybrids were analyzed. Among them, 10 hybrids encompassing the observed variance were selected for RNA expression analysis. The correlation between the RNA levels and the characterized parameters was analyzed using Pearson correlation test [davidmlane (dot) com/hyperstat/A34739(dot)html].

I. Correlation of Sorghum Varieties Across Ecotypes Grown Under Regular Growth Conditions, Severe Drought Conditions and Low Nitrogen Conditions Experimental Procedures 17 Sorghum varieties were grown in 3 repetitive plots, in field. Briefly, the growing protocol was as follows:

1. Regular (normal, non-stress) growth conditions: sorghum plants were grown in the field using commercial fertilization and irrigation protocols (370 liter per meter, fertilization of 14 units of 21% urea per entire growth period).

2. Drought conditions: sorghum seeds were sown in soil and grown under normal (non-stress) conditions until around 35 days from sowing, around stage V8 (eight green leaves are fully expanded, booting not started yet). At this point, irrigation was stopped, and severe drought stress was developed.

3. Low Nitrogen fertilization conditions: sorghum plants were fertilized with 50% less amount of nitrogen in the field than the amount of nitrogen applied in the regular growth treatment. All the fertilizer was applied before flowering.

Analyzed Sorghum tissues—All 10 selected Sorghum hybrids were sampled per each treatment. Tissues [Flag leaf, Flower meristem and Flower] from plants growing under normal conditions, severe drought stress and low nitrogen conditions were sampled and RNA was extracted as described above. Each micro-array expression information tissue type has received a Set ID as summarized in Table 9 below.

TABLE 9

Sorghum transcriptome expression sets

| Expression Set | Set ID |
|---|---|
| Flag leaf at flowering stage under drought growth conditions | 1 |
| Flag leaf at flowering stage under low nitrogen growth conditions | 2 |
| Flag leaf at flowering stage under normal growth conditions | 3 |
| Flower meristem at flowering stage under drought growth conditions | 4 |
| Flower meristem at flowering stage under low nitrogen growth conditions | 5 |
| Flower meristem at flowering stage under normal growth conditions | 6 |
| Flower at flowering stage under drought growth conditions | 7 |
| Flower at flowering stage under low nitrogen growth conditions | 8 |
| Flower at flowering stage under normal growth conditions | 9 |

Provided are the sorghum transcriptome expression sets 1, 2, 3 and 4.
Flag leaf = the leaf below the flower;
Flower meristem = Apical meristem following panicle initiation;
Flower = the flower at the anthesis day.
Flower = are from plants grown under normal conditions.
Expression set 4 derived from plants grown under drought conditions.

The following parameters were collected using digital imaging system:

At the end of the growing period the grains were separated from the plant 'Head' and the following parameters were measured and collected:

Average Grain Area ($cm^2$)—A sample of ~200 grains were weighted, photographed and images were processed using the below described image processing system. The grain area was measured from those images and was divided by the number of grains.

Upper and Lower Ratio Average of Grain Area, width, diameter and perimeter—Grain projection of area, width, diameter and perimeter were extracted from the digital images using open source package imagej (nih). Seed data was analyzed in plot average levels as follows:

Average of all seeds;

Average of upper 20% fraction—contained upper 20% fraction of seeds;

Average of lower 20% fraction—contained lower 20% fraction of seeds;

Further on, ratio between each fraction and the plot average was calculated for each of the data parameters.

At the end of the growing period 5 'Heads' were, photographed and images were processed using the below described image processing system.

(i) Head Average Area ($cm^2$)—At the end of the growing period 5 'Heads' were, photographed and images were processed using the below described image processing system. The 'Head' area was measured from those images and was divided by the number of 'Heads'.

(ii) Head Average Length (cm)—At the end of the growing period 5 'Heads' were, photographed and images were processed using the below described image processing system. The 'Head' length (longest axis) was measured from those images and was divided by the number of 'Heads'.

(iii) Head Average width (cm)—At the end of the growing period 5 'Heads' were, photographed and images were processed using the below described image processing system. The 'Head' width was measured from those images and was divided by the number of 'Heads'.

(iv) Head Average perimeter (cm)—At the end of the growing period 5 'Heads' were, photographed and images were processed using the below described image processing system. The 'Head' perimeter was measured from those images and was divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb(dot)nih(dot)gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Grain Weight/Head (gr.) (grain yield)—At the end of the experiment (plant 'Heads') heads from plots within blocks A-C were collected. 5 heads were separately threshed and grains were weighted, all additional heads were threshed together and weighted as well. The average grain weight per head was calculated by dividing the total grain weight by number of total heads per plot (based on plot). In case of 5 heads, the total grains weight of 5 heads was divided by 5.

FW Head/Plant gram—At the end of the experiment (when heads were harvested) total and 5 selected heads per plots within blocks A-C were collected separately. The heads (total and 5) were weighted (gr.) separately and the average fresh weight per plant was calculated for total (FW Head/Plant gr. based on plot) and for 5 (FW Head/Plant gr. based on 5 plants).

Plant height—Plants were characterized for height during growing period at 5 time points. In each measure, plants were measured for their height using a measuring tape. Height was measured from ground level to top of the longest leaf.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot.

Vegetative fresh weight and Heads—At the end of the experiment (when Inflorescence were dry) all Inflorescence and vegetative material from plots within blocks A-C were collected. The biomass and Heads weight of each plot was separated, measured and divided by the number of Heads.

Plant biomass (Fresh weight)—At the end of the experiment (when Inflorescence were dry) the vegetative material from plots within blocks A-C were collected. The plants biomass without the Inflorescence were measured and divided by the number of Plants.

FW Heads/(FW Heads+FW Plants)—The total fresh weight of heads and their respective plant biomass were measured at the harvest day. The heads weight was divided by the sum of weights of heads and plants.

Experimental Results 17 different sorghum varieties were grown and characterized for different parameters: The average for each of the measured parameter was calculated using the JMP software (Tables 11-12) and a subsequent correlation analysis between the various transcriptome sets (Table 9) and the average parameters, was conducted (Table 13). Results were then integrated to the database.

TABLE 10

Sorghum correlated parameters (vectors)

| Correlated parameter with | Correlation ID |
|---|---|
| Average Grain Area ($cm^2$), Drought | 1 |
| Average Grain Area ($cm^2$), Low N | 2 |
| Average Grain Area ($cm^2$), Normal | 3 |
| FW – Head/Plant gr (based on plot), Drought | 4 |
| FW – Head/Plant gr (based on plot), Low N | 5 |
| FW – Head/Plant gr (based on plot), Normal | 6 |
| FW – Head/Plant gr (based on 5 plants), Low N | 7 |
| FW – Head/Plant gr (based on 5 plants), Normal | 8 |
| FW Heads/(FW Heads + FW Plants)(all plot), Drought | 9 |
| FW Heads/(FW Heads + FW Plants)(all plot), Low N | 10 |
| FW Heads/(FW Heads + FW Plants)(all plot), Normal | 11 |
| FW/Plant gr (based on plot), Drought | 12 |
| FW/Plant gr (based on plot), Low N | 13 |
| FW/Plant gr (based on plot), Normal | 14 |
| Final Plant Height (cm), Drought | 15 |
| Final Plant Height (cm), Low N | 16 |
| Final Plant Height (cm), Normal | 17 |
| Head Average Area ($cm^2$), Drought | 18 |
| Head Average Area ($cm^2$), Low N | 19 |
| Head Average Area ($cm^2$), Normal | 20 |
| Head Average Length (cm), Drought | 21 |
| Head Average Length (cm), Low N | 22 |
| Head Average Length (cm), Normal | 23 |
| Head Average Perimeter (cm), Drought | 24 |
| Head Average Perimeter (cm), Low N | 25 |
| Head Average Perimeter (cm), Normal | 26 |

TABLE 10-continued

Sorghum correlated parameters (vectors)

| Correlated parameter with | Correlation ID |
|---|---|
| Head Average Width (cm), Drought | 27 |
| Head Average Width (cm), Low N | 28 |
| Head Average Width (cm), Normal | 29 |
| Leaf SPAD 64 DPS (Days Post Sowing), Drought | 30 |
| Leaf SPAD 64 DPS (Days Post Sowing), Low N | 31 |
| Leaf SPAD 64 DPS (Days Post Sowing), Normal | 32 |
| Lower Ratio Average Grain Area, Low N | 33 |
| Lower Ratio Average Grain Area, Normal | 34 |
| Lower Ratio Average Grain Length, Low N | 35 |
| Lower Ratio Average Grain Length, Normal | 36 |
| Lower Ratio Average Grain Perimeter, Low N | 37 |
| Lower Ratio Average Grain Perimeter, Normal | 38 |
| Lower Ratio Average Grain Width, Low N | 39 |
| Lower Ratio Average Grain Width, Normal | 40 |
| Total grain weight/Head (based on plot) gr, Low N | 41 |
| Total grain weight/Head gr (based on 5 heads), Low N | 42 |
| Total grain weight/Head gr (based on 5 heads), Normal | 43 |
| Total grain weight/Head gr (based on plot), Normal | 44 |
| Total grain weight/Head gr,(based on plot) Drought | 45 |
| Upper Ratio Average Grain Area, Drought | 46 |
| Upper Ratio Average Grain Area, Low N | 47 |
| Upper Ratio Average Grain Area, Normal | 48 |
| [Grain Yield + plant biomass/SPAD 64 DPS], Normal | 49 |
| [Grain Yield + plant biomass/SPAD 64 DPS], Low N | 50 |
| [Grain yield/SPAD 64 DPS], Low N | 51 |
| [Grain yield/SPAD 64 DPS], Normal | 52 |
| [Plant biomass (FW)/SPAD 64 DPS], Drought | 53 |
| [Plant biomass (FW)/SPAD 64 DPS], Low N | 54 |
| [Plant biomass (FW)/SPAD 64 DPS], Normal | 55 |

Provided are the Sorghum correlated parameters (vectors).
"gr." = grams;
"SPAD" = chlorophyll levels;
"FW" = Plant Fresh weight;
"normal" = standard growth conditions;
"low N" = low nitrogen growth conditions;
"drought" = drought growth conditions;

TABLE 11

Measured parameters in *Sorghum* accessions

| Ecotype/Treatment | Line-1 | Line-2 | Line-3 | Line-4 | Line-5 | Line-6 | Line-7 | Line-8 | Line-9 |
|---|---|---|---|---|---|---|---|---|---|
| 1 | 0.099 | 0.115 | 0.106 | 0.094 | 0.090 | 0.114 | | | |
| 2 | 0.105 | 0.111 | 0.136 | 0.121 | 0.141 | 0.134 | 0.119 | 0.117 | 0.116 |
| 3 | 0.105 | 0.112 | 0.131 | 0.129 | 0.139 | 0.141 | 0.110 | 0.113 | 0.102 |
| 4 | 154.90 | 122.02 | 130.51 | 241.11 | 69.03 | 186.41 | 62.11 | 39.02 | 58.94 |
| 5 | 214.78 | 205.05 | 73.49 | 122.96 | 153.07 | 93.23 | 134.11 | 77.43 | 129.63 |
| 6 | 175.15 | 223.49 | 56.40 | 111.62 | 67.34 | 66.90 | 126.18 | 107.74 | 123.86 |
| 7 | 388.00 | 428.67 | 297.67 | 280.00 | 208.33 | 303.67 | 436.00 | 376.33 | 474.67 |
| 8 | 406.50 | 518.00 | 148.00 | 423.00 | 92.00 | 101.33 | 423.50 | 386.50 | 409.50 |
| 9 | 0.42 | 0.47 | 0.42 | 0.37 | 0.23 | 0.31 | 0.41 | 0.44 | 0.40 |
| 10 | 0.505 | 0.506 | 0.166 | 0.391 | 0.210 | 0.192 | 0.476 | 0.375 | 0.420 |
| 11 | 0.51 | 0.51 | 0.12 | 0.26 | 0.12 | 0.18 | 0.46 | 0.43 | 0.42 |
| 12 | 207.99 | 138.02 | 255.41 | 402.22 | 233.55 | 391.75 | 89.31 | 50.61 | 87.02 |
| 13 | 204.78 | 199.64 | 340.51 | 240.60 | 537.78 | 359.40 | 149.20 | 129.06 | 178.71 |
| 14 | 162.56 | 212.59 | 334.83 | 313.46 | 462.28 | 318.26 | 151.13 | 137.60 | 167.98 |
| 15 | 89.40 | 75.73 | 92.10 | 94.30 | 150.80 | 110.73 | 99.20 | 84.00 | 99.00 |
| 16 | 104.00 | 80.93 | 204.73 | 125.40 | 225.40 | 208.07 | 121.40 | 100.27 | 121.13 |
| 17 | 95.25 | 79.20 | 197.85 | 234.20 | 189.40 | 194.67 | 117.25 | 92.80 | 112.65 |
| 18 | 83.14 | 107.79 | 88.68 | 135.91 | 90.76 | 123.95 | 86.06 | 85.20 | 113.10 |
| 19 | 96.24 | 214.72 | 98.59 | 182.83 | 119.64 | 110.19 | 172.36 | 84.81 | 156.25 |
| 20 | 120.14 | 167.60 | 85.14 | 157.26 | 104.00 | 102.48 | 168.54 | 109.32 | 135.13 |
| 21 | 21.63 | 21.94 | 21.57 | 22.01 | 20.99 | 28.60 | 21.35 | 20.81 | 24.68 |
| 22 | 23.22 | 25.58 | 20.93 | 28.43 | 24.32 | 22.63 | 32.11 | 20.38 | 26.69 |
| 23 | 25.58 | 26.84 | 21.02 | 26.84 | 23.14 | 21.82 | 31.33 | 23.18 | 25.70 |
| 24 | 52.78 | 64.49 | 56.59 | 64.37 | 53.21 | 71.66 | 55.61 | 52.96 | 69.83 |
| 25 | 56.32 | 79.20 | 53.25 | 76.21 | 67.27 | 59.49 | 79.28 | 51.52 | 69.88 |
| 26 | 61.22 | 67.90 | 56.26 | 65.38 | 67.46 | 67.46 | 74.35 | 56.16 | 61.64 |
| 27 | 4.83 | 6.31 | 5.16 | 7.78 | 5.28 | 5.49 | 5.04 | 5.07 | 5.77 |
| 28 | 5.26 | 10.41 | 5.93 | 8.25 | 6.19 | 6.12 | 6.80 | 5.25 | 7.52 |
| 29 | 5.97 | 7.92 | 4.87 | 7.43 | 5.58 | 5.88 | 6.78 | 5.99 | 6.62 |
| 30 | 40.58 | 40.88 | 45.01 | 42.30 | 45.24 | 40.56 | 44.80 | 45.07 | 40.65 |
| 31 | 38.33 | 38.98 | 42.33 | 40.90 | 43.15 | 39.85 | 42.68 | 43.31 | 39.01 |
| 32 | 43.01 | . | 43.26 | 44.74 | 45.76 | 41.61 | 45.21 | 45.14 | 43.03 |
| 33 | 0.815 | 0.770 | 0.810 | 0.793 | 0.780 | 0.799 | 0.834 | 0.788 | 0.806 |
| 34 | 0.825 | 0.740 | 0.778 | 0.802 | 0.697 | 0.699 | 0.827 | 0.805 | 0.841 |
| 35 | 0.910 | 0.900 | 0.921 | 0.898 | 0.908 | 0.926 | 0.918 | 0.890 | 0.901 |
| 36 | 0.914 | 0.884 | 0.921 | 0.908 | 0.890 | 0.877 | 0.913 | 0.903 | 0.920 |
| 37 | 0.901 | 0.884 | 0.915 | 0.897 | 0.919 | 0.918 | 0.916 | 0.891 | 0.898 |
| 38 | 0.914 | 0.869 | 0.913 | 0.948 | 0.902 | 0.915 | 0.913 | 0.910 | 0.918 |
| 39 | 0.901 | 0.852 | 0.893 | 0.880 | 0.863 | 0.871 | 0.910 | 0.888 | 0.899 |
| 40 | 0.908 | 0.833 | 0.850 | 0.874 | 0.788 | 0.799 | 0.904 | 0.893 | 0.915 |
| 41 | 25.95 | 30.57 | 19.37 | 35.62 | 25.18 | 22.18 | 49.96 | 27.48 | 51.12 |
| 42 | 50.27 | 50.93 | 36.13 | 73.10 | 37.87 | 36.40 | 71.67 | 35.00 | 76.73 |
| 43 | 47.40 | 46.30 | 28.37 | 70.40 | 32.15 | 49.23 | 63.45 | 44.45 | 56.65 |
| 44 | 31.12 | 26.35 | 18.72 | 38.38 | 26.67 | 28.84 | 47.67 | 31.00 | 39.99 |
| 45 | 22.11 | 16.77 | 9.19 | 104.44 | 3.24 | 22.00 | 9.97 | 18.58 | 29.27 |
| 46 | 1.31 | 1.19 | 1.29 | 1.46 | 1.21 | 1.21 | | | |
| 47 | 1.18 | 1.31 | 1.11 | 1.21 | 1.19 | 1.18 | 1.16 | 1.23 | 1.17 |

TABLE 11-continued

Measured parameters in *Sorghum* accessions

| Ecotype/Treatment | Line-1 | Line-2 | Line-3 | Line-4 | Line-5 | Line-6 | Line-7 | Line-8 | Line-9 |
|---|---|---|---|---|---|---|---|---|---|
| 48 | 1.22 | 1.30 | 1.13 | 1.14 | 1.16 | 1.15 | 1.19 | 1.23 | 1.25 |
| 49 | 4.50 | 8.17 | 7.87 | 10.68 | 8.34 | 4.40 | 3.74 | 4.83 | 3.67 |
| 50 | 6.02 | 5.91 | 8.50 | 6.75 | 13.05 | 9.58 | 4.67 | 3.61 | 5.89 |
| 51 | 0.68 | 0.78 | 0.46 | 0.87 | 0.58 | 0.56 | 1.17 | 0.63 | 1.31 |
| 52 | 3.78 | 7.74 | 7.01 | 10.10 | 7.65 | 3.34 | 3.05 | 3.90 | 2.83 |
| 53 | 5.13 | 3.38 | 5.67 | 9.51 | 5.16 | 9.66 | 1.99 | 1.12 | 2.14 |
| 54 | 5.34 | 5.12 | 8.05 | 5.88 | 12.46 | 9.02 | 3.50 | 2.98 | 4.58 |
| 55 | 0.72 | 0.43 | 0.86 | 0.58 | 0.69 | 1.05 | 0.69 | 0.93 | 0.84 |

Provided are the values of each of the parameters (as described above) measured in *Sorghum* accessions (ecotype) under normal, low nitrogen and drought conditions.
Growth conditions are specified in the experimental procedure section.

TABLE 12

Additional measured parameters in *Sorghum* accessions

| Ecotype/Treatment | Line-10 | Line-11 | Line-12 | Line-13 | Line-14 | Line-15 | Line-16 | Line-17 |
|---|---|---|---|---|---|---|---|---|
| 2 | 0.129 | 0.131 | 0.120 | 0.116 | 0.115 | 0.107 | 0.121 | 0.109 |
| 3 | 0.118 | 0.121 | 0.111 | 0.117 | 0.108 | 0.105 | 0.110 | 0.105 |
| 4 | 76.37 | 33.47 | 42.20 | 41.53 | 131.67 | 60.84 | 44.33 | 185.44 |
| 5 | 99.83 | 76.95 | 84.25 | 92.24 | 138.83 | 113.32 | 95.50 | 129.49 |
| 6 | 102.75 | 82.33 | 77.59 | 91.17 | 150.44 | 109.10 | 107.58 | 130.88 |
| 7 | 437.67 | 383.00 | 375.00 | 425.00 | 434.00 | 408.67 | 378.50 | 432.00 |
| 8 | 328.95 | 391.00 | 435.75 | 429.50 | 441.00 | 415.75 | 429.50 | 428.50 |
| 9 | 0.443 | 0.472 | 0.468 | 0.484 | 0.354 | 0.349 | 0.231 | 0.327 |
| 10 | 0.441 | 0.429 | 0.387 | 0.438 | 0.439 | 0.442 | 0.430 | 0.417 |
| 11 | 0.44 | 0.46 | 0.45 | 0.45 | 0.51 | 0.46 | 0.44 | 0.39 |
| 12 | 120.43 | 37.21 | 48.18 | 44.20 | 231.60 | 116.01 | 123.08 | 342.50 |
| 13 | 124.27 | 101.33 | 132.12 | 117.90 | 176.99 | 143.67 | 126.98 | 180.45 |
| 14 | 128.97 | 97.62 | 99.32 | 112.24 | 157.42 | 130.55 | 135.66 | 209.21 |
| 15 | 92.20 | 81.93 | 98.80 | 86.47 | 99.60 | 83.00 | 83.53 | 92.30 |
| 16 | 94.53 | 110.00 | 115.07 | 104.73 | 173.67 | 115.60 | 138.80 | 144.40 |
| 17 | 97.50 | 98.00 | 100.00 | 105.60 | 151.15 | 117.10 | 124.45 | 126.50 |
| 18 | 100.79 | 80.41 | 126.89 | 86.41 | 92.29 | 77.89 | 76.93 | |
| 19 | 136.71 | 137.70 | 96.54 | 158.19 | 163.95 | 138.39 | 135.46 | 165.64 |
| 20 | 169.03 | 156.10 | 112.14 | 154.74 | 171.70 | 168.51 | 162.51 | 170.46 |
| 21 | 24.28 | 21.95 | 24.98 | 19.49 | 20.42 | 16.81 | 18.88 | |
| 22 | 26.31 | 25.43 | 23.11 | 27.87 | 28.88 | 27.64 | 25.52 | 30.33 |
| 23 | 28.82 | 28.13 | 22.97 | 28.09 | 30.00 | 30.54 | 27.17 | 29.26 |
| 24 | 65.14 | 55.27 | 69.06 | 53.32 | 56.29 | 49.12 | 51.88 | |
| 25 | 66.17 | 67.37 | 57.90 | 70.61 | 73.76 | 66.87 | 65.40 | 75.97 |
| 26 | 71.40 | 68.56 | 56.44 | 67.79 | 71.54 | 78.94 | 67.03 | 74.11 |
| 27 | 5.37 | 4.66 | 6.35 | 5.58 | 5.76 | 5.86 | 5.10 | |
| 28 | 6.59 | 6.85 | 5.32 | 7.25 | 7.19 | 6.27 | 6.57 | 6.82 |
| 29 | 7.42 | 6.98 | 6.19 | 7.02 | 7.18 | 7.00 | 7.39 | 7.35 |
| 30 | 45.43 | 42.58 | 44.18 | 44.60 | 42.41 | 43.25 | 40.30 | 40.75 |
| 31 | 42.71 | 40.08 | 43.98 | 45.44 | 44.75 | 42.58 | 43.81 | 46.73 |
| 32 | 45.59 | 44.83 | 45.33 | 46.54 | 43.99 | 45.09 | 45.14 | 43.13 |
| 33 | 0.77 | 0.741 | 0.804 | 0.788 | 0.823 | 0.801 | 0.809 | 0.807 |
| 34 | 0.79 | 0.765 | 0.803 | 0.806 | 0.821 | 0.814 | 0.818 | 0.817 |
| 35 | 0.91 | 0.886 | 0.897 | 0.894 | 0.911 | 0.888 | 0.892 | 0.901 |
| 36 | 0.92 | 0.893 | 0.913 | 0.907 | 0.911 | 0.904 | 0.903 | 0.913 |
| 37 | 0.91 | 0.895 | 0.903 | 0.896 | 0.914 | 0.894 | 0.896 | 0.897 |
| 38 | 0.93 | 0.911 | 0.916 | 0.904 | 0.912 | 0.905 | 0.909 | 0.905 |
| 39 | 0.86 | 0.842 | 0.897 | 0.887 | 0.908 | 0.899 | 0.902 | 0.897 |
| 40 | 0.85 | 0.863 | 0.885 | 0.898 | 0.905 | 0.910 | 0.902 | 0.899 |
| 41 | 36.84 | 29.45 | 26.70 | 29.42 | 51.12 | 37.04 | 39.85 | 41.78 |
| 42 | 57.58 | 42.93 | 36.47 | 68.60 | 71.80 | 49.27 | 43.87 | 52.07 |
| 43 | 60.00 | 45.45 | 58.19 | 70.60 | 70.10 | 53.95 | 59.87 | 52.65 |
| 44 | 38.36 | 32.10 | 32.69 | 32.79 | 51.53 | 35.71 | 38.31 | 42.44 |
| 45 | 10.45 | 14.77 | 12.86 | 18.24 | 11.60 | 18.65 | 16.36 | |
| 47 | 1.22 | 1.24 | 1.19 | 1.23 | 1.16 | 1.34 | 1.21 | 1.21 |
| 48 | 1.24 | 1.32 | 1.22 | 1.18 | 1.18 | 1.22 | 1.25 | 1.22 |
| 49 | 2.89 | 2.91 | 3.12 | 4.75 | 3.69 | 3.85 | 5.84 | |
| 50 | 3.77 | 3.26 | 3.61 | 3.24 | 5.10 | 4.25 | 3.81 | 4.76 |
| 51 | 0.86 | 0.73 | 0.61 | 0.65 | 1.14 | 0.87 | 0.91 | 0.89 |
| 52 | 2.18 | 2.19 | 2.41 | 3.58 | 2.90 | 3.01 | 4.85 | |

TABLE 12-continued

Additional measured parameters in *Sorghum* accessions

| Ecotype/ Treatment | Line-10 | Line-11 | Line-12 | Line-13 | Line-14 | Line-15 | Line-16 | Line-17 |
|---|---|---|---|---|---|---|---|---|
| 53 | 2.65 | 0.87 | 1.09 | 0.99 | 5.46 | 2.68 | 3.05 | 8.40 |
| 54 | 2.91 | 2.53 | 3.00 | 2.60 | 3.96 | 3.38 | 2.90 | 3.86 |
| 55 | 0.72 | 0.72 | 0.70 | 1.17 | 0.79 | 0.85 | 0.98 | |

Provided are the values of each of the parameters (as described above) measured in *Sorghum* accessions (ecotype) under normal, low nitrogen and drought conditions.
Growth conditions are specified in the experimental procedure section.

TABLE 13

Correlation between the expression level of selected genes of some embodiments of the invention in various tissues and the phenotypic performance under normal or abiotic stress conditions across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LYM1195 | 0.81 | 8.27E−03 | 9 | 55 | LYM1195 | 0.74 | 1.41E−02 | 5 | 2 |
| LYM1196 | 0.78 | 7.18E−03 | 6 | 3 | LYM1196 | 0.82 | 3.74E−03 | 5 | 2 |
|  |  |  |  |  | LYM1201 | 0.72 | 1.84E−02 | 6 | 40 |
| LYM1201 | 0.83 | 2.97E−03 | 6 | 36 | LYM1201 | 0.77 | 8.83E−03 | 6 | 34 |
| LYM1201 | 0.96 | 1.10E−05 | 5 | 41 | LYM1201 | 0.95 | 3.28E−05 | 5 | 51 |
| LYM1201 | 0.71 | 2.07E−02 | 5 | 16 | LYM1201 | 0.76 | 1.71E−02 | 3 | 55 |
| LYM1201 | 0.74 | 1.49E−02 | 1 | 53 | LYM1201 | 0.74 | 1.51E−02 | 1 | 12 |
| LYM1202 | 0.73 | 1.57E−02 | 5 | 2 | LYM1204 | 0.82 | 3.49E−03 | 6 | 6 |
| LYM1204 | 0.85 | 1.65E−03 | 6 | 14 | LYM1204 | 0.89 | 6.05E−04 | 3 | 6 |
| LYM1204 | 0.91 | 2.44E−04 | 3 | 14 | LYM1205 | 0.80 | 5.08E−03 | 6 | 52 |
| LYM1205 | 0.83 | 3.05E−03 | 6 | 49 | LYM1205 | 0.79 | 6.92E−03 | 6 | 8 |
| LYM1205 | 0.71 | 2.25E−02 | 8 | 5 | LYM1205 | 0.75 | 1.32E−02 | 8 | 50 |
| LYM1205 | 0.84 | 2.13E−03 | 8 | 35 | LYM1205 | 0.73 | 1.57E−02 | 3 | 3 |
| LYM1205 | 0.73 | 2.41E−02 | 7 | 27 | LYM1205 | 0.75 | 1.92E−02 | 7 | 24 |
| LYM1206 | 0.72 | 1.99E−02 | 2 | 47 | LYM1206 | 0.74 | 1.52E−02 | 8 | 35 |
| LYM1206 | 0.71 | 2.16E−02 | 8 | 37 | LYM1206 | 0.91 | 5.65E−04 | 3 | 52 |
| LYM1206 | 0.79 | 6.87E−03 | 3 | 6 | LYM1206 | 0.89 | 1.48E−03 | 3 | 49 |
| LYM1206 | 0.71 | 2.27E−02 | 3 | 8 | LYM1207 | 0.71 | 2.22E−02 | 6 | 44 |
| LYM1207 | 0.70 | 2.37E−02 | 2 | 47 | LYM1207 | 0.83 | 3.18E−03 | 5 | 5 |
| LYM1207 | 0.73 | 1.67E−02 | 5 | 7 | LYM1207 | 0.86 | 1.54E−03 | 5 | 50 |
| LYM1207 | 0.78 | 7.25E−03 | 5 | 54 | LYM1207 | 0.79 | 6.59E−03 | 5 | 10 |
| LYM1207 | 0.76 | 1.09E−02 | 5 | 13 | LYM1208 | 0.80 | 5.70E−03 | 9 | 3 |
| LYM1208 | 0.76 | 1.16E−02 | 2 | 47 | LYM1208 | 0.76 | 1.65E−02 | 3 | 52 |
| LYM1208 | 0.80 | 9.89E−03 | 3 | 49 | LYM1209 | 0.87 | 1.20E−03 | 6 | 3 |
| LYM1209 | 0.71 | 2.03E−02 | 2 | 47 | LYM1209 | 0.85 | 1.83E−03 | 8 | 35 |
| LYM1209 | 0.83 | 3.13E−03 | 8 | 37 | LYM1209 | 0.77 | 9.60E−03 | 5 | 2 |
| LYM1210 | 0.89 | 5.18E−04 | 6 | 3 | LYM1211 | 0.74 | 1.48E−02 | 6 | 3 |
| LYM1211 | 0.72 | 1.91E−02 | 2 | 41 | LYM1211 | 0.84 | 2.59E−03 | 2 | 16 |
| LYM1211 | 0.81 | 4.89E−03 | 4 | 30 | LYM1211 | 0.70 | 2.34E−02 | 5 | 2 |
| LYM1211 | 0.87 | 2.33E−03 | 1 | 18 | LYM1211 | 0.77 | 1.44E−02 | 1 | 27 |
| LYM1211 | 0.90 | 1.01E−03 | 1 | 24 | LYM1211 | 0.71 | 3.24E−02 | 1 | 21 |
| LYM1212 | 0.75 | 1.29E−02 | 6 | 3 | LYM1212 | 0.79 | 1.14E−02 | 3 | 52 |
| LYM1212 | 0.84 | 4.17E−03 | 3 | 49 | LYM1212 | 0.75 | 1.31E−02 | 1 | 30 |
| LYM1213 | 0.72 | 1.94E−02 | 3 | 8 | LYM1213 | 0.74 | 1.48E−02 | 1 | 4 |
| LYM1214 | 0.73 | 1.71E−02 | 6 | 40 | LYM1214 | 0.72 | 1.77E−02 | 6 | 34 |
| LYM1214 | 0.70 | 2.29E−02 | 2 | 47 | LYM1214 | 0.72 | 1.99E−02 | 4 | 53 |
| LYM1214 | 0.71 | 2.10E−02 | 4 | 12 | LYM1214 | 0.76 | 1.13E−02 | 5 | 33 |
| LYM1239 | 0.71 | 2.13E−02 | 9 | 17 | LYM1239 | 0.78 | 8.44E−03 | 9 | 44 |
| LYM1239 | 0.90 | 4.03E−04 | 2 | 16 | LYM1239 | 0.80 | 5.13E−03 | 4 | 30 |
| LYM1239 | 0.88 | 8.34E−04 | 8 | 37 | LYM1239 | 0.71 | 2.08E−02 | 3 | 44 |

Provided are the correlations (R) between the expression levels of yield improving genes and their homologues in tissues [Flag leaf, Flower meristem, stem and Flower; Expression sets (Exp)] and the phenotypic performance in various yield, biomass, growth rate and/or vigor components [Correlation vector (corr.)] under stress conditions or normal conditions across *Sorghum* accessions.
P = p value.

II. Correlation of Sorghum Varieties Across Ecotype Grown Under Salinity Stress and Cold Stress Conditions Sorghum vigor related parameters under 100 mM NaCl and low temperature (10±2° C.)—Ten Sorghum varieties were grown in 3 repetitive plots, each containing 17 plants, at a net house under semi-hydroponics conditions. Briefly, the growing protocol was as follows: Sorghum seeds were sown in trays filled with a mix of vermiculite and peat in a 1:1 ratio. Following germination, the trays were transferred to the high salinity solution (100 mM NaCl in addition to the Full Hogland solution), low temperature (10±2° C. in the presence of Full Hogland solution) or at Normal growth solution [Full Hogland solution at 28±2° C.].

Full Hogland solution consists of: $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

All 10 selected Sorghum varieties were sampled per each treatment. Two tissues [leaves and roots] growing at 100 mM NaCl, low temperature (10±2° C.) or under Normal conditions (full Hogland at a temperature between 28±2° C.) were sampled and RNA was extracted as described hereinabove under "GENERAL EXPERIMENTAL AND BIOINFORMATICS METHODS".

TABLE 14

Sorghum transcriptome expression sets

| Expression Set | Set ID |
|---|---|
| root at vegetative stage (V4-V5) under cold conditions | 1 |
| root vegetative stage (V4-V5) under normal conditions | 2 |
| root vegetative stage (V4-V5) under low nitrogen conditions | 3 |
| root vegetative stage (V4-V5) under salinity conditions | 4 |
| vegetative meristem at vegetative stage (V4-V5) under cold conditions | 5 |
| vegetative meristem at vegetative stage (V4-V5) under low nitrogen conditions | 6 |
| vegetative meristem at vegetative stage (V4-V5) under salinity conditions | 7 |
| vegetative meristem at vegetative stage (V4-V5) under normal conditions | 8 |

Provided are the Sorghum transcriptome expression sets. Cold conditions = 10 ± 2° C.; NaCl = 100 mM NaCl; low nitrogen = 1.2 mM Nitrogen; Normal conditions = 16 mM Nitrogen.

Experimental Results 10 different Sorghum varieties were grown and characterized for the following parameters: "Leaf number Normal"=leaf number per plant under normal conditions (average of five plants); "Plant Height Normal"=plant height under normal conditions (average of five plants); "Root DW 100 mM NaCl"—root dry weight per plant under salinity conditions (average of five plants); The average for each of the measured parameter was calculated using the JMP software and values are summarized in Table 16 below. Subsequent correlation analysis between the various transcriptome sets and the average parameters were conducted (Table 17). Results were then integrated to the database.

TABLE 15

Sorghum correlated parameters (vectors)

| Correlated parameter with | Correlation ID |
|---|---|
| DW Root/Plant-100 mM NaCl (g) | 1 |
| DW Root/Plant-Cold (g) | 2 |
| DW Root/Plant-Low Nitrogen (g) | 3 |
| DW Root/Plant-Normal (g) | 4 |

TABLE 15-continued

Sorghum correlated parameters (vectors)

| Correlated parameter with | Correlation ID |
|---|---|
| DW Shoot/Plant-Low Nitrogen (g) | 5 |
| DW Shoot/Plant-100 mM NaCl (g) | 6 |
| DW Shoot/Plant-Cold (g) | 7 |
| DW Shoot/Plant-Normal (g) | 8 |
| Leaf number TP1-Cold | 9 |
| Leaf number TP2-Cold | 10 |
| Leaf number TP3-Cold | 11 |
| Low N-total biomass (g) | 12 |
| Low N-Shoot/Root | 13 |
| Low N-roots DW (g) | 14 |
| Low N-shoots DW (g) | 15 |
| Low N-percent-root biomass compared to normal | 16 |
| Low N-percent-shoot biomass compared to normal | 17 |
| Low N-percent-total biomass reduction compared to normal | 18 |
| N level/Leaf [Low Nitrogen] | 19 |
| N level/Leaf [100 mM NaCl] | 20 |
| N level/Leaf [Cold] | 21 |
| N level/Leaf [Normal] | 22 |
| Normal-Shoot/Root (g) | 23 |
| Normal-roots DW (g) | 24 |
| Normal-shoots DW (g) | 25 |
| Normal-total biomass (g) | 26 |
| Plant Height TP1-Cold (cm) | 27 |
| Plant Height TP2-Cold (cm) | 28 |
| RGR Leaf Num Normal | 29 |
| Root Biomass [DW-gr.]/SPAD [100 mM NaCl] | 30 |
| Root Biomass [DW-gr.]/SPAD [Cold] | 31 |
| Root Biomass [DW-gr.]/SPAD [Low Nitrogen] | 32 |
| Root Biomass [DW-gr.]/SPAD [Normal] | 33 |
| SPAD-Cold | 34 |
| SPAD-Low Nitrogen | 35 |
| SPAD-Normal | 36 |
| SPAD 100-mM NaCl | 37 |
| Shoot Biomass [DW-gr.]/SPAD [100 mM NaCl] | 38 |
| Shoot Biomass [DW-gr.]/SPAD [Cold] | 39 |
| Shoot Biomass [DW-gr.]/SPAD [Low Nitrogen] | 40 |
| Shoot Biomass [DW-gr.]/SPAD [Normal] | 41 |
| Total Biomass; Root + Shoot [DW-gr.]/SPAD [100 mM NaCl] | 42 |
| Total Biomass; Root + Shoot [DW-gr.]/SPAD [Cold] | 43 |
| Total Biomass; Root + Shoot [DW-gr.]/SPAD [Low Nitrogen] | 44 |
| Total Biomass; Root + Shoot [DW-gr.]/SPAD [Normal] | 45 |

Provided are the Sorghum correlated parameters. Cold conditions = 10 ± 2° C.; NaCl = 100 mM NaCl; low nitrogen = 1.2 mM Nitrogen; Normal conditions = 16 mM Nitrogen.

TABLE 16

Sorghum accessions, measured parameters

| Ecotype/Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 0.05 | 0.10 | 0.12 | 0.07 | 0.08 | 0.08 | 0.14 | 0.10 | 0.16 | 0.14 |
| 2 | 0.07 | 0.11 | 0.16 | 0.09 | 0.08 | 0.11 | 0.14 | 0.13 | 0.11 | 0.14 |
| 3 | 0.04 | 0.11 | 0.20 | 0.10 | 0.08 | 0.09 | 0.13 | 0.09 | 0.09 | 0.09 |
| 4 | 0.05 | 0.13 | 0.17 | 0.10 | 0.11 | 0.12 | 0.14 | 0.12 | 0.10 | 0.11 |
| 5 | 0.08 | 0.19 | 0.33 | 0.16 | 0.16 | 0.16 | 0.26 | 0.20 | 0.13 | 0.18 |
| 6 | 0.09 | 0.19 | 0.20 | 0.14 | 0.13 | 0.13 | 0.15 | 0.19 | 0.10 | 0.12 |
| 7 | 0.08 | 0.15 | 0.19 | 0.11 | 0.13 | 0.16 | 0.15 | 0.15 | 0.11 | 0.14 |
| 8 | 0.101 | 0.236 | 0.313 | 0.158 | 0.194 | 0.188 | 0.241 | 0.244 | 0.185 | 0.242 |
| 9 | 3.00 | 3.00 | 3.50 | 3.17 | 3.40 | 3.20 | 3.13 | 3.07 | 3.07 | 3.00 |
| 10 | 3.90 | 4.13 | 4.63 | 4.17 | 4.27 | 4.23 | 4.20 | 4.30 | 4.17 | 4.00 |
| 11 | 4.73 | 5.33 | 5.43 | 5.50 | 5.33 | 5.07 | 4.50 | 5.40 | 5.37 | 5.18 |
| 12 | 27.53 | 64.12 | 115.23 | 58.02 | 52.22 | 35.10 | 84.57 | 63.73 | 47.03 | 60.00 |
| 13 | 1.87 | 1.71 | 1.73 | 1.57 | 2.10 | 1.81 | 2.06 | 2.10 | 1.50 | 2.00 |
| 14 | 9.65 | 23.54 | 43.88 | 22.58 | 16.89 | 12.44 | 28.19 | 20.53 | 18.76 | 20.09 |
| 15 | 17.88 | 40.59 | 71.35 | 35.44 | 35.33 | 22.66 | 56.38 | 43.20 | 28.27 | 39.91 |
| 16 | 84.53 | 80.95 | 117.00 | 100.52 | 72.54 | 71.78 | 93.47 | 76.05 | 86.82 | 80.51 |
| 17 | 81.57 | 79.16 | 104.75 | 103.50 | 83.71 | 83.22 | 107.69 | 81.39 | 70.30 | 75.86 |
| 18 | 82.58 | 79.81 | 109.10 | 102.32 | 79.74 | 78.77 | 102.49 | 79.59 | 76.07 | 77.36 |
| 19 | 6.89 | 6.57 | 6.31 | 7.45 | 6.89 | 5.87 | 6.15 | 6.05 | 7.68 | 6.74 |
| 20 | 8.18 | 8.50 | 6.12 | 6.98 | 8.49 | 6.92 | 7.76 | 7.08 | 8.60 | 8.17 |
| 21 | 6.05 | 5.68 | 4.98 | 5.87 | 5.30 | 5.90 | 7.21 | 5.30 | 5.91 | 5.70 |
| 22 | 5.01 | 5.00 | 4.82 | 5.02 | 4.31 | 4.29 | 5.37 | 4.25 | 5.87 | 5.53 |
| 23 | 1.98 | 1.94 | 1.90 | 1.59 | 1.81 | 1.58 | 1.76 | 1.99 | 1.89 | 2.20 |
| 24 | 0.86 | 2.19 | 2.83 | 1.69 | 1.76 | 1.96 | 2.27 | 2.04 | 1.09 | 1.88 |
| 25 | 1.65 | 3.87 | 5.14 | 2.58 | 3.18 | 3.08 | 3.95 | 4.00 | 2.02 | 3.97 |
| 26 | 2.51 | 6.06 | 7.96 | 4.28 | 4.94 | 5.04 | 6.22 | 6.04 | 3.11 | 5.85 |
| 27 | 6.50 | 8.77 | 10.40 | 6.80 | 9.03 | 9.00 | 7.97 | 9.17 | 6.50 | 7.23 |
| 28 | 11.17 | 15.87 | 18.43 | 12.20 | 16.03 | 14.63 | 14.60 | 17.27 | 13.43 | 13.91 |
| 29 | 0.155 | 0.186 | 0.159 | 0.173 | 0.171 | 0.168 | 0.174 | 0.171 | 0.174 | 0.204 |
| 30 | 0.002 | 0.003 | 0.004 | 0.002 | 0.002 | 0.003 | 0.004 | 0.003 | 0.005 | 0.004 |
| 31 | 0.002 | 0.004 | 0.006 | 0.003 | 0.003 | 0.004 | 0.004 | 0.004 | 0.003 | 0.005 |
| 32 | 0.002 | 0.004 | 0.007 | 0.003 | 0.003 | 0.003 | 0.005 | 0.003 | 0.003 | 0.003 |
| 33 | 0.002 | 0.005 | 0.006 | 0.004 | 0.004 | 0.005 | 0.005 | 0.005 | 0.003 | 0.003 |
| 34 | 28.62 | 30.31 | 27.04 | 32.28 | 28.28 | 29.89 | 32.47 | 28.63 | 31.71 | 29.56 |
| 35 | 26.88 | 28.02 | 29.64 | 31.52 | 29.61 | 26.82 | 28.48 | 28.21 | 30.48 | 27.63 |
| 36 | 26.70 | 29.33 | 29.86 | 29.09 | 24.98 | 24.62 | 30.79 | 25.50 | 32.89 | 33.54 |
| 37 | 32.73 | 35.14 | 27.97 | 30.93 | 34.53 | 29.99 | 32.09 | 31.86 | 32.51 | 34.32 |
| 38 | 0.003 | 0.005 | 0.007 | 0.004 | 0.004 | 0.004 | 0.005 | 0.006 | 0.003 | 0.004 |
| 39 | 0.003 | 0.005 | 0.007 | 0.003 | 0.005 | 0.006 | 0.005 | 0.005 | 0.004 | 0.005 |
| 40 | 0.003 | 0.007 | 0.011 | 0.005 | 0.005 | 0.006 | 0.009 | 0.007 | 0.004 | 0.007 |
| 41 | 0.004 | 0.008 | 0.010 | 0.005 | 0.008 | 0.008 | 0.008 | 0.010 | 0.006 | 0.007 |
| 42 | 0.004 | 0.008 | 0.012 | 0.007 | 0.006 | 0.007 | 0.009 | 0.009 | 0.008 | 0.008 |
| 43 | 0.005 | 0.009 | 0.013 | 0.006 | 0.008 | 0.009 | 0.009 | 0.010 | 0.007 | 0.009 |
| 44 | 0.005 | 0.011 | 0.018 | 0.008 | 0.008 | 0.009 | 0.014 | 0.010 | 0.007 | 0.010 |
| 45 | 0.006 | 0.013 | 0.016 | 0.009 | 0.012 | 0.012 | 0.012 | 0.014 | 0.009 | 0.011 |

Provided are the measured parameters under 100 mM NaCl and low temperature (8-10° C.) conditions of Sorghum accessions (Seed ID) according to the Correlation ID numbers (described in Table 15 above)

45

TABLE 17

Correlation between the expression level of selected genes of some embodiments of the invention in roots and the phenotypic performance under normal or abiotic stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LYM1195 | 0.80 | 5.68E−03 | 1 | 34 | LYM1196 | 0.71 | 3.36E−02 | 7 | 42 |
| LYM1201 | 0.75 | 2.02E−02 | 6 | 35 | LYM1204 | 0.93 | 2.01E−03 | 3 | 35 |
| LYM1204 | 0.89 | 6.50E−03 | 3 | 19 | LYM1204 | 0.80 | 9.81E−03 | 6 | 35 |
| LYM1207 | 0.87 | 1.10E−02 | 3 | 35 | LYM1207 | 0.73 | 2.43E−02 | 5 | 7 |
| LYM1207 | 0.76 | 1.76E−02 | 5 | 27 | LYM1207 | 0.82 | 6.91E−03 | 5 | 28 |
| LYM1207 | 0.77 | 1.53E−02 | 5 | 10 | LYM1208 | 0.73 | 2.58E−02 | 6 | 32 |
| LYM1208 | 0.74 | 2.36E−02 | 6 | 14 | LYM1208 | 0.74 | 2.36E−02 | 6 | 3 |
| LYM1208 | 0.71 | 3.05E−02 | 6 | 12 | LYM1212 | 0.75 | 1.99E−02 | 8 | 29 |
| LYM1212 | 0.72 | 1.84E−02 | 1 | 11 | LYM1213 | 0.71 | 3.22E−02 | 2 | 22 |
| LYM1213 | 0.81 | 7.93E−03 | 5 | 27 | LYM1213 | 0.73 | 2.65E−02 | 5 | 28 |

TABLE 17-continued

Correlation between the expression level of selected genes of some embodiments of the invention in roots and the phenotypic performance under normal or abiotic stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LYM1213 | 0.75 | 2.01E−02 | 5 | 10 | LYM1214 | 0.71 | 7.54E−02 | 3 | 17 |
| LYM1214 | 0.81 | 7.60E−03 | 5 | 10 | | | | | |

Provided are the correlations (R) between the expression levels yield improving genes and their homologues in various tissues [Expression sets (Exp)] and the phenotypic performance [yield, biomass, growth rate and/or vigor components (Correlation vector)] under abiotic stress conditions (salinity) or normal conditions across Sorghum accessions.
Corr.—Correlation vector as described hereinabove (Table 15).
P = p value.

Example 5

Production of Maize Transcriptome and High Throughput Correlation Analysis Using 60K Maize Oligonucleotide Micro-Array To produce a high throughput correlation analysis, the present inventors utilized a Maize oligonucleotide microarray, produced by Agilent Technologies [chem. (dot) agilent(dot)com/Scripts/PDS(dot)asp?1Page=50879]. The array oligonucleotide represents about 60K Maize genes and transcripts designed based on data from Public databases (Example 1). To define correlations between the levels of RNA expression and yield, biomass components or vigor related parameters, various plant characteristics of 12 different Maize hybrids were analyzed. Among them, 10 hybrids encompassing the observed variance were selected for RNA expression analysis. The correlation between the RNA levels and the characterized parameters was analyzed using Pearson correlation test [davidmlane(dot)com/hyperstat/A34739(dot)html].

Experimental Procedures

Five tissues at different developmental stages including Ear (flowering -R1), leaf (flowering -R1), Leaf Grain from the basal ear part, Grain from the distal ear, representing different plant characteristics, were sampled and RNA was extracted as described in "GENERAL EXPERIMENTAL AND BIOINFORMATICS METHODS". For convenience, each micro-array expression information tissue type has received a Set ID as summarized in Table 18 below.

TABLE 18

Tissues used for Maize transcriptome expression sets

| Expression Set | Set ID |
|---|---|
| Ear under normal conditions at reproductive stage: R1-R2 | 1 |
| Ear under normal conditions at reproductive stage: R3-R4 | 2 |
| Internode under normal conditions at vegetative stage: V2-V3 | 3 |
| Internode under normal conditions at reproductive stage: R1-R2 | 4 |
| Internode under normal conditions at vegetative stage: R3-R4 | 5 |
| Leaf under normal conditions at vegetative stage: V2-V3 | 6 |
| Leaf under normal conditions at reproductive stage: R1-R2 | 7 |
| Grain distal under normal conditions at reproductive stage: R4-R5 | 8 |

Provided are the identification (ID) number of each of the Maize expression sets The following parameters were collected:

Grain Area ($cm^2$)—At the end of the growing period the grains were separated from the ear. A sample of ~200 grains were weight, photographed and images were processed using the below described image processing system. The grain area was measured from those images and was divided by the number of grains.

Grain Length and Grain width (cm)—At the end of the growing period the grains were separated from the ear. A sample of ~200 grains were weighted, photographed and images were processed using the below described image processing system. The sum of grain lengths/or width (longest axis) was measured from those images and was divided by the number of grains.

Ear Area ($cm^2$)—At the end of the growing period 6 ears were, photographed and images were processed using the below described image processing system. The Ear area was measured from those images and was divided by the number of Ears.

Ear Length and Ear Width (cm)—At the end of the growing period 6 ears were photographed and images were processed using the below described image processing system. The Ear length and width (longest axis) was measured from those images and was divided by the number of ears.

Filled per Whole Ear—it was calculated as the length of the ear with grains out of the total ear.

Percent Filled Ear—At the end of the growing period 6 ears were photographed and images were processed using the below described image processing system. The percent filled Ear grain was the ear with grains out of the total ear and was measured from those images and was divided by the number of Ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb(dot)nih(dot)gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (gr.)(yield)—At the end of the experiment all ears from plots within blocks A-C were collected. 6 ears were separately threshed and grains were weighted, all additional ears were threshed together and weighted as well. The grain weight was normalized using the relative humidity to be 0%. The normalized average grain weight per ear was calculated by dividing the total normalized grain weight by the total number of ears per plot (based on plot). In case of 6 ears, the total grains weight of 6 ears was divided by 6.

Ear FW (gr.)—At the end of the experiment (when ears were harvested) total and 6 selected ears per plots within blocks A-C were collected separately. The plants with (total and 6) were weighted (gr.) separately and the average ear per plant was calculated for total (Ear FW per plot) and for 6 (Ear FW per plant).

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located.

Leaf number per plant—Plants were characterized for leaf number during growing period at 5 time points. In each measure, plants were measured for their leaf number by counting all the leaves of 3 selected plants per plot.

Relative Growth Rate—RGR of leaf number was performed using Formula VIII above (measured in grams per day).

SPAD—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS).

Dry weight per plant—At the end of the experiment when all vegetative material from plots within blocks A-C were collected, weight and divided by the number of plants.

Ear diameter [cm]—The diameter of the ear at the mid of the ear was measured using a ruler.

Cob diameter [cm]—The diameter of the cob without grains was measured using a ruler.

Kernel Row Number per Ear—The number of rows in each ear was counted. The average of 6 ears per plot was calculated.

Leaf area index [LAI]=total leaf area of all plants in a plot. Measurement was performed using a Leaf area-meter.

Yield/LAI [kg]—is the ratio between total grain yields and total leaf area index.

TABLE 19

Maize correlated parameters (vectors)

| Correlated parameter with | Correlation ID |
|---|---|
| Cob Diameter [mm] | 1 |
| DW per Plant based on 6 [gr] | 2 |
| Ear Area [cm$^2$] | 3 |
| Ear FW per Plant based on 6 [gr] | 4 |
| Ear Height [cm] | 5 |
| Ear Length [cm] | 6 |
| Ear Width [cm] | 7 |
| Ears FW per plant based on all [gr] | 8 |
| Filled per Whole Ear [value] | 9 |
| Grain Area [cm$^2$] | 10 |
| Grain Length [cm] | 11 |
| Grain Width [cm] | 12 |
| Growth Rate Leaf Num [gr/day] | 13 |
| Kernel Row Number per Ear | 14 |
| Leaf Number per Plant | 15 |
| Normalized Grain Weight per Plant based on all [gr] | 16 |
| Normalized Grain Weight per plant based on 6 [gr] | 17 |
| Percent Filled Ear | 18 |
| Plant Height per Plot [cm] | 19 |
| SPAD R1 | 20 |
| SPAD R2 | 21 |

Twelve maize varieties were grown, and characterized for parameters, as described above. The average for each parameter was calculated using the JMP software, and values are summarized in Tables 20-21 below. Subsequent correlation between the various transcriptome sets for all or sub set of lines was done by the bioinformatic unit and results were integrated into the database (Table 22 below).

TABLE 20

Measured parameters in Maize Hybrid

| Ecotype/Treatment | Line-1 | Line-2 | Line-3 | Line-4 | Line-5 | Line-6 |
|---|---|---|---|---|---|---|
| 1 | 28.96 | 25.08 | 28.05 | 25.73 | 28.72 | 25.78 |
| 2 | 657.50 | 491.67 | 641.11 | 580.56 | 655.56 | 569.44 |
| 3 | 85.06 | 85.84 | 90.51 | 95.95 | 91.62 | 72.41 |
| 4 | 245.83 | 208.33 | 262.22 | 263.89 | 272.22 | 177.78 |
| 5 | 135.17 | 122.33 | 131.97 | 114.00 | 135.28 | 94.28 |
| 6 | 19.69 | 19.05 | 20.52 | 21.34 | 20.92 | 18.23 |
| 7 | 5.58 | 5.15 | 5.67 | 5.53 | 5.73 | 5.23 |
| 8 | 278.19 | 217.50 | 288.28 | 247.88 | 280.11 | 175.84 |
| 9 | 0.916 | 0.922 | 0.927 | 0.917 | 0.908 | 0.950 |
| 10 | 0.753 | 0.708 | 0.755 | 0.766 | 0.806 | 0.713 |
| 11 | 1.167 | 1.092 | 1.180 | 1.205 | 1.228 | 1.123 |
| 12 | 0.810 | 0.814 | 0.803 | 0.803 | 0.824 | 0.803 |
| 13 | 0.283 | 0.221 | 0.281 | 0.269 | 0.306 | 0.244 |
| 14 | 16.17 | 14.67 | 16.20 | 15.89 | 16.17 | 15.17 |
| 15 | 12.00 | 11.11 | 11.69 | 11.78 | 11.94 | 12.33 |
| 16 | 153.90 | 135.88 | 152.50 | 159.16 | 140.46 | 117.14 |
| 17 | 140.68 | 139.54 | 153.67 | 176.98 | 156.61 | 119.67 |
| 18 | 80.62 | 86.76 | 82.14 | 92.71 | 80.38 | 82.76 |
| 19 | 278.08 | 260.50 | 275.13 | 238.50 | 286.94 | 224.83 |
| 20 | 51.67 | 56.41 | 53.55 | 55.21 | 55.30 | 59.35 |
| 21 | 54.28 | 57.18 | 56.01 | 59.68 | 54.77 | 59.14 |

TABLE 21

Measured parameters in Maize Hybrid additional parameters

| Ecotype/Treatment | Line-7 | Line-8 | Line-9 | Line-10 | Line-11 | Line-12 |
|---|---|---|---|---|---|---|
| 1 | 26.43 | 25.19 |  | 26.67 |  |  |
| 2 | 511.11 | 544.44 |  | 574.17 | 522.22 |  |
| 3 | 74.03 | 76.53 |  | 55.20 | 95.36 |  |
| 4 | 188.89 | 197.22 |  | 141.11 | 261.11 |  |
| 5 | 120.94 | 107.72 |  | 60.44 | 112.50 |  |
| 6 | 19.02 | 18.57 |  | 16.69 | 21.70 |  |
| 7 | 5.22 | 5.33 |  | 4.12 | 5.58 |  |
| 8 | 192.47 | 204.70 |  | 142.72 | 264.24 |  |
| 9 | 0.873 | 0.939 |  | 0.80 | 0.96 |  |
| 10 | 0.714 | 0.753 |  | 0.50 | 0.76 |  |
| 11 | 1.139 | 1.134 |  | 0.92 | 1.18 |  |
| 12 | 0.791 | 0.837 |  | 0.67 | 0.81 |  |
| 13 | 0.244 | 0.266 |  | 0.19 | 0.30 |  |
| 14 | 16.00 | 14.83 |  | 14.27 | 15.39 |  |
| 15 | 12.44 | 12.22 |  | 9.28 | 12.56 |  |
| 16 | 123.24 | 131.27 |  | 40.84 | 170.66 |  |
| 17 | 119.69 | 133.51 |  | 54.32 | 173.23 |  |
| 18 | 73.25 | 81.06 |  | 81.06 | 91.60 |  |
| 19 | 264.44 | 251.61 |  | 163.78 | 278.44 |  |
| 20 | 58.48 | 55.88 | 52.98 | 53.86 | 59.75 | 49.99 |
| 21 | 57.99 | 60.36 | 54.77 | 51.39 | 61.14 | 53.34 |

TABLE 22

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LYM1129 | 0.74 | 9.31E−02 | 2 | 2 | LYM1130 | 0.71 | 4.65E−02 | 5 | 14 |
| LYM1130 | 0.80 | 1.82E−02 | 5 | 13 | LYM1130 | 0.76 | 2.83E−02 | 5 | 11 |
| LYM1130 | 0.85 | 3.30E−02 | 2 | 3 | LYM1130 | 0.72 | 1.04E−01 | 2 | 16 |
| LYM1130 | 0.72 | 1.09E−01 | 2 | 13 | LYM1130 | 0.80 | 5.77E−02 | 2 | 11 |
| LYM1130 | 0.78 | 6.72E−02 | 2 | 6 | LYM1130 | 0.82 | 4.41E−02 | 2 | 7 |
| LYM1130 | 0.75 | 8.40E−02 | 2 | 8 | LYM1130 | 0.82 | 4.40E−02 | 2 | 4 |
| LYM1130 | 0.83 | 4.19E−02 | 2 | 17 | LYM1131 | 0.78 | 3.69E−02 | 4 | 5 |
| LYM1131 | 0.78 | 4.01E−02 | 7 | 3 | LYM1131 | 0.73 | 6.39E−02 | 7 | 16 |
| LYM1131 | 0.86 | 1.37E−02 | 7 | 5 | LYM1131 | 0.75 | 5.46E−02 | 7 | 17 |
| LYM1131 | 0.75 | 5.29E−02 | 1 | 10 | LYM1131 | 0.78 | 3.71E−02 | 1 | 5 |
| LYM1131 | 0.72 | 7.06E−02 | 1 | 7 | LYM1131 | 0.74 | 5.64E−02 | 1 | 12 |
| LYM1131 | 0.83 | 1.10E−02 | 8 | 1 | LYM1131 | 0.77 | 2.56E−02 | 8 | 14 |
| LYM1131 | 0.83 | 1.15E−02 | 8 | 13 | LYM1131 | 0.80 | 1.81E−02 | 8 | 11 |
| LYM1131 | 0.71 | 4.81E−02 | 8 | 10 | LYM1131 | 0.78 | 2.17E−02 | 8 | 2 |
| LYM1131 | 0.72 | 4.42E−02 | 8 | 7 | LYM1131 | 0.72 | 2.91E−02 | 3 | 14 |
| LYM1132 | 0.81 | 1.55E−02 | 8 | 1 | LYM1132 | 0.73 | 3.82E−02 | 8 | 14 |
| LYM1133 | 0.76 | 7.73E−02 | 7 | 1 | LYM1133 | 0.71 | 7.31E−02 | 7 | 18 |
| LYM1133 | 0.73 | 1.59E−02 | 6 | 18 | LYM1133 | 0.88 | 2.14E−02 | 2 | 9 |
| LYM1133 | 0.85 | 3.03E−02 | 2 | 18 | LYM1134 | 0.91 | 1.20E−02 | 1 | 1 |
| LYM1134 | 0.72 | 6.55E−02 | 1 | 2 | LYM1134 | 0.89 | 1.67E−02 | 2 | 12 |
|  |  |  |  |  | LYM1136 | 0.87 | 4.71E−03 | 5 | 11 |
| LYM1136 | 0.73 | 6.26E−02 | 1 | 9 | LYM1136 | 0.74 | 5.80E−02 | 1 | 12 |
| LYM1136 | 0.90 | 1.31E−02 | 2 | 12 | LYM1137 | 0.78 | 6.98E−02 | 1 | 1 |
| LYM1137 | 0.73 | 6.39E−02 | 1 | 8 | LYM1137 | 0.84 | 4.65E−03 | 3 | 2 |
| LYM1138 | 0.73 | 3.90E−02 | 8 | 13 | LYM1138 | 0.88 | 4.36E−03 | 8 | 11 |
| LYM1138 | 0.81 | 1.55E−02 | 8 | 6 | LYM1138 | 0.85 | 6.83E−03 | 8 | 10 |
| LYM1138 | 0.75 | 3.12E−02 | 8 | 7 | LYM1138 | 0.75 | 3.30E−02 | 8 | 4 |
| LYM1138 | 0.71 | 4.64E−02 | 8 | 17 | LYM1138 | 0.72 | 1.04E−01 | 2 | 3 |
| LYM1138 | 0.74 | 9.30E−02 | 2 | 14 | LYM1138 | 0.84 | 3.49E−02 | 2 | 11 |
| LYM1138 | 0.78 | 6.99E−02 | 2 | 19 | LYM1138 | 0.83 | 3.99E−02 | 2 | 2 |
| LYM1138 | 0.79 | 6.02E−02 | 2 | 5 | LYM1138 | 0.80 | 5.61E−02 | 2 | 7 |
| LYM1138 | 0.82 | 4.40E−02 | 2 | 8 | LYM1138 | 0.81 | 5.32E−02 | 2 | 4 |
| LYM1139 | 0.75 | 5.45E−02 | 4 | 3 | LYM1139 | 0.80 | 2.95E−02 | 4 | 14 |
| LYM1139 | 0.72 | 6.84E−02 | 4 | 11 | LYM1139 | 0.73 | 6.09E−02 | 4 | 6 |
| LYM1139 | 0.73 | 6.44E−02 | 4 | 4 | LYM1139 | 0.72 | 6.84E−02 | 4 | 17 |
| LYM1139 | 0.78 | 3.99E−02 | 7 | 3 | LYM1139 | 0.78 | 4.04E−02 | 7 | 14 |
| LYM1139 | 0.73 | 6.44E−02 | 7 | 6 | LYM1139 | 0.75 | 5.29E−02 | 7 | 4 |
| LYM1139 | 0.72 | 6.56E−02 | 7 | 17 | LYM1139 | 0.89 | 7.52E−03 | 1 | 3 |
| LYM1139 | 0.79 | 3.62E−02 | 1 | 16 | LYM1139 | 0.90 | 5.70E−03 | 1 | 6 |
| LYM1139 | 0.82 | 2.46E−02 | 1 | 18 | LYM1139 | 0.82 | 2.51E−02 | 1 | 8 |
| LYM1139 | 0.86 | 1.23E−02 | 1 | 4 | LYM1139 | 0.81 | 2.78E−02 | 1 | 17 |
| LYM1139 | 0.79 | 6.14E−02 | 2 | 12 | LYM1140 | 0.71 | 1.15E−01 | 1 | 1 |
| LYM1140 | 0.81 | 2.79E−02 | 1 | 2 | LYM1140 | 0.72 | 1.10E−01 | 2 | 3 |
| LYM1140 | 0.71 | 1.17E−01 | 2 | 11 | LYM1140 | 0.71 | 1.11E−01 | 2 | 6 |
| LYM1141 | 0.72 | 6.82E−02 | 4 | 15 | LYM1141 | 0.81 | 2.67E−02 | 4 | 9 |
| LYM1141 | 0.83 | 2.04E−02 | 7 | 3 | LYM1141 | 0.89 | 7.39E−03 | 7 | 16 |
| LYM1141 | 0.81 | 2.72E−02 | 7 | 14 | LYM1141 | 0.84 | 1.70E−02 | 7 | 15 |
| LYM1141 | 0.73 | 6.07E−02 | 7 | 13 | LYM1141 | 0.76 | 4.85E−02 | 7 | 21 |
| LYM1141 | 0.94 | 1.61E−03 | 7 | 11 | LYM1141 | 0.79 | 3.51E−02 | 7 | 6 |
| LYM1141 | 0.87 | 1.14E−02 | 7 | 9 | LYM1141 | 0.91 | 4.66E−03 | 7 | 10 |
| LYM1141 | 0.75 | 5.12E−02 | 7 | 19 | LYM1141 | 0.78 | 3.71E−02 | 7 | 5 |
| LYM1141 | 0.92 | 3.00E−03 | 7 | 7 | LYM1141 | 0.71 | 7.32E−02 | 7 | 8 |
| LYM1141 | 0.81 | 2.85E−02 | 7 | 12 | LYM1141 | 0.77 | 4.26E−02 | 7 | 4 |
| LYM1141 | 0.88 | 8.42E−03 | 7 | 17 | LYM1141 | 0.79 | 3.52E−02 | 1 | 16 |
| LYM1141 | 0.88 | 8.30E−03 | 1 | 15 | LYM1141 | 0.88 | 8.47E−03 | 1 | 11 |
| LYM1141 | 0.88 | 8.55E−03 | 1 | 9 | LYM1141 | 0.93 | 2.80E−03 | 1 | 10 |
| LYM1141 | 0.73 | 6.22E−02 | 1 | 19 | LYM1141 | 0.75 | 5.24E−02 | 1 | 5 |
| LYM1141 | 0.87 | 1.13E−02 | 1 | 7 | LYM1141 | 0.92 | 2.94E−03 | 1 | 12 |
| LYM1141 | 0.77 | 4.46E−02 | 1 | 17 | LYM1141 | 0.77 | 2.51E−02 | 8 | 13 |
| LYM1141 | 0.71 | 4.62E−02 | 8 | 11 | LYM1141 | 0.75 | 3.30E−02 | 8 | 10 |
| LYM1142 | 0.78 | 6.74E−02 | 2 | 15 | LYM1142 | 0.76 | 7.68E−02 | 2 | 12 |
| LYM1143 | 0.88 | 4.10E−03 | 5 | 15 | LYM1143 | 0.71 | 4.71E−02 | 5 | 18 |
| LYM1143 | 0.70 | 1.20E−01 | 4 | 1 | LYM1143 | 0.73 | 6.38E−02 | 4 | 16 |
| LYM1143 | 0.77 | 4.23E−02 | 4 | 14 | LYM1143 | 0.82 | 2.53E−02 | 4 | 15 |
| LYM1143 | 0.90 | 5.51E−03 | 4 | 13 | LYM1143 | 0.85 | 1.59E−02 | 4 | 11 |
| LYM1143 | 0.73 | 5.99E−02 | 4 | 6 | LYM1143 | 0.77 | 4.32E−02 | 4 | 10 |
| LYM1143 | 0.79 | 3.32E−02 | 4 | 7 | LYM1143 | 0.70 | 7.82E−02 | 4 | 4 |
| LYM1143 | 0.74 | 5.59E−02 | 4 | 17 | LYM1143 | 0.72 | 6.71E−02 | 7 | 3 |
| LYM1143 | 0.72 | 6.59E−02 | 7 | 16 | LYM1143 | 0.87 | 1.18E−02 | 7 | 14 |
| LYM1143 | 0.83 | 2.15E−02 | 7 | 13 | LYM1143 | 0.84 | 1.82E−02 | 7 | 11 |
| LYM1143 | 0.82 | 2.53E−02 | 7 | 6 | LYM1143 | 0.72 | 7.08E−02 | 7 | 10 |
| LYM1143 | 0.76 | 4.58E−02 | 7 | 7 | LYM1143 | 0.80 | 3.10E−02 | 7 | 4 |
| LYM1143 | 0.78 | 3.93E−02 | 7 | 17 | LYM1143 | 0.82 | 2.39E−02 | 1 | 14 |

TABLE 22-continued

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LYM1143 | 0.72 | 6.96E−02 | 1 | 15 | LYM1143 | 0.81 | 2.71E−02 | 1 | 13 |
| LYM1143 | 0.78 | 3.82E−02 | 1 | 11 | LYM1143 | 0.72 | 6.64E−02 | 1 | 10 |
| LYM1143 | 0.77 | 4.34E−02 | 1 | 7 | LYM1143 | 0.73 | 4.00E−02 | 8 | 16 |
| LYM1143 | 0.76 | 2.94E−02 | 8 | 13 | LYM1143 | 0.76 | 2.81E−02 | 8 | 10 |
| LYM1143 | 0.72 | 4.38E−02 | 8 | 5 | LYM1143 | 0.74 | 3.40E−02 | 8 | 7 |
| LYM1143 | 0.78 | 2.21E−02 | 8 | 8 | LYM1143 | 0.75 | 3.07E−02 | 8 | 4 |
|  |  |  |  |  | LYM1146 | 0.73 | 1.01E−01 | 2 | 9 |
| LYM1146 | 0.70 | 1.20E−01 | 2 | 10 | LYM1146 | 0.94 | 5.60E−03 | 2 | 12 |
|  |  |  |  |  | LYM1149 | 0.72 | 6.98E−02 | 7 | 3 |
| LYM1149 | 0.70 | 7.97E−02 | 7 | 16 | LYM1149 | 0.73 | 6.11E−02 | 7 | 19 |
| LYM1149 | 0.77 | 4.17E−02 | 1 | 19 | LYM1149 | 0.79 | 3.45E−02 | 1 | 12 |
| LYM1149 | 0.73 | 4.05E−02 | 8 | 12 | LYM1149 | 0.74 | 2.34E−02 | 3 | 16 |
| LYM1149 | 0.72 | 3.03E−02 | 3 | 12 | LYM1149 | 0.83 | 3.95E−02 | 2 | 12 |
|  |  |  |  |  | LYM1151 | 0.73 | 4.04E−02 | 5 | 9 |
| LYM1151 | 0.73 | 6.32E−02 | 4 | 14 | LYM1151 | 0.78 | 3.74E−02 | 7 | 2 |
| LYM1151 | 0.74 | 9.14E−02 | 1 | 1 | LYM1151 | 0.70 | 7.71E−02 | 1 | 2 |
| LYM1151 | 0.71 | 1.14E−01 | 2 | 6 | LYM1151 | 0.80 | 5.47E−02 | 2 | 18 |
| LYM1151 | 0.74 | 9.38E−02 | 2 | 17 | LYM1152 | 0.85 | 7.44E−02 | 5 | 14 |
| LYM1152 | 0.85 | 8.12E−03 | 5 | 11 | LYM1152 | 0.72 | 4.25E−02 | 5 | 6 |
| LYM1152 | 0.75 | 8.79E−02 | 4 | 1 | LYM1152 | 0.75 | 4.98E−02 | 4 | 2 |
| LYM1152 | 0.74 | 9.37E−02 | 2 | 12 | LYM1153 | 0.73 | 2.43E−02 | 3 | 14 |
| LYM1153 | 0.78 | 6.99E−02 | 2 | 3 | LYM1153 | 0.74 | 9.05E−02 | 2 | 16 |
| LYM1153 | 0.77 | 7.26E−02 | 2 | 13 | LYM1153 | 0.71 | 1.13E−01 | 2 | 11 |
| LYM1153 | 0.76 | 7.86E−02 | 2 | 6 | LYM1153 | 0.83 | 4.13E−02 | 2 | 10 |
| LYM1153 | 0.82 | 4.65E−02 | 2 | 5 | LYM1153 | 0.71 | 1.12E−01 | 2 | 4 |
| LYM1153 | 0.83 | 3.87E−02 | 2 | 17 | LYM1154 | 0.77 | 2.44E−02 | 5 | 19 |
| LYM1154 | 0.77 | 4.23E−02 | 4 | 2 | LYM1154 | 0.80 | 5.55E−02 | 1 | 1 |
| LYM1154 | 0.80 | 5.84E−03 | 6 | 18 | LYM1154 | 0.94 | 5.21E−03 | 2 | 15 |
| LYM1155 | 0.74 | 9.23E−02 | 4 | 1 | LYM1155 | 0.74 | 5.88E−02 | 4 | 2 |
| LYM1156 | 0.73 | 6.21E−02 | 4 | 2 | LYM1156 | 0.91 | 1.14E−02 | 1 | 1 |
| LYM1156 | 0.77 | 4.35E−02 | 1 | 2 | LYM1156 | 0.75 | 2.00E−02 | 3 | 2 |
| LYM1156 | 0.78 | 6.96E−02 | 2 | 3 | LYM1156 | 0.71 | 1.11E−01 | 2 | 11 |
| LYM1156 | 0.76 | 8.26E−02 | 2 | 6 | LYM1156 | 0.72 | 1.08E−01 | 2 | 4 |
| LYM1156 | 0.79 | 6.14E−02 | 2 | 17 | LYM1158 | 0.79 | 2.03E−02 | 5 | 3 |
| LYM1158 | 0.83 | 9.97E−03 | 5 | 16 | LYM1158 | 0.79 | 1.96E−02 | 5 | 13 |
| LYM1158 | 0.78 | 2.29E−02 | 5 | 11 | LYM1158 | 0.81 | 1.35E−02 | 5 | 6 |
| LYM1158 | 0.80 | 1.74E−02 | 5 | 10 | LYM1158 | 0.76 | 2.77E−02 | 5 | 19 |
| LYM1158 | 0.70 | 5.20E−02 | 5 | 5 | LYM1158 | 0.92 | 1.09E−03 | 5 | 7 |
| LYM1158 | 0.94 | 6.40E−04 | 5 | 8 | LYM1158 | 0.91 | 1.85E−03 | 5 | 4 |
| LYM1158 | 0.76 | 2.93E−02 | 5 | 17 | LYM1158 | 0.75 | 8.50E−02 | 4 | 1 |
| LYM1158 | 0.83 | 2.15E−02 | 7 | 14 | LYM1158 | 0.77 | 4.48E−02 | 7 | 6 |
| LYM1158 | 0.77 | 4.46E−02 | 7 | 18 | LYM1158 | 0.76 | 4.95E−02 | 7 | 4 |
| LYM1158 | 0.75 | 8.41E−02 | 1 | 1 | LYM1158 | 0.76 | 8.13E−02 | 2 | 3 |
| LYM1158 | 0.87 | 2.39E−02 | 2 | 6 | LYM1158 | 0.79 | 6.12E−02 | 2 | 18 |
| LYM1158 | 0.79 | 5.95E−02 | 2 | 17 | LYM1159 | 0.72 | 3.01E−02 | 6 | 1 |
| LYM1159 | 0.90 | 1.05E−03 | 3 | 2 | LYM1160 | 0.89 | 7.09E−03 | 7 | 18 |
| LYM1161 | 0.85 | 1.52E−02 | 4 | 3 | LYM1161 | 0.91 | 4.55E−03 | 4 | 16 |
| LYM1161 | 0.78 | 3.83E−02 | 4 | 14 | LYM1161 | 0.84 | 1.85E−02 | 4 | 15 |
| LYM1161 | 0.78 | 3.91E−02 | 4 | 13 | LYM1161 | 0.88 | 8.96E−03 | 4 | 11 |
| LYM1161 | 0.78 | 3.94E−02 | 4 | 6 | LYM1161 | 0.90 | 5.38E−03 | 4 | 9 |
| LYM1161 | 0.88 | 8.73E−03 | 4 | 10 | LYM1161 | 0.90 | 5.68E−03 | 4 | 19 |
| LYM1161 | 0.85 | 1.53E−02 | 4 | 5 | LYM1161 | 0.92 | 3.17E−03 | 4 | 7 |
| LYM1161 | 0.80 | 3.19E−02 | 4 | 8 | LYM1161 | 0.81 | 2.71E−02 | 4 | 12 |
| LYM1161 | 0.79 | 3.431−02 | 4 | 4 | LYM1161 | 0.86 | 1.35E−02 | 4 | 17 |
| LYM1161 | 0.82 | 2.55E−02 | 1 | 19 | LYM1161 | 0.90 | 5.18E−03 | 1 | 5 |
| LYM1161 | 0.73 | 6.03E−02 | 1 | 7 | LYM1161 | 0.75 | 5.20E−02 | 1 | 8 |
| LYM1161 | 0.71 | 2.12E−02 | 6 | 15 | LYM1161 | 0.78 | 1.41E−02 | 3 | 3 |
| LYM1161 | 0.82 | 6.91E−03 | 3 | 16 | LYM1161 | 0.74 | 2.33E−02 | 3 | 14 |
| LYM1161 | 0.76 | 1.70E−02 | 3 | 13 | LYM1161 | 0.81 | 7.63E−03 | 3 | 11 |
| LYM1161 | 0.76 | 1.63E−02 | 3 | 6 | LYM1161 | 0.79 | 1.10E−02 | 3 | 10 |
| LYM1161 | 0.83 | 5.44E−03 | 3 | 19 | LYM1161 | 0.80 | 9.13E−03 | 3 | 5 |
| LYM1161 | 0.85 | 3.42E−03 | 3 | 7 | LYM1161 | 0.81 | 7.99E−03 | 3 | 8 |
| LYM1161 | 0.79 | 1.08E−02 | 3 | 4 | LYM1161 | 0.80 | 9.45E−03 | 3 | 17 |
| LYM1161 | 0.78 | 6.79E−02 | 2 | 3 | LYM1161 | 0.74 | 9.49E−02 | 2 | 16 |
| LYM1161 | 0.85 | 3.30E−02 | 2 | 11 | LYM1161 | 0.87 | 2.32E−02 | 2 | 6 |
| LYM1161 | 0.79 | 6.33E−02 | 2 | 19 | LYM1161 | 0.77 | 7.61E−02 | 2 | 4 |
| LYM1162 | 0.92 | 3.41E−03 | 4 | 14 | LYM1162 | 0.78 | 3.86E−02 | 4 | 6 |
| LYM1162 | 0.85 | 1.43E−02 | 4 | 8 | LYM1162 | 0.85 | 1.66E−02 | 4 | 4 |
| LYM1162 | 0.72 | 6.78E−02 | 1 | 5 | LYM1162 | 0.91 | 1.23E−02 | 2 | 12 |
| LYM1163 | 0.74 | 5.72E−02 | 4 | 3 | LYM1163 | 0.79 | 3.60E−02 | 4 | 16 |
| LYM1163 | 0.79 | 3.28E−02 | 4 | 15 | LYM1163 | 0.82 | 2.32E−02 | 4 | 11 |
| LYM1163 | 0.78 | 3.96E−02 | 4 | 9 | LYM1163 | 0.84 | 1.78E−02 | 4 | 10 |
| LYM1163 | 0.80 | 2.90E−02 | 4 | 5 | LYM1163 | 0.78 | 3.76E−02 | 4 | 7 |

TABLE 22-continued

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LYM1163 | 0.86 | 1.40E−02 | 4 | 12 | LYM1163 | 0.79 | 3.55E−02 | 4 | 17 |
| LYM1163 | 0.76 | 2.85E−02 | 8 | 1 | LYM1163 | 0.71 | 1.17E−01 | 2 | 9 |
| LYM1163 | 0.93 | 7.22E−03 | 2 | 12 | LYM1165 | 0.74 | 5.77E−02 | 4 | 3 |
| LYM1165 | 0.72 | 7.06E−02 | 4 | 16 | LYM1165 | 0.73 | 6.18E−02 | 4 | 14 |
| LYM1165 | 0.75 | 5.07E−02 | 4 | 11 | LYM1165 | 0.74 | 5.81E−02 | 4 | 10 |
| LYM1165 | 0.86 | 1.37E−02 | 4 | 5 | LYM1165 | 0.76 | 4.87E−02 | 4 | 7 |
| LYM1165 | 0.73 | 6.34E−02 | 4 | 17 | LYM1165 | 0.73 | 6.46E−02 | 7 | 3 |
| LYM1165 | 0.77 | 4.33E−02 | 7 | 5 | LYM1165 | 0.78 | 3.82E−02 | 1 | 16 |
| LYM1165 | 0.72 | 7.04E−02 | 1 | 15 | LYM1165 | 0.80 | 2.92E−02 | 1 | 11 |
| LYM1165 | 0.80 | 3.10E−02 | 1 | 9 | LYM1165 | 0.87 | 1.14E−02 | 1 | 10 |
| LYM1165 | 0.85 | 1.49E−02 | 1 | 19 | LYM1165 | 0.92 | 3.56E−03 | 1 | 5 |
| LYM1165 | 0.87 | 1.14E−02 | 1 | 7 | LYM1165 | 0.71 | 7.20E−02 | 1 | 8 |
| LYM1165 | 0.88 | 9.60E−03 | 1 | 12 | LYM1165 | 0.72 | 6.77E−02 | 1 | 17 |
| LYM1165 | 0.71 | 2.11E−02 | 6 | 12 | | | | | |
| LYM1167 | 0.80 | 5.75E−02 | 1 | 1 | LYM1167 | 0.89 | 1.67E−02 | 2 | 9 |
| LYM1167 | 0.90 | 1.58E−02 | 2 | 18 | LYM1168 | 0.73 | 6.08E−02 | 4 | 2 |
| LYM1169 | 0.78 | 2.34E−02 | 5 | 11 | LYM1169 | 0.76 | 2.78E−02 | 5 | 9 |
| LYM1169 | 0.71 | 7.15E−02 | 4 | 3 | LYM1169 | 0.81 | 2.57E−02 | 4 | 19 |
| LYM1169 | 0.85 | 1.58E−02 | 4 | 5 | LYM1169 | 0.84 | 1.91E−02 | 4 | 8 |
| LYM1169 | 0.72 | 7.00E−02 | 4 | 4 | LYM1169 | 0.74 | 9.03E−02 | 2 | 9 |
| LYM1169 | 0.84 | 3.86E−02 | 2 | 12 | LYM1170 | 0.90 | 5.92E−03 | 4 | 3 |
| LYM1170 | 0.90 | 5.52E−03 | 4 | 16 | LYM1170 | 0.75 | 5.20E−02 | 4 | 14 |
| LYM1170 | 0.72 | 6.76E−02 | 4 | 15 | LYM1170 | 0.74 | 5.68E−02 | 4 | 13 |
| LYM1170 | 0.85 | 1.60E−02 | 4 | 11 | LYM1170 | 0.86 | 1.24E−02 | 4 | 6 |
| LYM1170 | 0.79 | 3.50E−02 | 4 | 9 | LYM1170 | 0.81 | 2.75E−02 | 4 | 10 |
| LYM1170 | 0.85 | 1.62E−02 | 4 | 19 | LYM1170 | 0.82 | 2.40E−02 | 4 | 5 |
| LYM1170 | 0.87 | 1.08E−02 | 4 | 7 | LYM1170 | 0.84 | 1.89E−02 | 4 | 8 |
| LYM1170 | 0.85 | 1.53E−02 | 4 | 4 | LYM1170 | 0.88 | 9.02E−03 | 4 | 17 |
| LYM1171 | 0.77 | 2.49E−02 | 5 | 9 | LYM1171 | 0.78 | 3.73E−02 | 4 | 15 |
| LYM1171 | 0.83 | 1.99E−02 | 4 | 9 | LYM1171 | 0.70 | 7.76E−02 | 4 | 10 |
| LYM1171 | 0.72 | 6.97E−02 | 4 | 7 | LYM1171 | 0.71 | 7.11E−02 | 4 | 12 |
| LYM1171 | 0.81 | 4.77E−03 | 6 | 5 | LYM1171 | 0.83 | 4.29E−02 | 2 | 12 |
| LYM1172 | 0.82 | 1.28E−02 | 5 | 9 | LYM1173 | 0.82 | 4.61E−02 | 2 | 10 |
| LYM1173 | 0.79 | 6.01E−02 | 2 | 7 | LYM1173 | 0.72 | 1.10E−01 | 2 | 8 |
| LYM1173 | 0.70 | 1.20E−01 | 2 | 4 | LYM1174 | 0.71 | 4.69E−02 | 5 | 9 |
| LYM1174 | 0.79 | 3.44E−02 | 4 | 3 | LYM1174 | 0.81 | 2.56E−02 | 4 | 16 |
| LYM1174 | 0.75 | 5.24E−02 | 4 | 15 | LYM1174 | 0.87 | 1.14E−02 | 4 | 11 |
| LYM1174 | 0.73 | 6.31E−02 | 4 | 6 | LYM1174 | 0.76 | 4.52E−02 | 4 | 9 |
| LYM1174 | 0.83 | 2.23E−02 | 4 | 10 | LYM1174 | 0.81 | 2.84E−02 | 4 | 7 |
| LYM1174 | 0.73 | 6.39E−02 | 4 | 12 | LYM1174 | 0.85 | 1.63E−02 | 4 | 17 |
| LYM1174 | 0.70 | 7.97E−02 | 7 | 2 | LYM1174 | 0.94 | 4.56E−05 | 6 | 3 |
| LYM1174 | 0.88 | 8.99E−04 | 6 | 16 | LYM1174 | 0.80 | 5.31E−03 | 6 | 11 |
| LYM1174 | 0.88 | 8.90E−04 | 6 | 6 | LYM1174 | 0.70 | 2.36E−02 | 6 | 9 |
| LYM1174 | 0.77 | 8.75E−03 | 6 | 10 | LYM1174 | 0.80 | 5.69E−03 | 6 | 7 |
| LYM1174 | 0.78 | 8.42E−03 | 6 | 8 | LYM1174 | 0.71 | 2.26E−02 | 6 | 12 |
| LYM1174 | 0.87 | 1.11E−03 | 6 | 4 | LYM1174 | 0.94 | 6.60E−05 | 6 | 17 |
| LYM1174 | 0.90 | 1.41E−02 | 2 | 9 | LYM1174 | 0.91 | 1.12E−02 | 2 | 18 |
| LYM1175 | 0.75 | 8.67E−02 | 1 | 1 | LYM1176 | 0.81 | 5.25E−02 | 2 | 15 |
| LYM1177 | 0.86 | 2.72E−03 | 3 | 11 | LYM1177 | 0.87 | 2.42E−03 | 3 | 10 |
| LYM1177 | 0.76 | 1.86E−02 | 3 | 19 | LYM1177 | 0.76 | 1.69E−02 | 3 | 5 |
| LYM1177 | 0.83 | 5.79E−03 | 3 | 7 | LYM1177 | 0.81 | 8.38E−03 | 3 | 12 |
| LYM1177 | 0.73 | 2.68E−02 | 3 | 17 | LYM1177 | 0.95 | 3.65E−03 | 2 | 9 |
| LYM1177 | 0.88 | 2.09E−02 | 2 | 18 | LYM1178 | 0.90 | 1.39E−02 | 4 | 1 |
| LYM1178 | 0.79 | 3.61E−02 | 4 | 6 | LYM1178 | 0.77 | 4.47E−02 | 4 | 2 |
| LYM1178 | 0.76 | 4.58E−02 | 4 | 8 | LYM1178 | 0.74 | 5.60E−02 | 4 | 4 |
| LYM1178 | 0.73 | 6.32E−02 | 7 | 3 | LYM1178 | 0.79 | 3.30E−02 | 7 | 6 |
| LYM1178 | 0.80 | 3.14E−02 | 7 | 18 | LYM1178 | 0.94 | 5.60E−03 | 1 | 1 |
| LYM1178 | 0.78 | 3.71E−02 | 1 | 2 | LYM1179 | 0.70 | 7.83E−02 | 4 | 14 |
| LYM1179 | 0.76 | 4.82E−02 | 1 | 14 | LYM1179 | 0.70 | 7.74E−02 | 1 | 11 |
| LYM1179 | 0.76 | 4.95E−02 | 1 | 5 | LYM1179 | 0.71 | 7.28E−02 | 1 | 7 |
| LYM1179 | 0.75 | 3.31E−02 | 8 | 1 | LYM1179 | 0.81 | 1.52E−02 | 8 | 2 |
| LYM1180 | 0.75 | 5.34E−02 | 1 | 18 | LYM1180 | 0.81 | 5.29E−02 | 2 | 9 |
| LYM1182 | 0.75 | 3.26E−02 | 5 | 11 | LYM1182 | 0.70 | 7.98E−02 | 7 | 13 |
| LYM1182 | 0.82 | 4.50E−02 | 2 | 19 | LYM1183 | 0.77 | 4.39E−02 | 7 | 12 |
| LYM1183 | 0.74 | 9.23E−02 | 2 | 12 | LYM1184 | 0.77 | 4.40E−02 | 4 | 2 |
| LYM1184 | 0.88 | 2.04E−02 | 1 | 1 | LYM1184 | 0.79 | 3.32E−02 | 1 | 2 |
| LYM1185 | 0.76 | 7.66E−02 | 2 | 3 | LYM1185 | 0.79 | 6.15E−02 | 2 | 11 |
| LYM1185 | 0.71 | 1.16E−01 | 2 | 6 | LYM1185 | 0.84 | 3.77E−02 | 2 | 7 |
| LYM1185 | 0.81 | 5.26E−02 | 2 | 8 | LYM1185 | 0.80 | 5.57E−02 | 2 | 4 |
| LYM1185 | 0.71 | 1.11E−01 | 2 | 17 | LYM1186 | 0.97 | 1.42E−03 | 7 | 1 |
| LYM1186 | 0.78 | 3.79E−02 | 1 | 15 | LYM1186 | 0.81 | 2.85E−02 | 1 | 9 |
| LYM1186 | 0.76 | 4.66E−02 | 1 | 12 | LYM1186 | 0.84 | 3.43E−02 | 2 | 14 |
| LYM1187 | 0.76 | 4.63E−02 | 5 | 1 | LYM1187 | 0.72 | 4.56E−02 | 5 | 2 |

TABLE 22-continued

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LYM1187 | 0.71 | 7.30E−02 | 7 | 11 | LYM1187 | 0.70 | 5.18E−02 | 8 | 1 |
| LYM1187 | 0.72 | 4.47E−02 | 8 | 13 | LYM1187 | 0.71 | 4.77E−02 | 8 | 10 |
| LYM1187 | 0.71 | 3.31E−02 | 3 | 15 | LYM1187 | 0.70 | 3.55E−02 | 3 | 12 |
| LYM1187 | 0.72 | 2.92E−02 | 3 | 17 | LYM1187 | 0.96 | 2.29E−03 | 2 | 12 |

Provided are the correlations (R) between the expression levels yield improving genes and their homologs in various tissues [Expression (Exp) sets] and the phenotypic performance [yield, biomass, growth rate and/or vigor components (Correlation vector (Cor))] under normal conditions across maize varieties.
P = p value.

Example 6

Production of Barley Transcriptome and High Throughput Correlation Analysis Using 60K Barley Oligonucleotide Micro-Array In order to produce a high throughput correlation analysis comparing between plant phenotype and gene expression level, the present inventors utilized a Barley oligonucleotide micro-array, produced by Agilent Technologies [chem.(dot)agilent(dot)com/Scripts/PDS(dot)asp?1Page=50879]. The array oligonucleotide represents about 60K Barley genes and transcripts. In order to define correlations between the levels of RNA expression and yield or vigor related parameters, various plant characteristics of 15 different Barley accessions were analyzed. Among them, 10 accessions encompassing the observed variance were selected for RNA expression analysis. The correlation between the RNA levels and the characterized parameters was analyzed using Pearson correlation test [davidmlane(dot)com/hyperstat/A34739(dot)html].

Experimental Procedures

Analyzed Barley tissues—Five tissues at different developmental stages [leaf, meristem, root tip, adventitious root and booting spike], representing different plant characteristics, were sampled and RNA was extracted as described above. Each micro-array expression information tissue type has received a Set ID as summarized in Tables 23 and 24 below.

TABLE 23

Barley transcriptome expression sets (set 1)

| Expression Set | Set ID |
|---|---|
| Root at vegetative stage under low N conditions | 1 |
| Root at vegetative stage under normal conditions | 2 |
| leaf at vegetative stage under low N conditions | 3 |
| leaf at vegetative stage under normal conditions | 4 |
| root tip at vegetative stage under low N conditions | 5 |
| root tip at vegetative stage under normal conditions | 6 |

TABLE 24

Barley transcriptome expression sets (set 2)

| Expression Set | Set ID |
|---|---|
| booting spike at reproductive stage under drought conditions | 1 |
| leaf at reproductive stage under drought conditions | 2 |
| leaf at vegetative stage under drought conditions | 3 |
| meristems at vegetative stage under drought conditions | 4 |
| root tip at vegetative stage under drought conditions | 5 |
| root tip at vegetative stage under recovery drought | 6 |

Barley yield components and vigor related parameters assessment—15 Barley accessions in 5 repetitive blocks, each containing 5 plants per pot were grown at net house. Three different treatments were applied: plants were regularly fertilized and watered during plant growth until harvesting (as recommended for commercial growth) or under low Nitrogen (80% percent less Nitrogen) or drought stress. Plants were phenotyped on a daily basis following the standard descriptor of barley (Tables 25 and 26, below). Harvest was conducted while all the spikes were dry. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb(dot)nih(dot)gov/]. Next, analyzed data was saved to text files and processed using the JMP statistical analysis software (SAS institute).

Grains number—The total number of grains from all spikes that were manually threshed was counted. Number of grains per plot were counted.

Grain weight (gr.)—At the end of the experiment all spikes of the pots were collected. The total grains from all spikes that were manually threshed were weighted. The grain yield was calculated by per plot.

Spike length and width analysis—At the end of the experiment the length and width of five chosen spikes per plant were measured using measuring tape excluding the awns.

Spike number analysis—The spikes per plant were counted.

Plant height—Each of the plants was measured for its height using measuring tape. Height was measured from ground level to top of the longest spike excluding awns at two time points at the Vegetative growth (30 days after sowing) and at harvest.

Spike weight—The biomass and spikes weight of each plot was separated, measured and divided by the number of plants.

Dry weight=total weight of the vegetative portion above ground (excluding roots) after drying at 70° C. in oven for 48 hours at two time points at the Vegetative growth (30 days after sowing) and at harvest.

Root dry weight=total weight of the root portion underground after drying at 70° C. in oven for 48 hours at harvest.

Root/Shoot Ratio—Root/Shoot Ratio (=RBiH/BiH) was performed using Formula XXII above.

Total No of tillers—all tillers were counted per plot at two time points at the Vegetative growth (30 days after sowing) and at harvest.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), root length (cm) and number of lateral roots—3 plants per plot were selected for measurement of root weight, root length and for counting the number of lateral roots formed.

Shoot FW—weight of 3 plants per plot were recorded at different time-points.

Relative water content—Fresh weight (FW) of three leaves from three plants each from different seed ID was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to Formula I above.

Harvest Index (for barley)—The harvest index was calculated using Formula XVIII above.

Relative growth rate: relative growth rate (RGR) of Plant Height, SPAD and number of tillers were performed using Formula III, Formula IV and Formula V respectively.

TABLE 25

Barley correlated parameters (vectors for set 1)

| Correlated parameter with | Correlation ID |
|---|---|
| Lateral Roots (number)-Normal | 1 |
| Leaf Area (mm$^2$)-Normal | 2 |
| Leaf Number-TP4-Low N | 3 |
| Max Length (mm)-Normal | 4 |
| Max Width (mm)-Normal | 5 |
| Max Length (mm)-TP4-Low N | 6 |
| Max Width (mm)-TP4-Low N | 7 |
| No of lateral roots-Low N-TP2 | 8 |
| Num Leaves-Normal | 9 |
| Num Seeds-Normal | 10 |
| Num Spikes per plot-Normal | 11 |
| Num Tillers per plant-Normal | 12 |
| Plant Height (cm)-TP1-Normal | 13 |
| Plant Height (cm)-TP2-Normal | 14 |
| Plant Height (cm)-Low N-TP1 | 15 |
| Plant Height (cm)-Low N-TP2 | 16 |
| Root FW (g)-Normal | 17 |
| Root Length (cm)-Normal | 18 |
| Root FW (g)-Low N-TP2 | 19 |
| Root length (cm)-Low N-TP2 | 20 |
| SPAD-Normal | 21 |
| SPAD-Low N-TP2 | 22 |
| Seed Yield (gr)-Normal | 23 |
| Seed Number (per plot)-Low N | 24 |
| Seed Yield (gr)-Low N | 25 |
| Shoot FW (g)-Normal | 26 |
| Spike Length (cm)-Normal | 27 |
| Spike Width (cm)-Normal | 28 |
| Spike weight per plot (g)-Normal | 29 |
| Spike Length (cm)-Low N | 30 |
| Spike Width (cm)-Low N | 31 |

TABLE 25-continued

Barley correlated parameters (vectors for set 1)

| Correlated parameter with | Correlation ID |
|---|---|
| Spike total weight (per plot)-Low N | 32 |
| Total Tillers per plot (number)-Normal | 33 |
| Total Leaf Area (mm$^2$)-TP4-Low N | 34 |
| Total No of Spikes per plot-Low N | 35 |
| Total No of tillers per plot-Low N | 36 |
| shoot FW (gr)-Low N-TP2 | 37 |

Provided are the barley correlated parameters, TP means time point, DW-dry weight, FW-fresh weight and Low N-Low Nitrogen.

TABLE 26

Barley correlated parameters (vectors for set 2)

| Correlated parameter with | Correlation ID |
|---|---|
| Chlorophyll levels | 1 |
| Dry weight harvest (g) | 2 |
| Dry weight vegetative growth | 3 |
| Fresh weight (g) | 4 |
| Grain number | 5 |
| Grain weight (g) | 6 |
| Harvest index (value) | 7 |
| Heading date | 8 |
| Height Relative growth rate (cm/day) | 9 |
| Number of tillers Relative growth rate (number of tillers/day) | 10 |
| Plant height T1 (cm) | 11 |
| Plant height T2 (cm) | 12 |
| RBiH/BiH (value) | 13 |
| Relative water content | 14 |
| Root dry weight (g) | 15 |
| Root fresh weight (g) | 16 |
| Root length (cm) | 17 |
| SPAD Relative growth rate | 18 |
| Spike length (cm) | 19 |
| Spike number per plant | 20 |
| Spike weight per plant | 21 |
| Spike width (cm) | 22 |
| Tillers number T1 | 23 |
| Tillers number T2 | 24 |
| lateral root number | 25 |

Provided are the barley correlated parameters, TP means time point, DW-dry weight, FW-fresh weight and Low N-Low Nitrogen.

Experimental Results 15 different Barley accessions were grown and characterized for different parameters as described above. The average for each of the measured parameter was calculated using the JMP software and values are summarized in Tables 27-29 below. Subsequent correlation analysis between the various transcriptome sets and the average parameters was conducted (Tables 30-31). Follow, results were integrated to the database.

TABLE 27

Measured parameters of correlation IDs in Barley accessions (set 1)

| Ecotype/Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 7.00 | 8.67 | 8.33 | 9.67 | 10.70 | 9.67 | 9.67 | 8.67 | 10.00 | 9.67 |
| 2 | 294.00 | 199.00 | 273.00 | 276.00 | 313.00 | 309.00 | 259.00 | 291.00 | 299.00 | 296.00 |
| 3 | 8.00 | 8.00 | 7.50 | 8.50 | 10.00 | 11.50 | 8.60 | 6.33 | 7.50 | 10.00 |
| 4 | 502.00 | 348.00 | 499.00 | 594.00 | 535.00 | 551.00 | 479.00 | 399.00 | 384.00 | 470.00 |
| 5 | 5.77 | 5.45 | 5.80 | 6.03 | 4.63 | 5.33 | 5.83 | 5.43 | 5.75 | 6.03 |
| 6 | 102.90 | 107.78 | 111.57 | 142.42 | 152.38 | 149.33 | 124.08 | 95.00 | 124.12 | 135.17 |
| 7 | 5.25 | 5.17 | 5.12 | 5.30 | 5.20 | 5.33 | 5.32 | 5.10 | 5.15 | 5.10 |
| 8 | 5.00 | 6.00 | 4.33 | 6.00 | 6.33 | 6.00 | 6.67 | 4.67 | 5.67 | 7.33 |
| 9 | 24.20 | 18.20 | 22.70 | 25.50 | 23.20 | 28.30 | 22.20 | 19.00 | 17.30 | 22.00 |
| 10 | 1090.00 | 510.00 | 242.00 | 582.00 | 621.00 | 1070.00 | 903.00 | 950.00 | 984.00 | 768.00 |
| 11 | 41.50 | 32.00 | 36.00 | 71.40 | 34.20 | 45.60 | 49.80 | 28.00 | 19.30 | 38.00 |
| 12 | 2.00 | 2.00 | 1.00 | 2.33 | 2.33 | 3.33 | 2.33 | 1.33 | 1.33 | 1.67 |
| 13 | 39.20 | 37.00 | 36.80 | 49.80 | 46.80 | 34.80 | 43.20 | 35.70 | 46.20 | 40.20 |
| 14 | 64.70 | 84.00 | 67.40 | 82.00 | 72.00 | 56.60 | 65.80 | 62.80 | 91.60 | 66.20 |
| 15 | 41.00 | 82.00 | 61.40 | 59.40 | 65.80 | 47.80 | 53.80 | 56.40 | 81.80 | 44.60 |
| 16 | 16.33 | 18.83 | 17.33 | 26.00 | 22.50 | 18.17 | 19.67 | 19.83 | 19.17 | 19.17 |
| 17 | 0.27 | 0.27 | 0.25 | 0.35 | 0.62 | 0.27 | 0.35 | 0.32 | 0.23 | 0.27 |
| 18 | 21.30 | 15.00 | 21.80 | 20.30 | 27.20 | 16.00 | 24.00 | 13.50 | 21.50 | 15.20 |
| 19 | 0.38 | 0.23 | 0.12 | 0.40 | 0.88 | 0.50 | 0.43 | 0.32 | 0.30 | 0.55 |
| 20 | 24.67 | 21.67 | 22.00 | 21.67 | 22.17 | 23.00 | 30.50 | 22.83 | 23.83 | 24.50 |
| 21 | 39.10 | 41.40 | 35.20 | 33.70 | 34.20 | 42.80 | 37.00 | 36.90 | 35.00 | 36.80 |
| 22 | 24.03 | 23.30 | 26.47 | 23.90 | 26.63 | 23.20 | 25.43 | 24.23 | 25.03 | 26.07 |
| 23 | 46.40 | 19.80 | 10.80 | 22.60 | 30.30 | 54.10 | 37.00 | 42.00 | 35.40 | 38.30 |
| 24 | 230.20 | 164.60 | 88.25 | 133.60 | 106.00 | 222.60 | 219.20 | 143.45 | 201.80 | 125.00 |
| 25 | 9.76 | 7.31 | 3.30 | 5.06 | 6.02 | 9.74 | 7.35 | 5.80 | 7.83 | 6.29 |
| 26 | 2.17 | 1.90 | 1.25 | 3.00 | 15.60 | 3.02 | 2.58 | 1.75 | 2.18 | 1.82 |
| 27 | 16.50 | 19.20 | 18.30 | 20.40 | 17.20 | 19.10 | 20.30 | 21.70 | 16.50 | 16.10 |
| 28 | 9.54 | 9.05 | 8.25 | 6.55 | 10.50 | 8.83 | 7.38 | 10.40 | 10.20 | 10.30 |
| 29 | 69.40 | 39.40 | 34.90 | 50.30 | 60.80 | 79.10 | 62.70 | 60.00 | 55.90 | 59.70 |
| 30 | 15.19 | 19.61 | 16.30 | 19.32 | 90.22 | 16.44 | 20.44 | 18.84 | 18.77 | 16.65 |
| 31 | 7.95 | 8.13 | 9.43 | 4.94 | 9.60 | 7.16 | 7.06 | 8.51 | 10.01 | 9.40 |
| 32 | 13.74 | 13.44 | 9.15 | 11.64 | 11.34 | 15.06 | 12.18 | 10.95 | 12.18 | 10.62 |
| 33 | 46.70 | 41.60 | 40.00 | 48.80 | 34.60 | 48.60 | 49.20 | 29.00 | 27.50 | 38.80 |
| 34 | 39.40 | 46.27 | 51.51 | 57.07 | 67.78 | 64.15 | 52.42 | 46.15 | 68.02 | 57.91 |
| 35 | 12.20 | 9.00 | 11.60 | 25.00 | 7.80 | 14.50 | 15.00 | 7.00 | 5.40 | 8.40 |
| 36 | 16.20 | 14.60 | 16.00 | 20.75 | 12.50 | 18.80 | 21.20 | 11.00 | 6.75 | 14.00 |
| 37 | 0.43 | 0.43 | 0.33 | 0.58 | 0.78 | 0.53 | 0.45 | 0.43 | 0.50 | 0.62 |

TABLE 28

Measured parameters of correlation IDs in Barley accessions (set 2)

| Ecotype/Treatment | Line-1 | Line-2 | Line-3 | Line-4 | Line-5 | Line-6 | Line-7 | Line-8 |
|---|---|---|---|---|---|---|---|---|
| 1 | 41.33 | 33.57 | 36.57 | 40.50 | 45.07 | 39.73 | 38.33 | 36.17 |
| 2 | 6.15 | 5.05 | 3.20 | 3.28 | 4.76 | 3.55 | 4.52 | 3.38 |
| 3 | 0.21 | 0.21 | | | | 0.17 | | |
| 4 | 1.90 | 1.52 | 1.17 | 1.95 | 1.90 | 1.22 | 1.75 | 1.58 |
| 5 | 170.00 | 267.50 | 111.00 | 205.33 | 153.60 | 252.50 | 288.40 | 274.50 |
| 6 | 5.55 | 9.80 | 3.55 | 7.20 | 5.28 | 7.75 | 9.92 | 10.25 |
| 7 | 0.47 | 0.66 | 0.53 | 0.69 | 0.53 | 0.69 | 0.69 | 0.75 |
| 8 | 75.00 | 71.00 | 65.00 | | 66.75 | 90.00 | 90.00 | |
| 9 | 0.27 | 0.86 | 0.73 | 0.88 | 0.40 | 0.94 | 0.70 | 0.71 |
| 10 | 0.070 | 0.097 | 0.059 | 0.071 | 0.164 | 0.061 | 0.104 | 0.049 |
| 11 | 33.33 | 27.00 | 31.33 | 34.17 | 31.33 | 30.33 | 28.67 | 38.67 |
| 12 | 46.00 | 52.80 | 35.00 | 38.00 | 45.20 | 48.00 | 37.67 | 41.20 |
| 13 | 0.013 | 0.012 | 0.008 | 0.006 | 0.025 | 0.020 | 0.008 | 0.008 |
| 14 | 80.60 | 53.40 | 55.87 | | 43.21 | 69.78 | 45.49 | 76.51 |
| 15 | 77.52 | 60.19 | 27.13 | 18.62 | 117.42 | 70.72 | 37.34 | 25.56 |
| 16 | 2.07 | 1.48 | 1.12 | 1.87 | 1.67 | 1.68 | 1.62 | 0.85 |
| 17 | 21.67 | 20.33 | 22.00 | 24.00 | 20.67 | 18.33 | 21.00 | 20.33 |
| 18 | 0.09 | −0.12 | 0.00 | 0.01 | 0.04 | −0.07 | 0.01 | 0.00 |
| 19 | 16.70 | 16.85 | 13.27 | 13.55 | 14.19 | 15.64 | 15.66 | 17.49 |
| 20 | 4.20 | 4.36 | 7.60 | 8.44 | 4.92 | 3.43 | 6.90 | 5.80 |
| 21 | 17.72 | 24.24 | 18.20 | 18.00 | 19.50 | 15.00 | 23.40 | 28.16 |
| 22 | 8.64 | 9.07 | 7.82 | 7.32 | 8.74 | 7.62 | 6.98 | 8.05 |
| 23 | 2.00 | 2.00 | 1.67 | 1.67 | 2.00 | 1.67 | 2.33 | 1.00 |
| 24 | 11.68 | 9.04 | 10.92 | 10.16 | 10.32 | 8.78 | 13.00 | 7.44 |
| 25 | 8.33 | 8.67 | 7.33 | 7.67 | 6.67 | 6.67 | 7.67 | 6.67 |

TABLE 29

Measured parameters of correlation IDs in Barley accessions (set 2) additional lines

| Ecotype/Treatment | Line-9 | Line-10 | Line-11 | Line-12 | Line-13 | Line-14 | Line-15 |
|---|---|---|---|---|---|---|---|
| 1 | 42.13 | 31.77 | 33.47 | 42.37 | 42.27 | 36.77 | 40.63 |
| 2 | 5.67 | 3.31 | 2.65 | 5.12 | 6.86 | 3.11 | 3.74 |
| 3 | 0.25 | | | 0.13 | 0.19 | 0.22 | |
| 4 | 1.88 | 1.73 | 1.00 | 0.90 | 0.90 | 1.43 | 0.83 |
| 5 | 348.50 | 358.00 | 521.39 | 71.50 | 160.13 | 376.67 | 105.00 |
| 6 | 8.50 | 14.03 | 17.52 | 2.05 | 5.38 | 11.00 | 2.56 |
| 7 | 0.60 | 0.81 | 0.87 | 0.29 | 0.44 | 0.78 | 0.41 |
| 8 | 90.00 | | | 90.00 | 81.60 | 90.00 | |
| 9 | 0.77 | 0.80 | 0.92 | 0.39 | 0.88 | −0.13 | 0.20 |
| 10 | 0.100 | 0.061 | 0.063 | 0.183 | 0.149 | 0.022 | 0.442 |
| 11 | 33.67 | 28.43 | 27.50 | 25.00 | 27.00 | 31.00 | 22.33 |
| 12 | 40.80 | 49.86 | 43.00 | 47.40 | 64.80 | 52.60 | 32.00 |
| 13 | 0.012 | 0.007 | 0.016 | 0.023 | 0.012 | 0.012 | 0.026 |
| 14 | 87.41 | | | 58.32 | 80.58 | 73.09 | |
| 15 | 66.18 | 22.13 | 41.12 | 116.95 | 84.10 | 37.46 | 98.86 |
| 16 | 1.45 | 1.38 | 0.82 | 0.58 | 0.63 | 1.07 | 0.70 |
| 17 | 21.67 | 19.67 | 16.67 | 17.00 | 15.17 | 27.00 | 15.00 |
| 18 | −0.06 | 0.04 | 0.05 | 0.00 | −0.07 | 0.03 | −0.06 |
| 19 | 16.00 | 18.31 | 17.42 | 14.23 | 14.81 | 16.54 | 12.72 |
| 20 | 8.55 | 9.67 | 5.42 | 3.05 | 4.07 | 3.72 | 3.21 |
| 21 | 21.96 | 33.03 | 34.80 | 11.73 | 18.78 | 21.00 | 9.88 |
| 22 | 6.06 | 6.73 | 9.55 | 7.84 | 7.81 | 8.35 | 5.47 |
| 23 | 2.33 | 3.00 | 1.00 | 1.00 | 1.00 | 1.00 | 1.00 |
| 24 | 13.92 | 11.00 | 6.78 | 8.45 | 9.15 | 5.12 | 16.13 |
| 25 | 6.00 | 8.67 | 7.67 | 6.33 | 7.00 | 7.00 | 6.67 |

TABLE 30

Correlation between the expression level of selected genes of some embodiments of the invention in various tissues and the phenotypic performance under low nitrogen, normal or drought stress conditions across Barley accessions (set 1)

| Gene Name | R | P value | Exp. set | Corr. Set ID | Gene Name | R | P value | Exp. set | Corr. Set ID |
|---|---|---|---|---|---|---|---|---|---|
| LYM1010 | 0.89 | 1.28E−03 | 1 | 30 | LYM1010 | 0.86 | 2.91E−03 | 1 | 19 |
| LYM1010 | 0.71 | 3.13E−02 | 1 | 37 | LYM1010 | 0.93 | 2.58E−04 | 2 | 11 |
| LYM1010 | 0.71 | 3.22E−02 | 3 | 3 | LYM1010 | 0.83 | 5.24E−03 | 3 | 22 |
| LYM1011 | 0.72 | 2.92E−02 | 1 | 30 | LYM1011 | 0.84 | 2.09E−03 | 5 | 8 |
| LYM1012 | 0.75 | 3.37E−02 | 4 | 33 | LYM1012 | 0.75 | 3.09E−02 | 4 | 21 |
| LYM1013 | 0.85 | 7.13E−03 | 4 | 21 | LYM1013 | 0.74 | 2.34E−02 | 2 | 10 |
| LYM1014 | 0.76 | 1.83E−02 | 1 | 30 | LYM1015 | 0.79 | 1.91E−02 | 6 | 5 |
| LYM1015 | 0.72 | 2.90E−02 | 2 | 1 | LYM1015 | 0.89 | 1.21E−03 | 2 | 13 |
| LYM1015 | 0.72 | 2.87E−02 | 3 | 30 | LYM1015 | 0.80 | 1.01E−02 | 3 | 19 |
| LYM1015 | 0.76 | 1.73E−02 | 3 | 37 | LYM1017 | 0.80 | 1.02E−02 | 1 | 20 |
| LYM1017 | 0.81 | 8.66E−03 | 2 | 10 | LYM1017 | 0.71 | 3.12E−02 | 2 | 23 |
| LYM1017 | 0.72 | 2.84E−02 | 3 | 7 | LYM1018 | 0.72 | 4.25E−02 | 6 | 33 |
| LYM1018 | 0.72 | 4.21E−02 | 6 | 18 | LYM1018 | 0.80 | 9.48E−03 | 1 | 7 |
| LYM1018 | 0.75 | 2.04E−02 | 1 | 20 | LYM1018 | 0.71 | 4.82E−02 | 4 | 33 |
| LYM1018 | 0.83 | 1.11E−02 | 4 | 11 | LYM1018 | 0.83 | 9.93E−03 | 4 | 9 |
| LYM1018 | 0.78 | 2.37E−02 | 4 | 4 | LYM1018 | 0.79 | 1.88E−02 | 4 | 12 |
| LYM1018 | 0.87 | 2.15E−03 | 2 | 33 | LYM1018 | 0.78 | 1.39E−02 | 2 | 12 |
| LYM1018 | 0.71 | 3.15E−02 | 2 | 13 | LYM1018 | 0.86 | 3.10E−03 | 3 | 7 |
| LYM1018 | 0.78 | 1.39E−02 | 3 | 36 | LYM1018 | 0.87 | 2.35E−03 | 3 | 35 |
| LYM1019 | 0.76 | 1.09E−02 | 5 | 25 | LYM1020 | 0.71 | 3.05E−02 | 2 | 10 |
| LYM1020 | 0.81 | 7.98E−03 | 3 | 20 | LYM1020 | 0.73 | 2.68E−02 | 3 | 32 |
| LYM1021 | 0.88 | 1.69E−03 | 1 | 15 | LYM1021 | 0.97 | 1.22E−05 | 2 | 26 |
| LYM1021 | 0.92 | 5.10E−04 | 2 | 17 | LYM1021 | 0.80 | 9.78E−03 | 3 | 30 |
| LYM1021 | 0.73 | 2.45E−02 | 3 | 34 | LYM1021 | 0.79 | 1.06E−02 | 3 | 37 |
| LYM1022 | 0.81 | 1.38E−02 | 6 | 5 | LYM1022 | 0.80 | 1.80E−02 | 4 | 33 |
| LYM1022 | 0.76 | 3.01E−02 | 4 | 21 | LYM1022 | 0.74 | 2.39E−02 | 2 | 1 |
| LYM1022 | 0.72 | 2.97E−02 | 2 | 18 | LYM1022 | 0.75 | 1.96E−02 | 2 | 17 |
| LYM1022 | 0.87 | 2.17E−03 | 3 | 36 | LYM1022 | 0.95 | 8.69E−05 | 3 | 35 |
| LYM1024 | 0.73 | 4.12E−02 | 6 | 14 | LYM1024 | 0.89 | 1.27E−03 | 1 | 30 |
| LYM1024 | 0.75 | 2.00E−02 | 1 | 37 | LYM1024 | 0.80 | 1.60E−02 | 4 | 14 |
| LYM1024 | 0.82 | 6.83E−03 | 3 | 20 | LYM1025 | 0.87 | 2.38E−03 | 1 | 20 |
| LYM1025 | 0.77 | 1.42E−02 | 3 | 30 | LYM1025 | 0.80 | 9.87E−03 | 3 | 19 |
| LYM1025 | 0.71 | 3.25E−02 | 3 | 34 | LYM1025 | 0.85 | 3.74E−03 | 3 | 37 |
| LYM1025 | 0.70 | 3.41E−02 | 3 | 16 | LYM1027 | 0.72 | 4.47E−02 | 6 | 5 |
| LYM1027 | 0.74 | 3.53E−02 | 4 | 21 | LYM1027 | 0.72 | 4.27E−02 | 4 | 29 |
| LYM1027 | 0.93 | 8.23E−04 | 4 | 12 | LYM1028 | 0.74 | 3.70E−02 | 4 | 5 |
| LYM1029 | 0.90 | 2.37E−03 | 6 | 5 | LYM1029 | 0.80 | 9.04E−03 | 1 | 35 |

TABLE 30-continued

Correlation between the expression level of selected genes of some embodiments of the invention in various tissues and the phenotypic performance under low nitrogen, normal or drought stress conditions across Barley accessions (set 1)

| Gene Name | R | P value | Exp. set | Corr. Set ID | Gene Name | R | P value | Exp. set | Corr. Set ID |
|---|---|---|---|---|---|---|---|---|---|
| LYM1029 | 0.72 | 3.02E−02 | 2 | 18 | LYM1030 | 0.77 | 2.50E−02 | 6 | 5 |
| LYM1030 | 0.87 | 2.14E−03 | 2 | 13 | LYM1031 | 0.74 | 2.20E−02 | 2 | 26 |
| LYM1031 | 0.73 | 2.53E−02 | 2 | 17 | LYM1032 | 0.70 | 3.50E−02 | 3 | 34 |
| LYM1033 | 0.99 | 1.06E−07 | 1 | 30 | LYM1033 | 0.83 | 5.43E−03 | 1 | 19 |
| LYM1033 | 0.81 | 8.70E−03 | 1 | 37 | LYM1033 | 0.85 | 3.49E−03 | 2 | 11 |
| LYM1034 | 0.77 | 2.47E−02 | 6 | 5 | LYM1034 | 0.71 | 3.05E−02 | 1 | 30 |
| LYM1034 | 0.74 | 2.30E−02 | 1 | 31 | LYM1034 | 0.76 | 2.73E−02 | 4 | 28 |
| LYM1034 | 0.74 | 2.21E−02 | 2 | 28 | LYM1034 | 0.73 | 2.61E−02 | 2 | 18 |
| LYM1034 | 0.88 | 1.82E−03 | 2 | 26 | LYM1034 | 0.90 | 8.29E−04 | 2 | 17 |
| LYM1034 | 0.76 | 1.71E−02 | 3 | 32 | LYM1035 | 0.89 | 3.08E−03 | 4 | 14 |
| LYM1036 | 0.93 | 3.52E−04 | 2 | 26 | LYM1036 | 0.87 | 2.31E−03 | 2 | 17 |
| LYM1036 | 0.75 | 1.94E−02 | 3 | 25 | LYM1036 | 0.71 | 3.14E−02 | 3 | 32 |
| LYM1037 | 0.85 | 3.55E−03 | 1 | 20 | LYM1037 | 0.74 | 3.42E−02 | 4 | 18 |
| LYM1038 | 0.79 | 1.97E−02 | 4 | 14 | LYM1038 | 0.74 | 3.46E−02 | 4 | 13 |
| LYM1038 | 0.70 | 3.51E−02 | 2 | 1 | LYM1038 | 0.72 | 2.86E−02 | 2 | 13 |
|  |  |  |  |  | LYM1040 | 0.71 | 3.27E−02 | 1 | 22 |
| LYM1041 | 0.70 | 5.20E−02 | 4 | 23 | LYM1042 | 0.71 | 4.78E−02 | 6 | 21 |
| LYM1043 | 0.72 | 2.95E−02 | 1 | 35 | LYM1043 | 0.74 | 1.44E−02 | 5 | 35 |
| LYM1043 | 0.75 | 1.98E−02 | 3 | 30 | LYM1043 | 0.76 | 1.84E−02 | 3 | 19 |
| LYM1043 | 0.73 | 2.70E−02 | 3 | 37 | LYM1044 | 0.85 | 7.86E−03 | 6 | 26 |
| LYM1044 | 0.79 | 1.97E−02 | 6 | 12 | LYM1044 | 0.73 | 4.01E−02 | 4 | 18 |
| LYM1044 | 0.78 | 2.17E−02 | 4 | 26 | LYM1044 | 0.79 | 1.86E−02 | 4 | 17 |
| LYM1044 | 0.76 | 2.89E−02 | 4 | 13 | LYM1044 | 0.71 | 2.19E−02 | 5 | 19 |
| LYM1044 | 0.82 | 3.47E−03 | 5 | 3 | LYM1044 | 0.84 | 4.64E−03 | 2 | 21 |
| LYM1046 | 0.76 | 2.92E−02 | 6 | 21 | LYM1047 | 0.93 | 2.35E−04 | 3 | 30 |
| LYM1047 | 0.85 | 3.43E−03 | 3 | 19 | LYM1047 | 0.79 | 1.08E−02 | 3 | 37 |
| LYM1048 | 0.84 | 8.63E−03 | 4 | 18 | LYM1048 | 0.80 | 9.50E−03 | 3 | 31 |
| LYM1049 | 0.73 | 2.48E−02 | 3 | 7 | LYM1051 | 0.72 | 4.46E−02 | 6 | 5 |
| LYM1052 | 0.86 | 6.30E−03 | 4 | 28 | LYM1052 | 0.78 | 1.33E−02 | 3 | 31 |
| LYM1053 | 0.74 | 3.66E−02 | 4 | 14 | LYM1054 | 0.86 | 2.67E−03 | 1 | 30 |
| LYM1054 | 0.73 | 2.52E−02 | 1 | 19 | LYM1055 | 0.70 | 3.49E−02 | 2 | 11 |
| LYM1057 | 0.73 | 2.61E−02 | 3 | 36 | LYM1057 | 0.85 | 3.70E−03 | 3 | 35 |
| LYM1058 | 0.70 | 3.46E−02 | 1 | 30 | LYM1058 | 0.85 | 7.49E−03 | 4 | 18 |
| LYM1058 | 0.83 | 5.31E−03 | 2 | 11 | LYM1058 | 0.73 | 2.60E−02 | 3 | 31 |
| LYM1059 | 0.76 | 2.98E−02 | 6 | 18 | LYM1059 | 0.90 | 4.41E−04 | 5 | 35 |
| LYM1059 | 0.77 | 8.58E−03 | 5 | 16 | LYM1059 | 0.81 | 8.73E−03 | 2 | 18 |
| LYM1059 | 0.73 | 2.60E−02 | 2 | 17 | LYM1059 | 0.86 | 3.08E−03 | 2 | 13 |
| LYM1060 | 0.84 | 9.16E−03 | 6 | 1 | LYM1060 | 0.71 | 4.92E−02 | 6 | 26 |
| LYM1060 | 0.74 | 2.21E−02 | 2 | 18 | LYM1060 | 0.75 | 1.97E−02 | 2 | 4 |
| LYM1060 | 0.87 | 2.58E−03 | 3 | 30 | LYM1060 | 0.88 | 1.91E−03 | 3 | 19 |
| LYM1060 | 0.92 | 3.89E−04 | 3 | 37 | LYM1060 | 0.83 | 5.10E−03 | 3 | 6 |
| LYM1060 | 0.80 | 1.01E−02 | 3 | 16 | LYM1061 | 0.93 | 3.39E−04 | 1 | 16 |
| LYM1061 | 0.77 | 1.54E−02 | 2 | 26 | LYM1061 | 0.85 | 3.69E−03 | 2 | 17 |
| LYM1061 | 0.80 | 9.96E−03 | 2 | 13 | LYM1062 | 0.75 | 2.12E−02 | 1 | 31 |
| LYM1062 | 0.78 | 1.35E−02 | 3 | 31 | LYM1063 | 0.73 | 2.57E−02 | 1 | 34 |
| LYM1063 | 0.71 | 5.07E−02 | 4 | 17 | LYM1063 | 0.71 | 3.08E−02 | 2 | 26 |
| LYM1063 | 0.72 | 3.01E−02 | 2 | 17 | LYM1064 | 0.72 | 4.51E−02 | 6 | 33 |
| LYM1064 | 0.88 | 3.78E−03 | 4 | 18 | LYM1064 | 0.75 | 3.37E−02 | 4 | 26 |
| LYM1064 | 0.77 | 2.44E−02 | 4 | 17 | LYM1064 | 0.76 | 1.00E−02 | 5 | 8 |
| LYM1066 | 0.72 | 4.43E−02 | 6 | 18 | LYM1066 | 0.78 | 1.37E−02 | 1 | 30 |
| LYM1066 | 0.88 | 2.00E−03 | 2 | 11 | LYM1066 | 0.73 | 2.54E−02 | 2 | 13 |
| LYM1068 | 0.84 | 8.60E−03 | 6 | 18 | LYM1068 | 0.76 | 2.95E−02 | 4 | 2 |
| LYM1069 | 0.73 | 3.88E−02 | 6 | 17 | LYM1069 | 0.83 | 6.05E−03 | 1 | 20 |
| LYM1069 | 0.78 | 1.29E−02 | 2 | 11 | LYM1070 | 0.74 | 3.62E−02 | 6 | 14 |
| LYM1070 | 0.89 | 2.85E−03 | 6 | 5 | LYM1070 | 0.77 | 1.51E−02 | 1 | 31 |
| LYM1070 | 0.75 | 3.31E−02 | 4 | 18 | LYM1070 | 0.95 | 2.98E−04 | 4 | 13 |
| LYM1070 | 0.74 | 2.16E−02 | 3 | 3 | LYM1070 | 0.81 | 7.75E−03 | 3 | 8 |
| LYM1071 | 0.72 | 4.43E−02 | 4 | 28 | LYM1071 | 0.77 | 1.43E−02 | 2 | 28 |
| LYM1072 | 0.81 | 8.16E−03 | 1 | 30 | LYM1072 | 0.83 | 5.72E−03 | 1 | 19 |
| LYM1072 | 0.71 | 3.05E−02 | 1 | 37 | LYM1073 | 0.83 | 5.76E−03 | 1 | 20 |
| LYM1073 | 0.88 | 1.68E−03 | 3 | 20 | LYM1074 | 0.78 | 2.18E−02 | 6 | 33 |
| LYM1074 | 0.78 | 2.32E−02 | 6 | 12 | LYM1074 | 0.92 | 4.49E−04 | 1 | 20 |
| LYM1074 | 0.77 | 8.96E−03 | 5 | 8 | LYM1074 | 0.77 | 1.47E−02 | 2 | 11 |
| LYM1074 | 0.72 | 2.92E−02 | 2 | 18 | LYM1074 | 0.89 | 1.42E−03 | 2 | 13 |
| LYM1075 | 0.85 | 3.90E−03 | 1 | 30 | LYM1075 | 0.74 | 3.77E−02 | 4 | 28 |
| LYM1075 | 0.75 | 3.11E−02 | 4 | 11 | LYM1075 | 0.70 | 5.19E−02 | 4 | 12 |
| LYM1075 | 0.72 | 4.27E−02 | 4 | 2 | LYM1075 | 0.78 | 1.39E−02 | 2 | 21 |
| LYM1075 | 0.76 | 1.86E−02 | 3 | 7 | LYM1075 | 0.79 | 1.13E−02 | 3 | 35 |
| LYM1076 | 0.85 | 7.97E−03 | 4 | 26 | LYM1076 | 0.72 | 4.39E−02 | 4 | 17 |

TABLE 30-continued

Correlation between the expression level of selected genes of some embodiments of the invention in various tissues and the phenotypic performance under low nitrogen, normal or drought stress conditions across Barley accessions (set 1)

| Gene Name | R | P value | Exp. set | Corr. Set ID | Gene Name | R | P value | Exp. set | Corr. Set ID |
|---|---|---|---|---|---|---|---|---|---|
| LYM1076 | 0.70 | 2.36E−02 | 5 | 34 | LYM1234 | 0.79 | 1.13E−02 | 2 | 28 |
| LYM1234 | 0.75 | 2.01E−02 | 3 | 7 | LYM1234 | 0.72 | 3.00E−02 | 3 | 36 |
| LYM1234 | 0.86 | 3.19E−03 | 3 | 35 | | | | | |

Provided are the correlations (R) between the expression levels yield improving genes and their homologs in various tissues [Expression (Exp) sets] and the phenotypic performance [yield, biomass, growth rate and/or vigor components (Correlation vector (Corr))] under normal, low nitrogen and drought conditions across barley varieties.
P = p value.

TABLE 31

Correlation between the expression level of selected genes of some embodiments of the invention in various tissues and the phenotypic performance under low nitrogen, normal or drought stress conditions across Barley accessions (set 2)

| Gene Name | R | P value | Exp. set | Corr. Set ID | Gene Name | R | P value | Exp. set | Corr. Set ID |
|---|---|---|---|---|---|---|---|---|---|
| LYM1010 | 0.82 | 4.45E−02 | 1 | 11 | LYM1010 | 0.76 | 2.81E−02 | 3 | 22 |
| LYM1010 | 0.70 | 3.43E−02 | 6 | 2 | LYM1010 | 0.89 | 7.96E−03 | 2 | 17 |
| LYM1010 | 0.82 | 2.31E−02 | 2 | 11 | LYM1010 | 0.72 | 4.34E−02 | 5 | 10 |
| LYM1010 | 0.81 | 1.59E−02 | 5 | 2 | LYM1010 | 0.85 | 7.50E−03 | 5 | 15 |
| LYM1011 | 0.70 | 1.20E−01 | 1 | 25 | LYM1011 | 0.81 | 1.43E−02 | 3 | 20 |
| LYM1011 | 0.77 | 2.40E−02 | 3 | 23 | LYM1011 | 0.85 | 7.05E−03 | 5 | 18 |
| LYM1012 | 0.74 | 9.19E−02 | 1 | 11 | LYM1012 | 0.72 | 4.43E−02 | 3 | 12 |
| LYM1012 | 0.71 | 5.04E−02 | 3 | 15 | LYM1012 | 0.87 | 1.18E−02 | 2 | 11 |
| LYM1013 | 0.82 | 4.41E−02 | 1 | 12 | LYM1013 | 0.71 | 1.13E−01 | 1 | 19 |
| LYM1013 | 0.79 | 6.11E−02 | 1 | 21 | LYM1014 | 0.91 | 1.70E−03 | 3 | 12 |
| LYM1014 | 0.74 | 5.62E−02 | 2 | 11 | LYM1015 | 0.70 | 3.44E−02 | 4 | 4 |
| LYM1016 | 0.81 | 4.98E−02 | 1 | 11 | LYM1016 | 0.80 | 2.97E−02 | 2 | 22 |
| LYM1016 | 0.75 | 5.14E−02 | 2 | 13 | LYM1016 | 0.93 | 8.12E−03 | 5 | 8 |
| LYM1017 | 0.79 | 6.02E−02 | 1 | 22 | LYM1017 | 0.73 | 3.79E−02 | 3 | 13 |
| LYM1017 | 0.81 | 2.59E−02 | 2 | 22 | LYM1017 | 0.79 | 3.38E−02 | 2 | 9 |
| LYM1017 | 0.76 | 4.94E−02 | 2 | 13 | LYM1017 | 0.80 | 1.80E−02 | 5 | 15 |
| LYM1018 | 0.91 | 1.14E−02 | 1 | 13 | LYM1018 | 0.80 | 5.48E−02 | 1 | 2 |
| LYM1018 | 0.90 | 1.32E−02 | 1 | 15 | LYM1018 | 0.80 | 1.80E−02 | 3 | 24 |
| LYM1018 | 0.80 | 1.62E−02 | 3 | 11 | LYM1018 | 0.76 | 1.65E−02 | 6 | 16 |
| LYM1018 | 0.94 | 1.49E−03 | 2 | 10 | LYM1018 | 0.82 | 2.34E−02 | 2 | 2 |
| LYM1018 | 0.79 | 2.06E−02 | 5 | 24 | LYM1018 | 0.79 | 1.85E−02 | 5 | 11 |
| LYM1018 | 0.89 | 2.90E−03 | 5 | 1 | LYM1018 | 0.84 | 3.76E−02 | 5 | 8 |
| LYM1018 | 0.72 | 3.00E−02 | 4 | 18 | LYM1019 | 0.72 | 1.06E−01 | 1 | 4 |
| LYM1019 | 0.71 | 3.20E−02 | 6 | 22 | LYM1019 | 0.84 | 1.67E−02 | 2 | 17 |
| LYM1020 | 0.73 | 1.02E−01 | 1 | 7 | LYM1020 | 0.95 | 3.61E−03 | 1 | 12 |
| LYM1020 | 0.75 | 8.53E−02 | 1 | 19 | LYM1020 | 0.78 | 6.79E−02 | 1 | 6 |
| LYM1020 | 0.86 | 2.73E−02 | 1 | 21 | LYM1020 | 0.71 | 3.26E−02 | 6 | 2 |
| LYM1020 | 0.77 | 4.36E−02 | 2 | 12 | LYM1020 | 0.84 | 8.84E−03 | 5 | 19 |
| LYM1020 | 0.80 | 1.76E−02 | 5 | 9 | LYM1020 | 0.74 | 3.52E−02 | 5 | 13 |
| LYM1020 | 0.71 | 5.02E−02 | 5 | 15 | LYM1021 | 0.93 | 6.52E−03 | 1 | 12 |
| LYM1021 | 0.84 | 3.59E−02 | 1 | 19 | LYM1021 | 0.86 | 2.97E−02 | 1 | 5 |
| LYM1021 | 0.81 | 5.24E−02 | 1 | 6 | LYM1021 | 0.79 | 6.16E−02 | 1 | 21 |
| LYM1021 | 0.81 | 2.84E−02 | 2 | 7 | LYM1021 | 0.74 | 5.67E−02 | 2 | 5 |
| LYM1021 | 0.80 | 2.93E−02 | 2 | 6 | LYM1021 | 0.85 | 1.63E−02 | 2 | 9 |
| LYM1021 | 0.72 | 6.92E−02 | 2 | 18 | LYM1022 | 0.83 | 4.15E−02 | 1 | 12 |
| LYM1022 | 0.73 | 9.73E−02 | 1 | 19 | LYM1022 | 0.72 | 1.07E−01 | 1 | 5 |
| LYM1022 | 0.75 | 3.35E−02 | 3 | 6 | LYM1022 | 0.83 | 1.13E−02 | 3 | 21 |
| LYM1022 | 0.72 | 6.77E−02 | 2 | 20 | LYM1022 | 0.75 | 5.27E−02 | 2 | 12 |
| LYM1022 | 0.77 | 2.48E−02 | 5 | 15 | LYM1022 | 0.71 | 3.20E−02 | 4 | 10 |
| LYM1022 | 0.89 | 1.48E−03 | 4 | 12 | LYM1022 | 0.80 | 9.04E−03 | 4 | 2 |
| LYM1022 | 0.73 | 2.69E−02 | 4 | 15 | LYM1023 | 0.73 | 1.01E−01 | 1 | 23 |
| LYM1023 | 0.91 | 1.19E−02 | 1 | 25 | LYM1023 | 0.73 | 9.63E−02 | 1 | 18 |
| LYM1023 | 0.72 | 4.46E−02 | 3 | 20 | LYM1024 | 0.98 | 4.61E−04 | 1 | 11 |
| LYM1024 | 0.75 | 2.12E−02 | 6 | 7 | LYM1024 | 0.84 | 4.21E−03 | 6 | 5 |
| LYM1024 | 0.85 | 3.46E−03 | 6 | 6 | LYM1024 | 0.81 | 8.46E−03 | 6 | 21 |
| LYM1024 | 0.76 | 4.84E−02 | 2 | 1 | LYM1024 | 0.81 | 1.42E−02 | 5 | 10 |
| LYM1024 | 0.78 | 2.29E−02 | 5 | 12 | LYM1024 | 0.80 | 1.60E−02 | 5 | 2 |
| LYM1025 | 0.76 | 8.00E−02 | 1 | 17 | LYM1025 | 0.85 | 3.30E−02 | 1 | 22 |
| LYM1025 | 0.73 | 9.61E−02 | 1 | 11 | LYM1025 | 0.72 | 4.55E−02 | 3 | 12 |
| LYM1025 | 0.75 | 3.28E−02 | 3 | 22 | LYM1025 | 0.76 | 2.88E−02 | 3 | 2 |
| LYM1025 | 0.74 | 3.68E−02 | 3 | 15 | LYM1025 | 0.82 | 2.43E−02 | 6 | 8 |
| LYM1025 | 0.87 | 1.17E−02 | 2 | 11 | LYM1025 | 0.72 | 4.57E−02 | 5 | 18 |
| LYM1025 | 0.77 | 1.56E−02 | 4 | 12 | LYM1026 | 0.94 | 4.90E−03 | 1 | 12 |
| LYM1026 | 0.90 | 1.43E−02 | 1 | 19 | LYM1026 | 0.71 | 1.13E−01 | 1 | 5 |

TABLE 31-continued

Correlation between the expression level of selected genes of some embodiments of the invention in various tissues and the phenotypic performance under low nitrogen, normal or drought stress conditions across Barley accessions (set 2)

| Gene Name | R | P value | Exp. set | Corr. Set ID | Gene Name | R | P value | Exp. set | Corr. Set ID |
|---|---|---|---|---|---|---|---|---|---|
| LYM1026 | 0.79 | 6.05E−02 | 1 | 6 | LYM1026 | 0.91 | 1.23E−02 | 1 | 21 |
| LYM1026 | 0.72 | 4.39E−02 | 3 | 21 | LYM1026 | 0.71 | 3.18E−02 | 6 | 4 |
| LYM1026 | 0.71 | 7.22E−02 | 2 | 17 | LYM1026 | 0.78 | 3.77E−02 | 2 | 11 |
| LYM1026 | 0.71 | 4.90E−02 | 5 | 18 | LYM1026 | 0.83 | 3.92E−02 | 5 | 8 |
| LYM1026 | 0.84 | 4.92E−03 | 4 | 24 | LYM1026 | 0.91 | 6.44E−04 | 4 | 18 |
| LYM1026 | 0.76 | 1.86E−02 | 4 | 4 | LYM1027 | 0.82 | 4.78E−02 | 1 | 13 |
| LYM1027 | 0.70 | 1.21E−01 | 1 | 2 | LYM1027 | 0.77 | 7.42E−02 | 1 | 15 |
| LYM1027 | 0.83 | 1.01E−02 | 3 | 22 | LYM1027 | 0.71 | 7.42E−02 | 2 | 1 |
| LYM1027 | 0.80 | 1.75E−02 | 5 | 10 | LYM1027 | 0.77 | 2.65E−02 | 5 | 12 |
| LYM1027 | 0.78 | 2.27E−02 | 5 | 2 | LYM1027 | 0.91 | 1.78E−02 | 5 | 15 |
| LYM1028 | 0.86 | 2.94E−02 | 1 | 11 | LYM1028 | 0.80 | 3.21E−02 | 3 | 14 |
| LYM1028 | 0.80 | 2.96E−02 | 6 | 14 | LYM1028 | 0.82 | 2.49E−02 | 2 | 11 |
| LYM1028 | 0.94 | 4.77E−03 | 5 | 14 | LYM1028 | 0.75 | 3.33E−02 | 5 | 5 |
| LYM1028 | 0.92 | 3.52E−03 | 4 | 14 | LYM1029 | 0.74 | 2.15E−02 | 6 | 19 |
| LYM1029 | 0.76 | 4.65E−02 | 2 | 20 | LYM1029 | 0.81 | 8.40E−03 | 4 | 13 |
| LYM1030 | 0.72 | 3.00E−02 | 6 | 17 | LYM1030 | 0.84 | 3.65E−02 | 5 | 14 |
| LYM1030 | 0.73 | 2.47E−02 | 4 | 20 | LYM1031 | 0.76 | 8.23E−02 | 1 | 22 |
| LYM1031 | 0.86 | 5.76E−03 | 5 | 22 | LYM1032 | 0.94 | 5.86E−03 | 1 | 17 |
| LYM1032 | 0.75 | 3.31E−02 | 3 | 13 | LYM1032 | 0.73 | 3.78E−02 | 3 | 2 |
| LYM1032 | 0.98 | 2.26E−05 | 3 | 15 | LYM1032 | 0.79 | 1.96E−02 | 5 | 10 |
| LYM1032 | 0.81 | 1.53E−02 | 5 | 12 | LYM1032 | 0.79 | 1.97E−02 | 5 | 2 |
| LYM1032 | 0.82 | 1.25E−02 | 5 | 15 | LYM1032 | 0.86 | 1.39E−02 | 4 | 14 |
| LYM1033 | 0.74 | 9.18E−02 | 1 | 17 | LYM1033 | 0.73 | 4.12E−02 | 3 | 12 |
| LYM1033 | 0.72 | 4.21E−02 | 3 | 22 | LYM1034 | 0.75 | 8.80E−02 | 1 | 7 |
| LYM1034 | 0.88 | 2.20E−02 | 1 | 12 | LYM1034 | 0.77 | 7.38E−02 | 1 | 25 |
| LYM1034 | 0.75 | 8.88E−02 | 1 | 6 | LYM1034 | 0.84 | 3.73E−02 | 1 | 21 |
| LYM1034 | 0.73 | 3.98E−02 | 3 | 20 | LYM1034 | 0.79 | 1.95E−02 | 3 | 18 |
| LYM1034 | 0.79 | 2.06E−02 | 5 | 20 | LYM1034 | 0.89 | 3.46E−03 | 5 | 18 |
| LYM1034 | 0.89 | 1.44E−03 | 4 | 18 | LYM1035 | 0.84 | 3.80E−02 | 1 | 23 |
| LYM1035 | 0.74 | 9.58E−02 | 1 | 6 | LYM1035 | 0.73 | 6.10E−02 | 3 | 8 |
| LYM1035 | 0.76 | 1.68E−02 | 6 | 20 | LYM1035 | 0.73 | 2.48E−02 | 6 | 23 |
| LYM1035 | 0.73 | 6.19E−02 | 6 | 8 | LYM1035 | 0.86 | 1.29E−02 | 2 | 9 |
| LYM1035 | 0.98 | 8.21E−04 | 5 | 14 | LYM1035 | 0.71 | 4.91E−02 | 5 | 15 |
| LYM1035 | 0.86 | 1.36E−02 | 4 | 14 | LYM1036 | 0.74 | 9.34E−02 | 1 | 10 |
| LYM1036 | 0.75 | 8.62E−02 | 1 | 24 | LYM1036 | 0.94 | 4.82E−03 | 1 | 13 |
| LYM1036 | 0.96 | 1.88E−03 | 1 | 2 | LYM1036 | 0.99 | 8.43E−05 | 1 | 15 |
| LYM1036 | 0.72 | 1.04E−01 | 1 | 1 | LYM1036 | 0.85 | 6.94E−03 | 3 | 20 |
| LYM1036 | 0.79 | 1.07E−02 | 6 | 5 | LYM1036 | 0.78 | 1.39E−02 | 6 | 6 |
| LYM1036 | 0.82 | 7.43E−03 | 6 | 21 | LYM1036 | 0.74 | 3.74E−02 | 5 | 18 |
| LYM1036 | 0.75 | 3.39E−02 | 5 | 21 | LYM1036 | 0.77 | 1.60E−02 | 4 | 20 |
| LYM1036 | 0.78 | 1.27E−02 | 4 | 18 | LYM1037 | 0.73 | 1.00E−01 | 1 | 17 |
| LYM1037 | 0.73 | 3.84E−02 | 3 | 22 | LYM1037 | 0.71 | 4.72E−02 | 3 | 15 |
| LYM1037 | 0.85 | 1.44E−02 | 2 | 17 | LYM1037 | 0.76 | 2.94E−02 | 5 | 17 |
| LYM1038 | 0.75 | 3.26E−02 | 3 | 22 | LYM1038 | 0.71 | 3.12E−02 | 6 | 16 |
| LYM1038 | 0.81 | 1.47E−02 | 5 | 15 | LYM1038 | 0.78 | 2.13E−02 | 5 | 1 |
| LYM1038 | 0.85 | 3.00E−02 | 5 | 8 | | | | | |
| | | | | | LYM1040 | 0.71 | 1.12E−01 | 1 | 13 |
| LYM1040 | 0.70 | 1.21E−01 | 1 | 11 | LYM1040 | 0.92 | 1.17E−05 | 3 | 17 |
| LYM1040 | 0.81 | 7.64E−03 | 6 | 10 | LYM1040 | 0.79 | 3.35E−02 | 2 | 23 |
| LYM1040 | 0.81 | 2.83E−02 | 2 | 15 | LYM1040 | 0.75 | 3.15E−02 | 5 | 5 |
| LYM1040 | 0.74 | 3.64E−02 | 5 | 4 | LYM1040 | 0.80 | 3.14E−02 | 4 | 8 |
| LYM1041 | 0.73 | 3.98E−02 | 5 | 18 | LYM1041 | 0.82 | 6.36E−03 | 4 | 18 |
| LYM1042 | 0.78 | 6.96E−02 | 1 | 12 | LYM1042 | 0.72 | 1.06E−01 | 1 | 21 |
| LYM1042 | 0.89 | 2.79E−03 | 3 | 20 | LYM1042 | 0.74 | 2.23E−02 | 6 | 17 |
| LYM1042 | 0.92 | 1.39E−03 | 5 | 20 | LYM1043 | 0.73 | 3.95E−02 | 3 | 20 |
| LYM1043 | 0.73 | 2.69E−02 | 6 | 19 | LYM1043 | 0.92 | 5.38E−04 | 4 | 18 |
| LYM1044 | 0.83 | 4.16E−02 | 1 | 23 | LYM1044 | 0.70 | 1.20E−01 | 1 | 25 |
| LYM1044 | 0.70 | 1.20E−01 | 1 | 6 | LYM1044 | 0.82 | 1.26E−02 | 3 | 20 |
| LYM1044 | 0.95 | 2.39E−04 | 3 | 24 | LYM1044 | 0.73 | 6.21E−02 | 2 | 21 |
| LYM1044 | 0.87 | 2.11E−03 | 4 | 20 | LYM1044 | 0.73 | 2.55E−02 | 4 | 23 |
| LYM1046 | 0.86 | 2.68E−02 | 1 | 17 | LYM1046 | 0.79 | 6.05E−02 | 1 | 1 |
| LYM1046 | 0.86 | 5.63E−03 | 3 | 2 | LYM1046 | 0.73 | 3.98E−02 | 3 | 1 |
| LYM1047 | 0.70 | 1.21E−01 | 1 | 18 | LYM1047 | 0.94 | 5.72E−04 | 3 | 2 |
| LYM1047 | 0.80 | 1.72E−02 | 3 | 15 | LYM1047 | 0.84 | 8.91E−03 | 5 | 12 |
| LYM1048 | 0.73 | 1.01E−01 | 1 | 17 | LYM1048 | 0.78 | 6.49E−02 | 1 | 1 |
| LYM1048 | 0.71 | 5.05E−02 | 3 | 22 | LYM1048 | 0.73 | 4.19E−02 | 3 | 2 |
| LYM1048 | 0.75 | 2.13E−02 | 6 | 15 | LYM1048 | 0.73 | 6.08E−02 | 2 | 1 |
| LYM1048 | 0.98 | 8.86E−04 | 5 | 8 | LYM1048 | 0.72 | 6.71E−02 | 4 | 8 |
| LYM1049 | 0.78 | 6.84E−02 | 1 | 21 | LYM1051 | 0.77 | 7.22E−02 | 1 | 11 |
| LYM1052 | 0.82 | 4.55E−02 | 1 | 12 | LYM1052 | 0.79 | 6.37E−02 | 1 | 21 |
| LYM1052 | 0.97 | 5.61E−05 | 3 | 25 | LYM1052 | 0.82 | 2.53E−02 | 2 | 25 |
| LYM1052 | 0.82 | 2.53E−02 | 2 | 18 | LYM1052 | 0.74 | 2.13E−02 | 4 | 18 |
| LYM1053 | 0.82 | 1.25E−02 | 3 | 22 | LYM1053 | 0.83 | 5.68E−03 | 6 | 9 |

TABLE 31-continued

Correlation between the expression level of selected genes of some embodiments of the invention in various tissues and the phenotypic performance under low nitrogen, normal or drought stress conditions across Barley accessions (set 2)

| Gene Name | R | P value | Exp. set | Corr. Set ID | Gene Name | R | P value | Exp. set | Corr. Set ID |
|---|---|---|---|---|---|---|---|---|---|
| LYM1053 | 0.77 | 2.59E−02 | 5 | 9 | LYM1054 | 0.77 | 7.05E−02 | 1 | 1 |
| LYM1054 | 0.84 | 8.86E−03 | 3 | 22 | LYM1054 | 0.75 | 3.25E−02 | 5 | 10 |
| LYM1054 | 0.80 | 1.81E−02 | 5 | 2 | LYM1054 | 0.74 | 3.51E−02 | 5 | 15 |
| LYM1054 | 0.72 | 1.05E−01 | 5 | 8 | LYM1055 | 0.85 | 3.34E−02 | 1 | 17 |
| LYM1055 | 0.73 | 4.01E−02 | 3 | 12 | LYM1055 | 0.77 | 2.68E−02 | 3 | 22 |
| LYM1055 | 0.88 | 8.87E−03 | 2 | 11 | LYM1056 | 0.83 | 4.00E−02 | 1 | 25 |
| LYM1056 | 0.78 | 6.46E−02 | 1 | 18 | LYM1056 | 0.70 | 5.09E−02 | 3 | 22 |
| LYM1056 | 0.78 | 1.37E−02 | 6 | 12 | LYM1056 | 0.78 | 1.39E−02 | 6 | 15 |
| LYM1057 | 0.86 | 2.62E−02 | 1 | 17 | LYM1057 | 0.83 | 1.09E−02 | 3 | 24 |
| LYM1057 | 0.81 | 1.45E−02 | 3 | 4 | LYM1057 | 0.76 | 1.70E−02 | 6 | 25 |
| LYM1057 | 0.71 | 7.31E−02 | 2 | 17 | LYM1057 | 0.84 | 1.91E−02 | 2 | 11 |
| LYM1057 | 0.91 | 1.57E−03 | 5 | 7 | LYM1057 | 0.72 | 4.62E−02 | 5 | 19 |
| LYM1057 | 0.88 | 4.02E−03 | 5 | 5 | LYM1057 | 0.92 | 1.06E−03 | 5 | 6 |
| LYM1057 | 0.85 | 6.85E−03 | 5 | 21 | LYM1057 | 0.70 | 3.47E−02 | 4 | 11 |
| LYM1058 | 0.79 | 5.93E−02 | 1 | 17 | LYM1058 | 0.71 | 5.00E−02 | 3 | 12 |
| LYM1058 | 0.71 | 4.79E−02 | 3 | 22 | LYM1058 | 0.71 | 4.81E−02 | 3 | 2 |
| LYM1059 | 0.83 | 4.00E−02 | 1 | 25 | LYM1059 | 0.70 | 1.21E−01 | 1 | 18 |
| LYM1059 | 0.81 | 2.60E−02 | 6 | 8 | LYM1059 | 0.72 | 6.70E−02 | 2 | 20 |
| LYM1059 | 0.86 | 2.81E−02 | 5 | 8 | LYM1059 | 0.73 | 2.50E−02 | 4 | 20 |
| LYM1060 | 0.86 | 2.87E−02 | 1 | 12 | LYM1060 | 0.77 | 7.49E−02 | 1 | 25 |
| LYM1060 | 0.85 | 8.10E−03 | 5 | 23 | LYM1060 | 0.87 | 4.66E−03 | 5 | 25 |
| LYM1060 | 0.84 | 4.92E−03 | 4 | 20 | LYM1060 | 0.70 | 3.55E−02 | 4 | 23 |
| LYM1061 | 0.91 | 1.14E−02 | 1 | 13 | LYM1061 | 0.78 | 6.88E−02 | 1 | 2 |
| LYM1061 | 0.89 | 1.82E−02 | 1 | 15 | LYM1061 | 0.77 | 2.42E−02 | 3 | 20 |
| LYM1061 | 0.75 | 3.29E−02 | 3 | 21 | LYM1061 | 0.71 | 3.33E−02 | 4 | 20 |
| LYM1062 | 0.89 | 1.80E−02 | 1 | 11 | LYM1062 | 0.77 | 4.13E−02 | 2 | 1 |
| LYM1063 | 0.70 | 1.19E−01 | 1 | 20 | LYM1063 | 0.84 | 3.46E−02 | 1 | 12 |
| LYM1063 | 0.81 | 5.02E−02 | 1 | 25 | LYM1063 | 0.82 | 1.17E−02 | 3 | 12 |
| LYM1063 | 0.71 | 7.13E−02 | 2 | 23 | LYM1063 | 0.76 | 4.97E−02 | 2 | 12 |
| LYM1063 | 0.77 | 4.46E−02 | 2 | 25 | LYM1063 | 0.78 | 2.27E−02 | 5 | 12 |
| LYM1064 | 0.70 | 1.19E−01 | 1 | 20 | LYM1064 | 0.79 | 5.93E−02 | 1 | 12 |
| LYM1064 | 0.76 | 2.93E−02 | 3 | 20 | LYM1064 | 0.76 | 2.70E−02 | 3 | 23 |
| LYM1064 | 0.78 | 2.29E−02 | 3 | 18 | LYM1064 | 0.81 | 8.67E−03 | 6 | 7 |
| LYM1064 | 0.75 | 1.95E−02 | 6 | 6 | LYM1064 | 0.72 | 6.61E−02 | 2 | 25 |
| LYM1064 | 0.78 | 3.92E−02 | 2 | 18 | LYM1064 | 0.73 | 4.10E−02 | 5 | 20 |
| LYM1064 | 0.85 | 4.13E−03 | 4 | 20 | LYM1065 | 0.72 | 1.10E−01 | 1 | 20 |
| LYM1065 | 0.74 | 3.46E−02 | 3 | 24 | LYM1066 | 0.74 | 9.16E−02 | 1 | 20 |
| LYM1066 | 0.91 | 1.24E−02 | 1 | 9 | LYM1066 | 0.90 | 6.35E−03 | 2 | 20 |
| LYM1066 | 0.86 | 2.89E−02 | 5 | 14 | | | | | |
| | | | | | LYM1068 | 0.78 | 6.76E−02 | 1 | 22 |
| LYM1068 | 0.71 | 3.15E−02 | 6 | 20 | LYM1068 | 0.76 | 1.86E−02 | 6 | 21 |
| LYM1068 | 0.81 | 2.59E−02 | 2 | 2 | LYM1068 | 0.83 | 2.23E−02 | 2 | 15 |
| LYM1068 | 0.82 | 1.32E−02 | 5 | 10 | LYM1068 | 0.82 | 1.27E−02 | 5 | 12 |
| LYM1068 | 0.76 | 2.92E−02 | 5 | 2 | LYM1069 | 0.75 | 8.89E−02 | 1 | 17 |
| LYM1069 | 0.73 | 4.12E−02 | 3 | 12 | LYM1069 | 0.77 | 2.45E−02 | 3 | 22 |
| LYM1069 | 0.79 | 1.88E−02 | 3 | 2 | LYM1069 | 0.75 | 3.39E−02 | 3 | 15 |
| LYM1069 | 0.70 | 3.42E−02 | 4 | 5 | LYM1069 | 0.76 | 1.71E−02 | 4 | 9 |
| LYM1070 | 0.84 | 3.56E−02 | 1 | 13 | LYM1070 | 0.73 | 9.81E−02 | 1 | 2 |
| LYM1070 | 0.81 | 4.86E−02 | 1 | 15 | LYM1070 | 0.71 | 4.89E−02 | 3 | 22 |
| LYM1070 | 0.75 | 3.24E−02 | 3 | 25 | LYM1070 | 0.74 | 2.24E−02 | 6 | 6 |
| LYM1070 | 0.75 | 5.20E−02 | 2 | 13 | LYM1070 | 0.81 | 2.59E−02 | 2 | 15 |
| LYM1070 | 0.77 | 2.52E−02 | 5 | 10 | LYM1070 | 0.75 | 3.06E−02 | 5 | 2 |
| LYM1070 | 0.72 | 4.22E−02 | 5 | 15 | LYM1070 | 0.83 | 3.98E−02 | 5 | 8 |
| LYM1070 | 0.85 | 3.80E−03 | 4 | 20 | LYM1071 | 0.78 | 2.17E−02 | 3 | 10 |
| LYM1071 | 0.78 | 2.15E−02 | 3 | 12 | LYM1071 | 0.83 | 1.96E−02 | 2 | 22 |
| LYM1071 | 0.79 | 3.37E−02 | 2 | 9 | LYM1071 | 0.77 | 2.51E−02 | 5 | 5 |
| LYM1071 | 0.73 | 4.08E−02 | 5 | 15 | LYM1071 | 0.86 | 1.20E−02 | 4 | 14 |
| LYM1071 | 0.88 | 1.80E−03 | 4 | 22 | LYM1071 | 0.73 | 2.43E−02 | 4 | 15 |
| LYM1072 | 0.79 | 5.90E−02 | 1 | 25 | LYM1072 | 0.80 | 1.82E−02 | 5 | 7 |
| LYM1072 | 0.70 | 5.26E−02 | 5 | 25 | LYM1072 | 0.81 | 1.45E−02 | 5 | 6 |
| LYM1072 | 0.86 | 3.00E−02 | 5 | 8 | LYM1072 | 0.74 | 3.42E−02 | 5 | 21 |
| LYM1072 | 0.82 | 6.70E−03 | 4 | 24 | LYM1072 | 0.78 | 1.29E−02 | 4 | 11 |
| LYM1072 | 0.73 | 2.41E−02 | 4 | 4 | LYM1073 | 0.77 | 7.44E−02 | 1 | 23 |
| LYM1073 | 0.74 | 9.54E−02 | 1 | 25 | LYM1073 | 0.76 | 8.19E−02 | 1 | 6 |
| LYM1073 | 0.92 | 1.30E−03 | 3 | 20 | LYM1073 | 0.82 | 1.29E−02 | 3 | 24 |
| LYM1073 | 0.85 | 1.65E−02 | 6 | 8 | LYM1073 | 0.79 | 3.43E−02 | 2 | 7 |
| LYM1073 | 0.82 | 2.52E−02 | 2 | 5 | LYM1073 | 0.89 | 6.79E−03 | 2 | 6 |
| LYM1073 | 0.71 | 7.59E−02 | 2 | 18 | LYM1073 | 0.85 | 1.51E−02 | 2 | 21 |
| LYM1073 | 0.76 | 1.76E−02 | 4 | 20 | LYM1073 | 0.77 | 1.46E−02 | 4 | 23 |
| LYM1074 | 0.79 | 6.27E−02 | 1 | 25 | LYM1074 | 0.79 | 3.31E−02 | 2 | 17 |
| LYM1074 | 0.85 | 3.28E−02 | 5 | 14 | LYM1074 | 0.73 | 4.03E−02 | 5 | 15 |
| LYM1074 | 0.73 | 9.83E−02 | 5 | 8 | LYM1075 | 0.89 | 1.90E−02 | 1 | 22 |
| LYM1075 | 0.84 | 3.53E−02 | 1 | 11 | LYM1075 | 0.82 | 1.28E−02 | 3 | 22 |

TABLE 31-continued

Correlation between the expression level of selected genes of some embodiments of the invention in various tissues and the phenotypic performance under low nitrogen, normal or drought stress conditions across Barley accessions (set 2)

| Gene Name | R | P value | Exp. set | Corr. Set ID | Gene Name | R | P value | Exp. set | Corr. Set ID |
|---|---|---|---|---|---|---|---|---|---|
| LYM1075 | 0.71 | 7.65E−02 | 6 | 8 | LYM1075 | 0.70 | 3.43E−02 | 6 | 16 |
| LYM1075 | 0.84 | 8.99E−03 | 5 | 13 | LYM1075 | 0.81 | 1.46E−02 | 5 | 11 |
| LYM1076 | 0.92 | 1.04E−02 | 1 | 11 | LYM1076 | 0.72 | 4.59E−02 | 3 | 2 |
| LYM1234 | 0.79 | 6.00E−02 | 1 | 11 | LYM1234 | 0.70 | 5.15E−02 | 3 | 20 |
| LYM1234 | 0.71 | 4.79E−02 | 3 | 23 | LYM1234 | 0.81 | 1.56E−02 | 3 | 21 |
| LYM1234 | 0.73 | 6.18E−02 | 2 | 25 | LYM1234 | 0.77 | 2.54E−02 | 5 | 18 |
| LYM1234 | 0.72 | 6.87E−02 | 4 | 8 | | | | | |

Provided are the correlations (R) between the expression levels yield improving genes and their homologs in various tissues [Expression (Exp) sets] and the phenotypic performance [yield, biomass, growth rate and/or vigor components (Correlation vector (Corr))] under normal, low nitrogen and drought conditions across barley varieties.
P = p value.

Example 7

Production of Brachypodium Transcriptome and High Throughput Correlation Analysis Using 60K Brachypodium Oligonucleotide Micro-Array In order to produce a high throughput correlation analysis comparing between plant phenotype and gene expression level, the present inventors utilized a brachypodium oligonucleotide micro-array, produced by Agilent Technologies [chem.(dot)agilent(dot)com/Scripts/PDS(dot) asp?1Page=50879]. The array oligonucleotide represents about 60K brachypodium genes and transcripts. In order to define correlations between the levels of RNA expression and yield or vigor related parameters, various plant characteristics of 24 different brachypodium accessions were analyzed. Among them, 22 accessions encompassing the observed variance were selected for RNA expression analysis and comparative genomic hybridization (CGH) analysis.

The correlation between the RNA levels and the characterized parameters was analyzed using Pearson correlation test [davidmlane(dot)com/hyperstat/A34739 (dot) html].

Additional correlation analysis was done by comparing plant phenotype and gene copy number. The correlation between the normalized copy number hybridization signal and the characterized parameters was analyzed using Pearson correlation test [davidmlane(dot)com/hyperstat/A34739 (dot)html].

Experimental Procedures

Analyzed Brachypodium tissues—two tissues [leaf and spike] were sampled and RNA was extracted as described above. Each micro-array expression information tissue type has received a Set ID as summarized in Table 32 below.

TABLE 32

Brachypodium transcriptome expression sets

| Expression Set | Set ID |
|---|---|
| Leaf at flowering stage under normal growth conditions | 1 |
| Leaf at flowering stage under normal growth conditions | 2 |
| spike at flowering stage under normal growth conditions | 3 |

From set ID No. 1 the sample was used to extract DNA; from set ID No. 2 and 3 the samples were used to extract RNA.

Brachypodium yield components and vigor related parameters assessment—24 brachypodium accessions were grown in 4-6 repetitive plots (8 plant per plot), in a green house. The growing protocol was as follows: brachypodium seeds were sown in plots and grown under normal condition. Plants were continuously phenotyped during the growth period and at harvest (Table 34-35, below). The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih(dot)gov/]. Next, analyzed data was saved to text files and processed using the JMP statistical analysis software (SAS institute).

At the end of the growing period the grains were separated from the spikes and the following parameters were measured using digital imaging system and collected:

No. of tillering—all tillers were counted per plant at harvest (mean per plot).

Head number—At the end of the experiment, heads were harvested from each plot and were counted.

Total Grains weight per plot (gr.)—At the end of the experiment (plant 'Heads') heads from plots were collected, the heads were threshed and grains were weighted. In addition, the average grain weight per head was calculated by dividing the total grain weight by number of total heads per plot (based on plot).

Highest number of spikelets—The highest spikelet number per head was calculated per plant (mean per plot).

Mean number of spikelets—The mean spikelet number per head was calculated per plot.

Plant height—Each of the plants was measured for its height using measuring tape. Height was measured from ground level to spike base of the longest spike at harvest.

Spikelets weight (gr.)—The biomass and spikes weight of each plot was separated, measured per plot.

Average head weight—calculated by dividing spikelets weight with head number (gr.).

Harvest Index—harvest index was performed using Formula LXV above.

Spikelets Index—Spikelets index was performed using Formula XXXI.

Percent Number of heads with spikelets—The number of heads with more than one spikelet per plant were counted and the percent from all heads per plant was calculated.

Total dry mater per plot—Calculated as Vegetative portion above ground plus all the spikelet dry weight per plot.

1000 grain weight—At the end of the experiment all grains from all plots were collected and weighted and the weight of 1000 were calculated.

The following parameters were collected using digital imaging system:

At the end of the growing period the grains were separated from the spikes and the following parameters were measured and collected:

(i) Average Grain Area (cm$^2$)—A sample of ~200 grains was weighted, photographed and images were processed using the below described image processing system. The grain area was measured from those images and was divided by the number of grains.

(ii) Average Grain Length, perimeter and width (cm)—A sample of ~200 grains was weighted, photographed and images were processed using the below described image processing system. The sum of grain lengths and width (longest axis) was measured from those images and was divided by the number of grains.

The image processing system was used, which consists of a personal desktop computer (Intel P4 3.0 GHz processor) and a public domain program—ImageJ 1.37, Java based image processing software, which was developed at the U.S. National Institutes rsbweb(dot)nih(dot)gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

TABLE 33

| Brachypodium correlated parameters (vectors) | |
|---|---|
| Correlated parameter with | Correlation ID |
| % Num of heads with spikelets | 1 |
| 1000 grain weight (g) | 2 |
| Average head weight (g) | 3 |
| Grain Perimeter (cm) | 4 |
| Grain area (cm$^2$) | 5 |
| Grain length (cm) | 6 |
| Grain width (cm) | 7 |
| Grains weight per plant (g) | 8 |
| Grains weight per plot (g) | 9 |
| Harvest index (value) | 10 |
| Heads per plant (number) | 11 |
| Heads per plot (number) | 12 |
| Highest num of spikelets per plot | 13 |
| Mean num of spikelets per plot | 14 |
| Num of heads with spikelets per plant | 15 |
| Plant height (cm) | 17 |
| Plant Vegetative DW (g) | 16 |
| Plants num | 18 |
| Spikelets DW per plant (g) | 19 |
| Spikelets weight (g) | 20 |
| Spikes index (g) | 21 |
| Tillering (number) | 22 |
| Total dry mater per plant (g) | 23 |
| Total dry mater per plot (g) | 24 |
| Vegetative DW (g) | 25 |

Provided are the Brachypodium correlated parameters. "num" = number.

Experimental Results 24 different Brachypodium accessions were grown and characterized for different parameters as described above. The average for each of the measured parameter was calculated using the JMP software and values are summarized in Tables 34-35 below. Subsequent correlation analysis between the various transcriptome sets and the average parameters (Table 36) was conducted. Follow, results were integrated to the database.

TABLE 34

Measured parameters of correlation IDs in Brachypodium accessions under normal conditions

| Ecotype/Treatment | Line-1 | Line-2 | Line-3 | Line-4 | Line-5 | Line-6 | Line-7 | Line-8 |
|---|---|---|---|---|---|---|---|---|
| 1 | 27.61 | 35.33 | 21.67 | 52.40 | 20.84 | 47.73 | 17.55 | 16.51 |
| 2 | 3.75 | 3.78 | 3.35 | 3.70 | 3.90 | 4.87 | 4.82 | 4.76 |
| 3 | 0.057 | 0.044 | 0.049 | 0.087 | 0.040 | 0.087 | 0.060 | 0.055 |
| 4 | 1.67 | 1.62 | 1.62 | 1.65 | 1.60 | 1.90 | 1.80 | 1.82 |
| 5 | 0.102 | 0.096 | 0.094 | 0.088 | 0.086 | 0.113 | 0.105 | 0.111 |
| 6 | 0.733 | 0.719 | 0.717 | 0.750 | 0.724 | 0.871 | 0.794 | 0.789 |
| 7 | 0.178 | 0.168 | 0.167 | 0.149 | 0.151 | 0.165 | 0.168 | 0.180 |
| 8 | 0.14 | 0.06 | 0.08 | 0.35 | 0.27 | 0.44 | 0.32 | 0.07 |
| 9 | 1.05 | 0.44 | 0.61 | 2.58 | 2.03 | 3.40 | 2.58 | 0.39 |
| 10 | 0.13 | 0.14 | 0.15 | 0.21 | 0.17 | 0.18 | 0.15 | 0.11 |
| 11 | 16.29 | 7.08 | 6.59 | 16.11 | 21.40 | 17.05 | 25.88 | 8.02 |
| 12 | 121.75 | 56.60 | 52.75 | 123.50 | 156.83 | 135.00 | 207.00 | 48.60 |
| 13 | 3.00 | 2.60 | 3.00 | 2.83 | 2.33 | 4.50 | 2.60 | 2.00 |
| 14 | 2.10 | 2.10 | 1.72 | 2.17 | 1.85 | 2.85 | 1.93 | 1.56 |
| 15 | 5.27 | 2.50 | 2.06 | 9.44 | 5.02 | 7.72 | 4.90 | 1.87 |
| 16 | 0.42 | 0.12 | 0.13 | 0.82 | 0.67 | 1.05 | 0.87 | 0.31 |
| 17 | 31.65 | 23.44 | 22.75 | 45.35 | 29.41 | 46.74 | 38.39 | 29.15 |
| 18 | 7.50 | 8.00 | 8.00 | 7.50 | 7.33 | 7.88 | 8.00 | 6.40 |
| 19 | 0.96 | 0.31 | 0.33 | 1.46 | 0.96 | 1.42 | 1.56 | 0.45 |
| 20 | 7.18 | 2.50 | 2.68 | 11.31 | 7.16 | 11.05 | 12.44 | 2.66 |
| 21 | 0.71 | 0.72 | 0.73 | 0.68 | 0.60 | 0.57 | 0.65 | 0.60 |
| 22 | 16.84 | 7.20 | 7.00 | 16.99 | 23.61 | 18.25 | 27.20 | 8.60 |
| 23 | 1.38 | 0.43 | 0.47 | 2.28 | 1.63 | 2.47 | 2.43 | 0.76 |
| 24 | 10.26 | 3.45 | 3.74 | 17.78 | 12.29 | 19.27 | 19.40 | 4.47 |
| 25 | 3.08 | 0.95 | 1.06 | 6.47 | 5.13 | 8.23 | 6.96 | 1.81 |

Correlation IDs: 1, 2, 3, 4, 5, . . . etc. refer to those described in Table 33 above [Brachypodium correlated parameters (vectors)].

TABLE 35

Measured parameters of correlation IDs in *brachypodium* accessions under normal conditions

| Ecotype/Treatment | Line-9 | Line-10 | Line-11 | Line-12 | Line-13 | Line-14 | Line-15 |
|---|---|---|---|---|---|---|---|
| 1 | 5.42 | 15.42 | 14.00 | 6.40 | 4.51 | 15.52 | 20.34 |
| 2 | 5.54 | 4.98 | 4.88 | 4.83 | 5.54 | 4.73 | 5.24 |
| 3 | 0.040 | 0.056 | 0.075 | 0.048 | 0.042 | 0.048 | 0.053 |
| 4 | 1.82 | 1.83 | 1.69 | 1.74 | 1.93 | 1.69 | 1.91 |
| 5 | 0.105 | 0.111 | 0.094 | 0.102 | 0.110 | 0.100 | 0.124 |
| 6 | 0.833 | 0.824 | 0.740 | 0.781 | 0.896 | 0.748 | 0.857 |
| 7 | 0.161 | 0.172 | 0.162 | 0.166 | 0.155 | 0.169 | 0.185 |
| 8 | 0.14 | 0.14 | 0.26 | 0.14 | 0.11 | 0.39 | 0.14 |
| 9 | 1.11 | 1.07 | 1.96 | 1.09 | 0.84 | 3.07 | 1.09 |
| 10 | 0.20 | 0.16 | 0.20 | 0.14 | 0.26 | 0.22 | 0.09 |
| 11 | 10.48 | 9.09 | 11.63 | 14.13 | 5.88 | 23.75 | 16.06 |
| 12 | 82.40 | 70.13 | 83.40 | 110.33 | 47.00 | 185.50 | 125.00 |
| 13 | 2.00 | 2.25 | 2.20 | 1.83 | 2.00 | 2.50 | 2.40 |
| 14 | 1.38 | 1.65 | 1.69 | 1.43 | 1.25 | 1.76 | 1.83 |
| 15 | 0.71 | 1.94 | 2.08 | 1.08 | 0.35 | 4.98 | 3.70 |
| 16 | 0.32 | 0.32 | 0.38 | 0.39 | 0.13 | 0.87 | 0.69 |
| 17 | 34.36 | 28.65 | 31.95 | 28.88 | 24.74 | 37.30 | 45.09 |
| 18 | 7.80 | 7.75 | 7.20 | 7.83 | 8.00 | 7.75 | 8.00 |
| 19 | 0.44 | 0.56 | 0.88 | 0.67 | 0.26 | 1.14 | 0.83 |
| 20 | 3.45 | 4.29 | 6.42 | 5.29 | 2.04 | 8.89 | 6.65 |
| 21 | 0.58 | 0.66 | 0.71 | 0.64 | 0.66 | 0.59 | 0.54 |
| 22 | 10.67 | 9.38 | 11.97 | 14.58 | 6.35 | 25.50 | 16.56 |
| 23 | 0.76 | 0.88 | 1.25 | 1.06 | 0.38 | 2.01 | 1.53 |
| 24 | 6.00 | 6.78 | 9.12 | 8.34 | 3.04 | 15.79 | 12.20 |
| 25 | 2.55 | 2.48 | 2.69 | 3.05 | 1.00 | 6.89 | 5.55 |

Correlation IDs: 1, 2, 3, 4, 5, . . . etc. refer to those described in Table 33 above [*Brachypodium* correlated parameters (vectors)].

TABLE 36

Measured parameters of correlation IDs in *brachypodium* accessions under normal conditions

| Ecotype/Treatment | Line-16 | Line17 | Line-18 | Line-19 | Line-20 | Line-21 | Line-22 |
|---|---|---|---|---|---|---|---|
| 1 | 8.11 | 53.21 | 55.41 | 47.81 | 42.81 | 59.01 | 34.92 |
| 2 | 4.96 | 4.00 | 3.84 | 4.26 | 5.99 | 3.76 | 4.34 |
| 3 | 0.057 | 0.104 | 0.078 | 0.079 | 0.082 | 0.090 | 0.064 |
| 4 | 1.71 | 1.81 | 1.68 | 1.75 | 1.87 | 1.68 | 1.66 |
| 5 | 0.100 | 0.096 | 0.101 | 0.090 | 0.117 | 0.092 | 0.091 |
| 6 | 0.744 | 0.839 | 0.748 | 0.802 | 0.842 | 0.764 | 0.736 |
| 7 | 0.171 | 0.146 | 0.171 | 0.143 | 0.177 | 0.152 | 0.157 |
| 8 | 0.13 | 0.37 | 0.08 | 0.49 | 0.31 | 0.30 | 0.20 |
| 9 | 1.07 | 2.99 | 0.50 | 3.52 | 2.41 | 1.92 | 1.47 |
| 10 | 0.18 | 0.09 | 0.07 | 0.16 | 0.18 | 0.09 | 0.11 |
| 11 | 9.74 | 22.19 | 11.89 | 24.32 | 13.25 | 25.54 | 19.22 |
| 12 | 80.75 | 177.50 | 81.50 | 172.80 | 98.60 | 177.00 | 143.17 |
| 13 | 2.00 | 3.50 | 3.50 | 3.80 | 2.80 | 3.17 | 2.83 |
| 14 | 1.42 | 2.71 | 2.41 | 2.61 | 2.12 | 2.79 | 2.15 |
| 15 | 0.89 | 12.58 | 7.59 | 12.13 | 6.35 | 15.36 | 7.15 |
| 16 | 0.34 | 1.72 | 0.44 | 1.32 | 0.48 | 1.73 | 0.63 |
| 17 | 22.39 | 55.04 | 31.40 | 45.34 | 40.20 | 58.82 | 39.18 |
| 18 | 8.25 | 8.00 | 6.50 | 7.00 | 7.60 | 6.83 | 7.33 |
| 19 | 0.59 | 2.27 | 0.92 | 1.91 | 1.09 | 2.25 | 1.26 |
| 20 | 4.92 | 18.15 | 6.25 | 13.49 | 8.35 | 15.55 | 9.42 |
| 21 | 0.68 | 0.56 | 0.69 | 0.59 | 0.70 | 0.57 | 0.66 |
| 22 | 10.53 | 27.15 | 12.38 | 26.30 | 13.56 | 29.09 | 20.79 |
| 23 | 0.93 | 3.99 | 1.36 | 3.23 | 1.57 | 3.98 | 1.89 |
| 24 | 7.76 | 31.94 | 9.21 | 22.78 | 12.04 | 27.67 | 14.14 |
| 25 | 2.84 | 13.80 | 2.96 | 9.28 | 3.70 | 12.12 | 4.72 |

Correlation IDs: 1, 2, 3, 4, 5, . . . etc. refer to those described in Table 33 above [*Brachypodium* correlated parameters (vectors)].

TABLE 37

Correlation between the expression level of selected genes of some embodiments of the invention in various tissues and the phenotypic performance under normal conditions across *brachypodium* varieties

| Gene Name | R | P value | Exp. set | Corr. Set ID | Gene Name | R | P value | Exp. set | Corr. Set ID |
|---|---|---|---|---|---|---|---|---|---|
| LYM1099 | 0.85 | 5.21E−04 | 3 | 10 | LYM1082 | 0.72 | 8.94E−03 | 3 | 7 |
| LYM1082 | 0.73 | 7.32E−03 | 3 | 2 | LYM1084 | 0.71 | 9.89E−03 | 3 | 23 |
| LYM1084 | 0.83 | 8.85E−04 | 3 | 14 | LYM1084 | 0.71 | 1.01E−02 | 3 | 22 |
| LYM1084 | 0.80 | 1.76E−03 | 3 | 20 | LYM1084 | 0.72 | 7.84E−03 | 3 | 1 |
| LYM1084 | 0.88 | 1.85E−04 | 3 | 8 | LYM1084 | 0.84 | 6.71E−04 | 3 | 9 |
| LYM1084 | 0.83 | 7.36E−04 | 3 | 13 | LYM1084 | 0.73 | 7.51E−03 | 3 | 24 |
| LYM1084 | 0.72 | 8.26E−03 | 3 | 3 | LYM1084 | 0.78 | 2.89E−03 | 3 | 19 |
| LYM1084 | 0.71 | 1.03E−02 | 3 | 15 | LYM1084 | 0.72 | 1.89E−02 | 2 | 22 |
| LYM1092 | 0.71 | 1.48E−02 | 1 | 22 | LYM1094 | 0.74 | 1.39E−02 | 2 | 22 |
| LYM1096 | 0.72 | 1.32E−02 | 1 | 22 | LYM1097 | 0.80 | 3.42E−03 | 1 | 22 |

Provided are the correlations (R) between the expression levels yield improving genes and their homologs in various tissues [Expression (Exp) sets] and the phenotypic performance [yield, biomass, growth rate and/or vigor components (Correlation vector (Corr))] under normal conditions across *brachypodium* varieties. P = p value.

Example 8

Production of Foxtail Millet Transcriptome and High Throughput Correlation Analysis Using 60K Foxtaill Millet Oligonucleotide Micro-Array In order to produce a high throughput correlation analysis comparing between plant phenotype and gene expression level, the present inventors utilized a foxtail millet oligonucleotide micro-array, produced by Agilent Technologies [chem.(dot)agilent(dot)com/Scripts/PDS(dot)asp?1Page=50879]. The array oligonucleotide represents about 60K foxtail millet genes and transcripts. In order to define correlations between the levels of RNA expression and yield or vigor related parameters, various plant characteristics of 15 different foxtail millet accessions were analyzed. Among them, 11 accessions encompassing the observed variance were selected for RNA expression analysis. The correlation between the RNA levels and the characterized parameters was analyzed using Pearson correlation test [davidmlane(dot)com/hyperstat/A34739 (dot) html].

Experimental Procedures

Analyzed Foxtail millet tissues—three tissues at different developmental stages [leaf, flower, and stem], representing different plant characteristics, were sampled and RNA was extracted as described above. Each micro-array expression information tissue type has received a Set ID as summarized in Table 38 below.

TABLE 38

Foxtail millet transcriptome expression sets

| Expression Set | Set ID |
|---|---|
| Grain, grain filling stage, normal | 1 |
| Leaf, grain filling stage, normal | 2 |
| Stem, grain filling stage, normal | 3 |
| Flower, flowering stage, normal | 4 |
| Leaf, flowering stage, normal | 5 |

Foxtaill millet yield components and vigor related parameters assessment—14 Foxtail millet accessions in 5 repetitive plots, in the field. Foxtaill millet seeds were sown in soil and grown under normal condition in the field. Plants were continuously phenotyped during the growth period and at harvest (Tables 40-41, below). The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb(dot)nih(dot)gov/]. Next, analyzed data was saved to text files and processed using the JMP statistical analysis software (SAS institute).

The following parameters were collected using digital imaging system:

At the end of the growing period the grains were separated from the Plant 'Head' and the following parameters were measured and collected:

(i) Average Grain Area ($cm^2$)—A sample of ~200 grains was weighted, photographed and images were processed using the below described image processing system. The grain area was measured from those images and was divided by the number of grains.

(ii) Average Grain Length and width (cm)—A sample of ~200 grains was weighted, photographed and images were processed using the below described image processing system. The sum of grain lengths and width (longest axis) was measured from those images and was divided by the number of grains.

At the end of the growing period 14 'Heads' were photographed and images were processed using the below described image processing system.

(i) Head Average Area ($cm^2$)—The 'Head' area was measured from those images and was divided by the number of 'Heads'.

(ii) Head Average Length (mm)—The 'Head' length (longest axis) was measured from those images and was divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb(dot)nih(dot)gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Grain Weight (gr.)—At the end of the experiment (plant 'Heads') heads from plots were collected, the heads were threshed and grains were weighted. In addition, the average grain weight per head was calculated by dividing the total grain weight by number of total heads per plot (based on plot).

Head weight and head number—At the end of the experiment, heads were harvested from each plot and were counted and weighted (kg.).

Biomass at harvest—At the end of the experiment the vegetative material from plots was weighted.

Dry weight=total weight of the vegetative portion above ground (excluding roots) after drying at 70° C. in oven for 48 hours at harvest.

Total dry mater per plot—Calculated as Vegetative portion above ground plus all the heads dry weight per plot.

Num days to anthesis—Calculated as the number of days from sowing till 50% of the plot arrive anthesis.

TABLE 39

Foxtail millet correlated parameters (vectors)

| Correlated parameter with | Correlation ID |
|---|---|
| 1000 grain weight (g) | 1 |
| Biomass at harvest at one meter (kg) | 2 |
| Grain area (cm$^2$) | 3 |
| Grain length (cm) | 4 |
| Grain width (cm) | 5 |
| Grains yield per Head (plot) (g) | 6 |
| Head Area (cm$^2$) | 7 |
| Head length (cm) | 8 |
| Heads num | 9 |
| Num days to Anthesis | 10 |
| Total Grains yield (g) | 11 |
| Total dry matter at one meter (kg) | 12 |
| Total heads weight (kg) | 13 |

Provided are the foxtail millet correlated parameters.

Experimental Results 14 different foxtail millet accessions were grown and characterized for different parameters as described above. The average for each of the measured parameter was calculated using the JMP software and values are summarized in Tables 40-41 below. Subsequent correlation analysis between the various transcriptome sets and the average parameters (Table 42) was conducted. Follow, results were integrated to the database.

TABLE 40

Measured parameters of correlation IDs in foxtail millet accessions under normal conditions

| Ecotype/Treatment | Line-1 | Line-2 | Line-3 | Line-4 | Line-5 | Line-6 | Line-7 |
|---|---|---|---|---|---|---|---|
| 1 | 2.46 | 3.42 | 2.61 | 2.36 | 2.41 | 2.65 | 2.18 |
| 2 | 2.40 | 3.99 | 3.17 | 3.58 | 3.60 | 3.06 | 4.04 |
| 3 | 0.032 | 0.037 | 0.033 | 0.032 | 0.032 | 0.034 | 0.029 |
| 4 | 0.240 | 0.242 | 0.249 | 0.253 | 0.256 | 0.252 | 0.231 |
| 5 | 0.172 | 0.194 | 0.167 | 0.159 | 0.160 | 0.170 | 0.162 |
| 6 | 3.40 | 7.29 | 1.75 | 1.30 | 1.57 | 0.69 | 2.10 |
| 7 | 37.83 | 57.87 | 19.59 | 17.10 | 19.76 | 9.42 | 22.92 |
| 8 | 23.13 | 24.25 | 17.56 | 14.79 | 15.38 | 8.56 | 16.08 |
| 9 | 427.60 | 149.20 | 867.00 | 1204.00 | 1146.40 | 2132.00 | 752.20 |
| 10 | 34.00 | 41.00 | 45.00 | 41.00 | 41.00 | 30.00 | 38.00 |
| 11 | 1449.63 | 1067.88 | 1534.92 | 1567.20 | 1794.80 | 1476.11 | 1582.57 |
| 12 | 0.70 | 0.85 | 0.96 | 0.92 | 0.90 | 0.48 | 0.92 |
| 13 | 3.81 | 5.95 | 6.20 | 5.64 | 6.27 | 6.07 | 6.32 |

Correlation IDs: 1, 2, 3, 4, 5, . . . etc. refer to those described in Table 39 above [Foxtail millet correlated parameters (vectors)].

TABLE 41

Measured parameters of correlation IDs in foxtail millet accessions under normal conditions

| Ecotype/Treatment | Line-8 | Line-9 | Line-10 | Line-11 | Line-12 | Line-13 | Line-14 |
|---|---|---|---|---|---|---|---|
| 1 | 1.80 | 2.69 | 1.65 | 3.17 | 2.60 | 3.18 | 2.26 |
| 2 | 1.15 | 3.20 | 3.90 | 3.58 | 3.68 | 2.94 | 1.48 |
| 3 | 0.024 | 0.032 | 0.025 | 0.037 | 0.033 | 0.039 | 0.030 |
| 4 | 0.196 | 0.221 | 0.199 | 0.262 | 0.250 | 0.269 | 0.244 |
| 5 | 0.155 | 0.184 | 0.157 | 0.181 | 0.169 | 0.183 | 0.158 |
| 6 | 3.34 | 11.46 | 7.17 | 4.35 | 2.26 | 0.44 | 1.31 |
| 7 | 40.89 | 45.29 | 49.34 | 27.69 | 24.18 | 7.13 | 14.69 |
| 8 | 21.88 | 20.41 | 23.32 | 20.87 | 17.98 | 6.35 | 9.78 |
| 9 | 394.20 | 186.60 | 131.80 | 434.20 | 646.40 | 2797.80 | 994.60 |
| 10 | 30.00 | 38.00 | 51.00 | 44.00 | 51.00 | 31.00 | 27.00 |
| 11 | 1317.88 | 2131.60 | 937.93 | 1880.21 | 1427.12 | 1216.24 | 1296.69 |

TABLE 41-continued

Measured parameters of correlation IDs in foxtail millet accessions under normal conditions

| Ecotype/ Treatment | Line-8 | Line-9 | Line-10 | Line-11 | Line-12 | Line-13 | Line-14 |
|---|---|---|---|---|---|---|---|
| 12 | 0.45 | 0.59 | 1.00 | 0.91 | 1.03 | 0.62 | 0.46 |
| 13 | 2.82 | 7.25 | 5.24 | 6.58 | 5.85 | 5.62 | 2.73 |

Correlation IDs: 1, 2, 3, 4, 5, . . . etc. refer to those described in Table 39 above [Foxtail millet correlated parameters (vectors)].

TABLE 42

Correlation between the expression level of selected genes of some embodiments of the invention in various tissues and the phenotypic performance under normal conditions across foxtail millet varieties

| Gene Name | R | P value | Exp. set | Corr. Set ID | Gene Name | R | P value | Exp. set | Corr. Set ID |
|---|---|---|---|---|---|---|---|---|---|
| LYM1100 | 0.80 | 5.28E−03 | 2 | 11 | LYM1100 | 0.76 | 1.10E−02 | 2 | 8 |
| LYM1100 | 0.78 | 7.55E−03 | 2 | 6 | LYM1100 | 0.83 | 2.76E−03 | 2 | 7 |
| LYM1100 | 0.73 | 3.85E−02 | 3 | 11 | LYM1100 | 0.97 | 5.97E−05 | 3 | 6 |
| LYM1100 | 0.88 | 4.43E−03 | 3 | 7 | LYM1100 | 0.81 | 5.30E−02 | 1 | 13 |
| LYM1100 | 0.84 | 3.66E−02 | 1 | 6 | LYM1101 | 0.89 | 5.25E−04 | 2 | 13 |
| LYM1101 | 0.78 | 8.25E−03 | 2 | 2 | LYM1101 | 0.70 | 1.19E−01 | 1 | 13 |
| LYM1101 | 0.73 | 9.65E−02 | 1 | 6 | LYM1102 | 0.78 | 7.44E−03 | 2 | 1 |
| LYM1102 | 0.72 | 1.96E−02 | 2 | 3 | LYM1102 | 0.71 | 4.82E−02 | 3 | 1 |
| LYM1102 | 0.77 | 2.56E−02 | 3 | 3 | LYM1102 | 0.84 | 9.42E−03 | 3 | 9 |
| LYM1102 | 0.81 | 5.29E−02 | 1 | 13 | LYM1102 | 0.82 | 4.46E−02 | 1 | 6 |
| LYM1103 | 0.72 | 1.06E−01 | 1 | 1 | LYM1103 | 0.80 | 5.43E−02 | 1 | 8 |
| LYM1103 | 0.75 | 8.51E−02 | 1 | 3 | LYM1103 | 0.70 | 1.21E−01 | 1 | 7 |
| LYM1104 | 0.71 | 4.81E−02 | 3 | 11 | LYM1104 | 0.89 | 1.62E−02 | 1 | 10 |
| LYM1104 | 0.71 | 1.17E−01 | 1 | 2 | LYM1106 | 0.74 | 1.52E−02 | 2 | 5 |
| LYM1107 | 0.83 | 3.96E−02 | 1 | 8 | LYM1107 | 0.91 | 1.26E−02 | 1 | 6 |
| LYM1107 | 0.85 | 3.06E−02 | 1 | 5 | LYM1107 | 0.87 | 2.34E−02 | 1 | 7 |
| LYM1108 | 0.72 | 1.10E−01 | 1 | 12 | LYM1108 | 0.90 | 1.57E−02 | 1 | 4 |
| LYM1108 | 0.83 | 4.18E−02 | 1 | 9 | LYM1109 | 0.76 | 1.10E−02 | 2 | 13 |
| LYM1109 | 0.77 | 9.26E−03 | 2 | 11 | LYM1109 | 0.81 | 4.40E−03 | 2 | 10 |
| LYM1109 | 0.79 | 6.77E−03 | 2 | 2 | LYM1109 | 0.73 | 1.58E−02 | 2 | 6 |
| LYM1109 | 0.84 | 3.63E−02 | 1 | 1 | LYM1109 | 0.78 | 6.47E−02 | 1 | 3 |
| LYM1109 | 0.81 | 5.11E−02 | 1 | 2 | LYM1110 | 0.90 | 2.18E−03 | 3 | 6 |
| LYM1110 | 0.75 | 3.06E−02 | 3 | 7 | LYM1110 | 0.88 | 2.15E−02 | 1 | 8 |
| LYM1110 | 0.73 | 9.88E−02 | 1 | 6 | LYM1110 | 0.77 | 7.47E−02 | 1 | 5 |
| LYM1110 | 0.83 | 4.10E−02 | 1 | 7 | LYM1111 | 0.86 | 2.82E−02 | 1 | 8 |
| LYM1111 | 0.75 | 8.83E−02 | 1 | 7 | LYM1112 | 0.80 | 1.78E−02 | 3 | 11 |
| LYM1112 | 0.71 | 1.10E−01 | 1 | 1 | LYM1112 | 0.83 | 4.14E−02 | 1 | 4 |
| LYM1112 | 0.85 | 3.07E−02 | 1 | 3 | LYM1113 | 0.86 | 6.15E−03 | 3 | 12 |
| LYM1113 | 0.72 | 4.38E−02 | 3 | 8 | LYM1113 | 0.82 | 1.19E−02 | 3 | 10 |
| LYM1113 | 0.72 | 1.06E−01 | 1 | 1 | LYM1113 | 0.74 | 9.26E−02 | 1 | 10 |
| LYM1114 | 0.96 | 2.16E−03 | 1 | 11 | LYM1115 | 0.76 | 8.21E−02 | 1 | 8 |
| LYM1115 | 0.84 | 3.65E−02 | 1 | 6 | LYM1115 | 0.83 | 3.88E−02 | 1 | 5 |
| LYM1115 | 0.85 | 3.26E−02 | 1 | 7 | LYM1116 | 0.73 | 9.93E−02 | 1 | 1 |
| LYM1116 | 0.74 | 9.46E−02 | 1 | 8 | LYM1116 | 0.95 | 4.07E−03 | 1 | 6 |
| LYM1116 | 0.94 | 5.84E−03 | 1 | 5 | LYM1116 | 0.91 | 1.29E−02 | 1 | 7 |
| LYM1117 | 0.82 | 1.25E−02 | 3 | 11 | LYM1117 | 0.81 | 1.39E−02 | 3 | 8 |
| LYM1117 | 0.84 | 8.67E−03 | 3 | 6 | LYM1117 | 0.93 | 7.48E−04 | 3 | 7 |
| LYM1117 | 0.73 | 9.99E−02 | 1 | 13 | LYM1118 | 0.74 | 3.76E−02 | 3 | 13 |
| LYM1118 | 0.85 | 7.54E−03 | 3 | 11 | LYM1118 | 0.74 | 3.51E−02 | 3 | 6 |
| LYM1118 | 0.72 | 4.46E−02 | 3 | 7 | LYM1118 | 0.77 | 7.28E−02 | 1 | 11 |
| LYM1119 | 0.89 | 1.87E−02 | 1 | 13 | LYM1119 | 0.82 | 4.75E−02 | 1 | 11 |
| LYM1119 | 0.80 | 5.85E−02 | 1 | 6 | LYM1120 | 0.86 | 2.91E−02 | 1 | 8 |
| LYM1120 | 0.71 | 1.11E−01 | 1 | 5 | LYM1120 | 0.79 | 6.34E−02 | 1 | 7 |
| LYM1121 | 0.76 | 8.19E−02 | 1 | 1 | LYM1121 | 0.95 | 3.38E−03 | 1 | 8 |
| LYM1121 | 0.87 | 2.49E−02 | 1 | 5 | LYM1121 | 0.92 | 8.65E−03 | 1 | 7 |
| LYM1122 | 0.90 | 2.05E−03 | 3 | 9 | LYM1122 | 0.90 | 1.37E−02 | 1 | 1 |
| LYM1122 | 0.76 | 8.23E−02 | 1 | 4 | LYM1122 | 0.92 | 9.93E−03 | 1 | 8 |
| LYM1122 | 0.82 | 4.80E−02 | 1 | 3 | LYM1122 | 0.71 | 1.15E−01 | 1 | 9 |
| LYM1122 | 0.99 | 2.89E−04 | 1 | 6 | LYM1122 | 0.96 | 1.85E−03 | 1 | 5 |
| LYM1122 | 0.98 | 4.28E−04 | 1 | 7 | LYM1123 | 0.70 | 5.22E−02 | 3 | 4 |
| LYM1123 | 0.72 | 4.29E−02 | 3 | 3 | LYM1123 | 0.92 | 1.25E−03 | 3 | 9 |
| LYM1123 | 0.88 | 2.19E−02 | 1 | 6 | LYM1123 | 0.84 | 3.43E−02 | 1 | 5 |
| LYM1123 | 0.81 | 4.82E−02 | 1 | 7 | LYM1124 | 0.74 | 9.51E−02 | 1 | 6 |
| LYM1125 | 0.72 | 1.79E−02 | 2 | 12 | LYM1125 | 0.88 | 3.76E−03 | 3 | 12 |
| LYM1125 | 0.89 | 3.06E−03 | 3 | 10 | LYM1125 | 0.88 | 2.15E−02 | 1 | 12 |
| LYM1126 | 0.91 | 1.13E−02 | 1 | 13 | LYM1126 | 0.77 | 7.42E−02 | 1 | 11 |
| LYM1126 | 0.83 | 3.98E−02 | 1 | 10 | LYM1126 | 0.73 | 1.01E−01 | 1 | 3 |
| LYM1127 | 0.71 | 2.08E−02 | 2 | 5 | LYM1127 | 0.93 | 6.68E−04 | 3 | 6 |

TABLE 42-continued

Correlation between the expression level of selected genes of some embodiments of the invention in various tissues and the phenotypic performance under normal conditions across foxtail millet varieties

| Gene Name | R | P value | Exp. set | Corr. Set ID | Gene Name | R | P value | Exp. set | Corr. Set ID |
|---|---|---|---|---|---|---|---|---|---|
| LYM1127 | 0.80 | 1.64E−02 | 3 | 7 | LYM1128 | 0.83 | 3.96E−02 | 1 | 13 |
| LYM1128 | 0.89 | 1.73E−02 | 1 | 1 | LYM1128 | 0.76 | 7.89E−02 | 1 | 11 |
| LYM1128 | 0.89 | 1.88E−02 | 1 | 3 | LYM1123 | 0.72 | 1.95E−02 | 5 | 1 |
| LYM1100 | 0.85 | 1.69E−03 | 5 | 11 | LYM1101 | 0.80 | 3.31E−03 | 4 | 12 |
| LYM1101 | 0.76 | 6.46E−03 | 4 | 10 | LYM1102 | 0.75 | 1.18E−02 | 5 | 11 |
| LYM1103 | 0.80 | 3.40E−03 | 4 | 5 | LYM1104 | 0.76 | 6.31E−03 | 4 | 10 |
| LYM1108 | 0.79 | 3.65E−03 | 4 | 1 | LYM1108 | 0.78 | 4.23E−03 | 4 | 3 |
| LYM1110 | 0.75 | 8.36E−03 | 4 | 12 | LYM1110 | 0.85 | 1.05E−03 | 4 | 10 |
| LYM1116 | 0.71 | 2.07E−02 | 5 | 11 | LYM1118 | 0.86 | 1.23E−03 | 5 | 11 |
| LYM1120 | 0.85 | 1.86E−03 | 5 | 11 | | | | | |

Provided are the correlations (R) between the expression levels yield improving genes and their homologs in various tissues [Expression (Exp) sets] and the phenotypic performance [yield, biomass, growth rate and/or vigor components (Correlation vector (Cor))] under normal, low nitrogen and drought conditions across foxtail millet varieties.
P = p value.

Example 9

Production of Soybean (Glycine max) Transcriptome and High Throughput Correlation Analysis with Yield Parameters Using 44K B. Soybean Oligonucleotide Micro-Arrays In order to produce a high throughput correlation analysis, the present inventors utilized a Soybean oligonucleotide micro-array, produced by Agilent Technologies [chem.(dot) agilent(dot)com/Scripts/PDS(dot)asp?1Page=50879]. The array oligonucleotide represents about 42,000 Soybean genes and transcripts. In order to define correlations between the levels of RNA expression with yield components or plant architecture related parameters or plant vigor related parameters, various plant characteristics of 29 different Glycine max varieties were analyzed and 12 varieties were further used for RNA expression analysis. The correlation between the RNA levels and the characterized parameters was analyzed using Pearson correlation test.

Correlation of Glycine max Genes' Expression Levels with Phenotypic Characteristics Across Ecotype Experimental Procedures 29 Soybean varieties were grown in three repetitive plots, in field. Briefly, the growing protocol was as follows: Soybean seeds were sown in soil and grown under normal conditions until harvest. In order to define correlations between the levels of RNA expression with yield components or plant architecture related parameters or vigor related parameters, 12 different Soybean varieties (out of 29 varieties) were analyzed and used for gene expression analyses. Analysis was performed at two pre-determined time periods: at pod set (when the soybean pods are formed) and at harvest time (when the soybean pods are ready for harvest, with mature seeds).

TABLE 43

Soybean transcriptome expression sets

| Expression Set | Set ID |
|---|---|
| Apical meristem at vegetative stage under normal growth condition | 1 |
| Leaf at vegetative stage under normal growth condition | 2 |
| Leaf at flowering stage under normal growth condition | 3 |
| Leaf at pod setting stage under normal growth condition | 4 |
| Root at vegetative stage under normal growth condition | 5 |
| Root at flowering stage under normal growth condition | 6 |
| Root at pod setting stage under normal growth condition | 7 |
| Stem at vegetative stage under normal growth condition | 8 |
| Stem at pod setting stage under normal growth condition | 9 |
| Flower bud at flowering stage under normal growth condition | 10 |
| Pod (R3-R4) at pod setting stage under normal growth condition | 11 |

RNA extraction—All 12 selected Soybean varieties were sample per treatment. Plant tissues [leaf, root. Stem, pod, apical meristem, flower buds] growing under normal conditions were sampled and RNA was extracted as described above. The collected data parameters were as follows: Main branch base diameter [mm] at pod set—the diameter of the base of the main branch (based diameter) average of three plants per plot.

Fresh weight [gr./plant] at pod set—total weight of the vegetative portion above ground (excluding roots) before drying at pod set, average of three plants per plot.

Dry weight [gr./plant] at pod set—total weight of the vegetative portion above ground (excluding roots) after drying at 70° C. in oven for 48 hours at pod set, average of three plants per plot.

Total number of nodes with pods on lateral branches [value/plant]—counting of nodes which contain pods in lateral branches at pod set, average of three plants per plot.

Number of lateral branches at pod set [value/plant]—counting number of lateral branches at pod set, average of three plants per plot.

Total weight of lateral branches at pod set [gr./plant]—weight of all lateral branches at pod set, average of three plants per plot.

Total weight of pods on main stem at pod set [gr./plant]—weight of all pods on main stem at pod set, average of three plants per plot.

Total number of nodes on main stem [value/plant]—count of number of nodes on main stem starting from first node above ground, average of three plants per plot.

Total number of pods with 1 seed on lateral branches at pod set [value/plant]—count of the number of pods containing 1 seed in all lateral branches at pod set, average of three plants per plot.

Total number of pods with 2 seeds on lateral branches at pod set [value/plant]—count of the number of pods containing 2 seeds in all lateral branches at pod set, average of three plants per plot.

Total number of pods with 3 seeds on lateral branches at pod set [value/plant]—count of the number of pods containing 3 seeds in all lateral branches at pod set, average of three plants per plot.

Total number of pods with 4 seeds on lateral branches at pod set [value/plant]—count of the number of pods containing 4 seeds in all lateral branches at pod set, average of three plants per plot.

Total number of pods with 1 seed on main stem at pod set [value/plant]—count of the number of pods containing 1 seed in main stem at pod set, average of three plants per plot.

Total number of pods with 2 seeds on main stem at pod set [value/plant]—count of the number of pods containing 2 seeds in main stem at pod set, average of three plants per plot.

Total number of pods with 3 seeds on main stem at pod set [value/plant]—count of the number of pods containing 3 seeds in main stem at pod set, average of three plants per plot.

Total number of pods with 4 seeds on main stem at pod set [value/plant]—count of the number of pods containing 4 seeds in main stem at pod set, average of three plants per plot.

Total number of seeds per plant at pod set [value/plant]—count of number of seeds in lateral branches and main stem at pod set, average of three plants per plot.

Total number of seeds on lateral branches at pod set [value/plant]—count of total number of seeds on lateral branches at pod set, average of three plants per plot.

Total number of seeds on main stem at pod set [value/plant]—count of total number of seeds on main stem at pod set, average of three plants per plot.

Plant height at pod set [cm/plant]—total length from above ground till the tip of the main stem at pod set, average of three plants per plot.

Plant height at harvest [cm/plant]—total length from above ground till the tip of the main stem at harvest, average of three plants per plot.

Total weight of pods on lateral branches at pod set [gr./plant]—weight of all pods on lateral branches at pod set, average of three plants per plot.

Ratio of the number of pods per node on main stem at pod set—was performed using Formula XXIII above, average of three plants per plot.

Ratio of total number of seeds in main stem to number of seeds on lateral branches—was performed using Formula XXIV above, average of three plants per plot.

Total weight of pods per plant at pod set [gr./plant]—weight of all pods on lateral branches and main stem at pod set, average of three plants per plot.

Days till 50% flowering [days]—number of days till 50% flowering for each plot.

Days till 100% flowering [days]—number of days till 100% flowering for each plot.

Maturity [days]—measure as 95% of the pods in a plot have ripened (turned 100% brown). Delayed leaf drop and green stems are not considered in assigning maturity. Tests are observed 3 days per week, every other day, for maturity. The maturity date is the date that 95% of the pods have reached final color. Maturity is expressed in days after August 31 [according to the accepted definition of maturity in USA, Descriptor list for SOYBEAN, ars-grin(dot)gov/cgi-bin/npgs/html/desclist (dot)pl?51].

Seed quality [ranked 1-5]—measure at harvest; a visual estimate based on several hundred seeds. Parameter is rated according to the following scores considering the amount and degree of wrinkling, defective coat (cracks), greenishness, and moldy or other pigment. Rating is 1-very good, 2-good, 3-fair, 4-poor, 5-very poor.

Lodging [ranked 1-5]—was rated at maturity per plot according to the following scores: 1-most plants in a plot are erected; 2-all plants leaning slightly or a few plants down; 3-all plants leaning moderately, or 25%-50% down; 4-all plants leaning considerably, or 50%-80% down; 5-most plants down. Note: intermediate score such as 1.5 are acceptable.

Seed size [gr.]—weight of 1000 seeds per plot normalized to 13% moisture, measure at harvest.

Total weight of seeds per plant [gr./plant]—calculated at harvest (per 2 inner rows of a trimmed plot) as weight in grams of cleaned seeds adjusted to 13% moisture and divided by the total number of plants in two inner rows of a trimmed plot.

Yield at harvest [bushels/hectare]—calculated at harvest (per 2 inner rows of a trimmed plot) as weight in grams of cleaned seeds, adjusted to 13% moisture, and then expressed as bushels per acre.

Average lateral branch seeds per pod [number]—Calculate Num of Seeds on lateral branches-at pod set and divide by the Number of Total number of pods with seeds on lateral branches-at pod set.

Average main stem seeds per pod [number]—Calculate Total Number of Seeds on main stem at pod set and divide by the Number of Total number of pods with seeds on main stem at pod setting.

Main stem average internode length [cm]—Calculate Plant height at pod set and divide by the Total number of nodes on main stem at pod setting.

Total num of pods with seeds on main stem [number]—count all pods containing seeds on the main stem at pod setting.

Total num of pods with seeds on lateral branches [number]—count all pods containing seeds on the lateral branches at pod setting.

Total number of pods per plant at pod set [number]—count pods on main stem and lateral branches at pod setting.

Experimental Results

Twelve different Soybean varieties lines 1-12 were grown and characterized for 34 parameters as specified above. The average for each of the measured parameters was calculated using the JMP software and values are summarized in Tables 45-46 below. Subsequent correlation analysis between the various transcriptome sets and the average parameters was conducted (Table 47). Follow, results were integrated to the database.

TABLE 44

Soybean correlated parameters (vectors)

| Correlated parameter with | Correlation ID |
| --- | --- |
| 100 percent flowering (days) | 1 |
| 50 percent flowering (days) | 2 |
| Base diameter at pod set (mm) | 3 |
| DW at pod set (gr) | 4 |
| Lodging (score 1-5) | 5 |
| Maturity (days) | 6 |
| Num of lateral branches (number) | 7 |
| Num of pods with 1 seed on main stem at pod set (number) | 8 |
| Num of pods with 2 seed on main stem (number) | 9 |

TABLE 44-continued

Soybean correlated parameters (vectors)

| Correlated parameter with | Correlation ID |
|---|---|
| Num of pods with 3 seed on main stem (number) | 10 |
| Num of pods with 4 seed on main stem (number) | 11 |
| Plant height at harvest (cm) | 12 |
| Plant height at pod set (cm) | 13 |
| Ratio number of pods per node on main stem (ratio) | 14 |
| Ratio number of seeds per main stem to seeds per lateral branch (ratio) | 15 |
| Seed quality (score 1-5) | 16 |
| Total Number of Seeds on lateral branches | 18 |
| Seed size (gr) | 18 |
| Total Number of Seeds on main stem at pod set | 19 |
| Total no of pods with 1 seed on lateral branch (number) | 20 |
| Total no of pods with 2 seed on lateral branch (number) | 21 |
| Total no of pods with 3 seed on lateral branch (number) | 22 |
| Total no of pods with 4 seed on lateral branch (number) | 23 |
| Total number of nodes on main stem (number) | 24 |
| Total number of nodes with pods on lateral branches (number) | 25 |
| Total number of seeds per plant | 26 |
| Total weight of lateral branches at pod set (gr) | 27 |
| Total weight of pods on lateral branches (gr) | 28 |
| Total weight of pods on main stem at pod set (gr) | 29 |
| Total weight of pods per plant (gr) | 30 |
| Total weight of seeds per plant (gr/plant) | 31 |
| fresh weight at pod set (gr) | 32 |
| yield at harvest (bushel/hectare) | 33 |
| Average lateral branch seeds per pod (number) | 34 |
| Average main stem seeds per pod (number) | 35 |
| Main stem average internode length (cm/number) | 36 |
| Num pods with seeds on lateral branches-at pod set (number) | 37 |
| Total number of pods per plant at pod set (number) | 38 |
| Total number of pods with seeds on main stem at pod set (number) | 39 |
| Corrected Seed size (gr) | 40 |

TABLE 45

Measured parameters in Soybean varieties (lines 1-6)

| Ecotype/Treatment | Line-1 | Line-2 | Line-3 | Line-4 | Line-5 | Line-6 |
|---|---|---|---|---|---|---|
| 1 | 67.33 | 71.67 | 67.67 | 67.33 | 60.00 | 74.00 |
| 2 | 61.00 | 65.33 | 60.67 | 61.00 | 54.67 | 68.33 |
| 3 | 8.33 | 9.54 | 9.68 | 8.11 | 8.82 | 10.12 |
| 4 | 53.67 | 50.33 | 38.00 | 46.17 | 60.83 | 55.67 |
| 5 | 1.67 | 1.83 | 1.17 | 1.67 | 2.67 | 2.83 |
| 6 | 24.00 | 43.67 | 30.33 | 30.33 | 38.33 | 40.00 |
| 7 | 9.00 | 8.67 | 9.11 | 9.89 | 7.67 | 17.56 |
| 8 | 1.11 | 4.38 | 1.44 | 1.44 | 4.56 | 1.67 |
| 9 | 16.89 | 16.25 | 13.22 | 16.89 | 27.00 | 8.11 |
| 10 | 29.56 | 1.75 | 19.78 | 22.33 | 11.67 | 22.78 |
| 11 | 0.00 | 0.00 | 0.11 | 0.11 | 0.00 | 0.44 |
| 12 | 96.67 | 76.67 | 67.50 | 75.83 | 74.17 | 76.67 |
| 13 | 86.78 | 69.56 | 62.44 | 70.89 | 69.44 | 63.89 |
| 14 | 2.87 | 1.38 | 2.13 | 2.26 | 2.60 | 1.87 |
| 15 | 0.89 | 0.90 | 0.87 | 0.89 | 2.32 | 0.37 |
| 16 | 2.33 | 3.50 | 3.00 | 2.17 | 2.83 | 2.00 |
| 17 | 89.00 | 219.33 | 93.00 | 86.00 | 191.33 | 71.33 |
| 18 | 150.89 | 55.89 | 134.00 | 160.44 | 75.44 | 324.63 |
| 19 | 123.56 | 43.89 | 87.67 | 102.67 | 93.56 | 88.00 |
| 20 | 1.56 | 3.00 | 1.78 | 1.78 | 5.67 | 5.63 |
| 21 | 17.00 | 18.75 | 26.44 | 32.33 | 21.56 | 33.50 |
| 22 | 38.44 | 2.00 | 26.44 | 31.33 | 8.89 | 82.00 |
| 23 | 0.00 | 0.00 | 0.00 | 0.00 | 0.00 | 1.50 |
| 24 | 16.56 | 16.78 | 16.11 | 18.11 | 16.78 | 17.11 |
| 25 | 23.00 | 16.00 | 23.11 | 33.00 | 15.22 | 45.25 |
| 26 | 274.44 | 99.78 | 221.67 | 263.11 | 169.00 | 412.50 |
| 27 | 67.78 | 63.78 | 64.89 | 74.89 | 54.00 | 167.22 |
| 28 | 26.00 | 14.89 | 20.11 | 20.11 | 21.11 | 30.25 |
| 29 | 22.11 | 14.33 | 16.00 | 15.00 | 33.78 | 9.00 |
| 30 | 48.11 | 29.22 | 36.11 | 35.11 | 54.89 | 38.88 |
| 31 | 15.09 | 10.50 | 17.23 | 16.51 | 12.06 | 10.25 |
| 32 | 170.89 | 198.22 | 152.56 | 163.89 | 224.67 | 265.00 |
| 33 | 47.57 | 43.77 | 50.37 | 56.30 | 44.00 | 40.33 |
| 34 | 2.67 | 1.95 | 2.43 | 2.53 | 2.13 | 2.68 |
| 35 | 2.60 | 1.89 | 2.52 | 2.53 | 2.17 | 2.59 |
| 36 | 5.24 | 4.15 | 3.91 | 3.92 | 4.15 | 3.74 |
| 37 | 57.00 | 28.56 | 54.67 | 65.44 | 36.11 | 122.63 |
| 38 | 104.56 | 51.67 | 89.22 | 106.22 | 79.33 | 155.63 |
| 39 | 47.56 | 23.11 | 34.56 | 40.78 | 43.22 | 33.00 |
| 40 | 89.00 |  | 93.00 | 86.00 |  | 71.33 |

TABLE 46

Measured parameters in Soybean varieties (lines 7-12)

| Ecotype/Treatment | Line-7 | Line-8 | Line-9 | Line-10 | Line-11 | Line-12 |
|---|---|---|---|---|---|---|
| 1 | 73.00 | 72.33 | 68.67 | 73.67 | 68.00 | 70.67 |
| 2 | 66.50 | 65.67 | 62.33 | 67.67 | 61.67 | 64.33 |
| 3 | 8.46 | 8.09 | 8.26 | 7.73 | 8.16 | 7.89 |
| 4 | 48.00 | 52.00 | 44.17 | 52.67 | 56.00 | 47.50 |
| 5 | 2.67 | 2.50 | 1.83 | 3.50 | 3.33 | 1.50 |
| 6 | 41.00 | 38.33 | 31.00 | 39.00 | 27.33 | 32.67 |
| 7 | 11.67 | 12.11 | 8.00 | 9.11 | 6.78 | 10.00 |
| 8 | 4.00 | 4.33 | 2.11 | 1.89 | 3.44 | 1.22 |
| 9 | 21.33 | 17.67 | 20.33 | 16.11 | 28.11 | 16.56 |
| 10 | 11.11 | 28.22 | 24.11 | 36.44 | 39.67 | 32.33 |
| 11 | 0.00 | 0.56 | 0.00 | 3.89 | 0.00 | 0.00 |
| 12 | 101.67 | 98.33 | 75.83 | 116.67 | 76.67 | 71.67 |
| 13 | 89.78 | 82.11 | 70.56 | 101.67 | 79.56 | 67.22 |
| 14 | 1.98 | 2.71 | 2.78 | 2.75 | 3.70 | 2.84 |
| 15 | 3.90 | 0.78 | 1.18 | 1.98 | 1.03 | 0.83 |
| 16 | 3.50 | 2.50 | 2.17 | 2.33 | 2.17 | 2.17 |
| 17 | 88.00 | 75.00 | 80.67 | 75.67 | 76.33 | 77.33 |
| 18 | 46.88 | 176.22 | 143.00 | 105.44 | 184.33 | 187.33 |
| 19 | 80.00 | 126.56 | 115.11 | 159.00 | 178.67 | 131.33 |
| 20 | 2.88 | 3.00 | 1.25 | 2.67 | 1.78 | 3.00 |
| 21 | 8.50 | 22.78 | 21.75 | 10.67 | 23.78 | 25.67 |
| 22 | 9.00 | 42.11 | 32.75 | 25.67 | 45.00 | 44.33 |
| 23 | 0.00 | 0.33 | 0.00 | 1.11 | 0.00 | 0.00 |
| 24 | 18.78 | 18.89 | 16.78 | 21.11 | 19.33 | 20.78 |
| 25 | 8.25 | 25.44 | 21.88 | 16.33 | 22.56 | 24.22 |
| 26 | 136.00 | 302.78 | 260.50 | 264.44 | 363.00 | 318.67 |
| 27 | 45.44 | 83.22 | 64.33 | 52.00 | 76.89 | 67.00 |
| 28 | 4.13 | 20.11 | 17.00 | 9.22 | 28.11 | 22.56 |
| 29 | 9.03 | 16.00 | 15.89 | 14.56 | 30.44 | 18.00 |
| 30 | 14.25 | 36.11 | 32.75 | 23.78 | 58.56 | 40.56 |
| 31 | 7.30 | 11.38 | 15.68 | 10.83 | 12.98 | 15.16 |
| 32 | 160.67 | 196.33 | 155.33 | 178.11 | 204.44 | 164.22 |
| 33 | 34.23 | 44.27 | 53.67 | 42.47 | 43.60 | 52.20 |
| 34 | 2.12 | 2.58 | 2.58 | 2.67 | 2.62 | 2.58 |
| 35 | 2.22 | 2.49 | 2.47 | 2.71 | 2.51 | 2.61 |
| 36 | 4.80 | 4.36 | 4.20 | 4.82 | 4.12 | 3.83 |
| 37 | 20.38 | 68.22 | 55.75 | 40.11 | 70.56 | 73.00 |
| 38 | 61.00 | 119.00 | 103.25 | 98.44 | 141.78 | 123.11 |
| 39 | 36.44 | 50.78 | 43.63 | 58.33 | 71.22 | 50.11 |
| 40 | 88.00 | 75.00 | 80.67 | 75.67 | 76.33 | 77.33 |

TABLE 47

Correlation between the expression level of selected genes of some embodiments of the invention in various tissues and the phenotypic performance under normal conditions across soybean varieties

| Gene Name | R | P value | Exp. set | Corr. Set ID | Gene Name | R | P value | Exp. set | Corr. Set ID |
|---|---|---|---|---|---|---|---|---|---|
| LYM1216 | 0.72 | 4.25E−02 | 9 | 7 | LYM1216 | 0.76 | 4.35E−03 | 1 | 17 |
| LYM1217 | 0.78 | 7.37E−03 | 7 | 31 | LYM1217 | 0.81 | 4.15E−03 | 7 | 33 |
| LYM1217 | 0.73 | 7.29E−03 | 10 | 23 | LYM1218 | 0.74 | 1 46E−02 | 5 | 10 |
| LYM1218 | 0.71 | 2.18E−02 | 5 | 19 | LYM1218 | 0.72 | 1.82E−02 | 5 | 26 |
| LYM1218 | 0.79 | 2.08E−02 | 9 | 12 | LYM1218 | 0.84 | 6.97E−04 | 10 | 23 |
| LYM1219 | 0.78 | 7.58E−03 | 5 | 2 | LYM1219 | 0.78 | 7.26E−03 | 5 | 1 |
| LYM1219 | 0.75 | 1.23E−02 | 8 | 22 | LYM1219 | 0.70 | 2.31E−02 | 8 | 18 |
| LYM1219 | 0.70 | 2.41E−02 | 8 | 2 | LYM1219 | 0.72 | 1.93E−02 | 8 | 26 |
| LYM1219 | 0.84 | 8.33E−03 | 9 | 17 | LYM1219 | 0.73 | 7.16E−03 | 1 | 14 |
| LYM1220 | 0.70 | 2.38E−02 | 8 | 9 | LYM1220 | 0.73 | 3.84E−02 | 9 | 22 |
| LYM1220 | 0.71 | 4.63E−02 | 9 | 18 | LYM1220 | 0.74 | 3.41E−02 | 9 | 32 |
| LYM1220 | 0.79 | 1.92E−02 | 9 | 5 | LYM1220 | 0.78 | 2.15E−02 | 9 | 23 |
| LYM1220 | 0.76 | 2.86E−02 | 9 | 27 | LYM1220 | 0.72 | 4 42E−02 | 9 | 7 |
| LYM1220 | 0.84 | 6.63E−04 | 10 | 9 | LYM1220 | 0.78 | 2.69E−03 | 10 | 29 |
| LYM1220 | 0.91 | 3.43E−05 | 10 | 17 | LYM1221 | 0.73 | 1 62E−02 | 7 | 5 |
| LYM1221 | 0.77 | 9.93E−03 | 5 | 14 | LYM1221 | 0.72 | 1.92E−02 | 8 | 17 |
| LYM1221 | 0.87 | 5.35E−03 | 9 | 15 | LYM1221 | 0.76 | 2.95E−02 | 9 | 16 |
| LYM1222 | 0.74 | 1.37E−02 | 8 | 11 | LYM1222 | 0.82 | 3.63E−03 | 8 | 23 |
| LYM1222 | 0.73 | 3.83E−02 | 9 | 31 | LYM1222 | 0.72 | 4.48E−02 | 9 | 14 |
| LYM1222 | 0.80 | 1.82E−02 | 9 | 29 | LYM1222 | 0.82 | 9.76E−04 | 4 | 9 |
| LYM1222 | 0.74 | 6.30E−03 | 4 | 30 | LYM1222 | 0.71 | 9.31E−03 | 4 | 14 |
| LYM1222 | 0.85 | 4.82E−04 | 4 | 29 | LYM1223 | 0.86 | 1.36E−03 | 8 | 10 |
| LYM1223 | 0.78 | 7.78E−03 | 8 | 19 | LYM1223 | 0.74 | 3.69E−02 | 9 | 31 |
| LYM1223 | 0.71 | 1.01E−02 | 10 | 13 | LYM1223 | 0.75 | 5.28E−03 | 10 | 12 |
| LYM1224 | 0.85 | 1.79E−03 | 5 | 31 | LYM1224 | 0.85 | 1.98E−02 | 5 | 33 |
| LYM1224 | 0.75 | 3.12E−02 | 9 | 29 | LYM1224 | 0.79 | 2.37E−03 | 4 | 11 |
| LYM1224 | 0.78 | 2.88E−03 | 1 | 23 | LYM1224 | 0.71 | 9.14E−03 | 1 | 27 |
| LYM1225 | 0.72 | 8.91E−03 | 11 | 5 | LYM1225 | 0.79 | 2.06E−02 | 9 | 17 |
| LYM1225 | 0.74 | 6.42E−03 | 4 | 33 | LYM1225 | 0.71 | 9.14E−03 | 1 | 20 |
| LYM1226 | 0.73 | 1.60E−02 | 7 | 32 | LYM1226 | 0.81 | 1.50E−02 | 9 | 15 |
| LYM1226 | 0.75 | 3.03E−02 | 9 | 13 | LYM1226 | 0.77 | 2.68E−02 | 9 | 23 |
| LYM1226 | 0.79 | 1.99E−02 | 9 | 7 | LYM1226 | 0.70 | 1.09E−02 | 4 | 25 |
| LYM1227 | 0.77 | 8.82E−03 | 7 | 21 | LYM1227 | 0.78 | 7.79E−03 | 8 | 10 |
| LYM1227 | 0.73 | 1.68E−02 | 8 | 11 | LYM1227 | 0.72 | 4.31E−02 | 9 | 29 |
| LYM1227 | 0.84 | 9.05E−03 | 9 | 17 | LYM1227 | 0.78 | 3.07E−03 | 4 | 17 |
| LYM1227 | 0.77 | 3.64E−03 | 1 | 17 | LYM1227 | 0.74 | 5.73E−03 | 10 | 5 |
| LYM1218 | 0.71 | 2.16E−02 | 5 | 38 | LYM1218 | 0.73 | 3.88E−02 | 9 | 36 |
| LYM1219 | 0.72 | 8.47E−03 | 11 | 36 | LYM1219 | 0.74 | 1.35E−02 | 8 | 35 |
| LYM1219 | 0.79 | 7.15E−03 | 8 | 34 | LYM1220 | 0.71 | 5.02E−02 | 9 | 37 |
| LYM1221 | 0.71 | 2.05E−02 | 5 | 39 | LYM1223 | 0.82 | 3.79E−03 | 8 | 35 |
| LYM1223 | 0.77 | 9.45E−03 | 8 | 34 | LYM1223 | 0.74 | 6.02E−03 | 10 | 36 |
| LYM1226 | 0.73 | 3.97E−02 | 9 | 36 | LYM1227 | 0.86 | 1.33E−03 | 8 | 35 |
| LYM1227 | 0.80 | 5.77E−03 | 8 | 34 | LYM1227 | 0.74 | 9.72E−03 | 2 | 35 |
| LYM1216 | 0.84 | 8.59E−03 | 5 | 40 | LYM1217 | 0.76 | 2.98E−02 | 6 | 40 |
| LYM1218 | 0.80 | 2.92E−02 | 9 | 40 | LYM1219 | 0.80 | 1.69E−02 | 7 | 40 |
| LYM1219 | 0.74 | 1.53E−02 | 11 | 40 | LYM1219 | 0.78 | 2.32E−02 | 5 | 40 |
| LYM1220 | 0.79 | 2.03E−02 | 8 | 40 | LYM1220 | 0.83 | 2.20E−02 | 9 | 40 |
| LYM1222 | 0.81 | 4.08E−03 | 1 | 40 | LYM1223 | 0.77 | 2 65E−02 | 5 | 40 |
| LYM1224 | 0.71 | 4.83E−02 | 5 | 40 | LYM1224 | 0.85 | 7.12E−03 | 6 | 40 |
| LYM1226 | 0.87 | 1.00E−02 | 9 | 40 | | | | | |

Provided are the correlations (R) between the expression levels yield improving genes and their homologs in various tissues [Expression (Exp) sets] and the phenotypic performance [yield, biomass, and plant architecture (Correlation vector (Corr))] under normal conditions across soybean varieties.
P = p value.

Example 10

Production of Tomato Transcriptome and High Throughput Correlation Analysis Using 44K Tomato Oligonucleotide Micro-Array In order to produce a high throughput correlation analysis between NUE related phenotypes and gene expression, the present inventors utilized a Tomato oligonucleotide microarray, produced by Agilent Technologies [chem.(dot)agilent (dot)com/Scripts/PDS(dot)asp?1Page=50879]. The array oligonucleotide represents about 44,000 Tomato genes and transcripts. In order to define correlations between the levels of RNA expression with NUE, ABST, yield components or vigor related parameters various plant characteristics of 18 different Tomato varieties were analyzed. Among them, 10 varieties encompassing the observed variance were selected for RNA expression analysis. The correlation between the RNA levels and the characterized parameters was analyzed using Pearson correlation test [davidmlane (dot) com/hyperstat/A34739(dot)html].

Correlation of Tomato Varieties Across Ecotypes Grown Under Low Nitrogen, Drought and Regular Growth Conditions Experimental Procedures:

10 Tomato varieties were grown in 3 repetitive blocks, each containing 6 plants per plot were grown at net house. Briefly, the growing protocol was as follows:

1. Regular growth conditions: Tomato varieties were grown under normal conditions (4-6 Liters/m² of water per day and fertilized with NPK as recommended in protocols for commercial tomato production).

2. Low Nitrogen fertilization conditions: Tomato varieties were grown under normal conditions (4-6 Liters/m² per day and fertilized with NPK as recommended in protocols for commercial tomato production) until flower stage. At this time, Nitrogen fertilization was stopped.

3. Drought stress: Tomato variety was grown under normal conditions (4-6 Liters/m² per day) until flower stage. At this time, irrigation was reduced to 50% compared to normal conditions. Plants were phenotyped on a daily basis following the standard descriptor of tomato (Table 49). Harvest was conducted while 50% of the fruits were red (mature). Plants were separated to the vegetative part and fruits, of them, 2 nodes were analyzed for additional inflorescent parameters such as size, number of flowers, and inflorescent weight. Fresh weight of all vegetative material was measured. Fruits were separated to colors (red vs. green) and in accordance with the fruit size (small, medium and large). Next, analyzed data was saved to text files and processed using the JMP statistical analysis software (SAS institute). Data parameters collected are summarized in Tables 50-52, herein below.

Analyzed Tomato tissues—Two tissues at different developmental stages [flower and leaf], representing different plant characteristics, were sampled and RNA was extracted as described above. For convenience, each micro-array expression information tissue type has received a Set ID as summarized in Table 48 below.

TABLE 48

Tomato transcriptome expression sets

| Expression Set | Set ID |
| --- | --- |
| Leaf at reproductive stage under NUE conditions | 1 |
| Flower under normal conditions | 2 |
| Leaf at reproductive stage under normal conditions | 3 |
| Flower under drought conditions | 4 |
| Leaf at reproductive stage under drought conditions | 5 |
| Flower under NUE conditions | 6 |

Provided are the identification (ID) digits of each of the tomato expression sets.

Table 49 provides the tomato correlated parameters (Vectors). The average for each of the measured parameter was calculated using the JMP software and values are summarized in Tables 50-52 below. Subsequent correlation analysis was conducted (Table 53). Results were integrated to the database.

TABLE 49

Tomato correlated parameters (vectors)

| Correlated parameter with | Correlation ID |
| --- | --- |
| 100 weight green fruit [g] (Drought) | 1 |
| 100 weight green fruit [g] (Low N) | 2 |
| 100 weight green fruit [g] (Normal) | 3 |
| 100 weight red fruit [g] (Drought) | 4 |
| 100 weight red fruit [g] (Low N) | 5 |
| 100 weight red fruit [g] (Normal) | 6 |
| Cluster Weight NUE/Normal [g] | 7 |
| FW NUE/Normal [g] | 8 |
| FW drought/Normal [g] | 9 |
| FW/Plant (NUE) [g] | 10 |
| FW/Plant (Normal) [g] | 11 |

TABLE 49-continued

Tomato correlated parameters (vectors)

| Correlated parameter with | Correlation ID |
| --- | --- |
| FW/Plant Drought [g] | 12 |
| Fruit Drought/NUE [g] | 13 |
| Fruit NUE/Normal [g] | 14 |
| Fruit Yield Drought/Normal [g] | 15 |
| Fruit Yield/Plant (NUE) [g] | 16 |
| Fruit Yield/Plant Drought [g] | 17 |
| Fruit yield /Plant (Normal) [g] | 18 |
| HI [yield/ yield + biomass] (Low N) | 19 |
| HI [yield/ yield + biomass] (Normal) | 20 |
| Leaflet Length [cm] (Low N) | 21 |
| Leaflet Length [cm] (Normal) | 22 |
| Leaflet Length [cm]) (Drought) | 23 |
| Leaflet Width [cm] (Low N) | 24 |
| Leaflet Width [cm] (Normal) | 25 |
| Leaflet Width [cm] (Drought) | 26 |
| NUE [yield/SPAD] (Low N) | 27 |
| NUE [yield/SPAD] (Normal) | 28 |
| NUE2 [total biomass/SPAD] (Low N) | 29 |
| NUE2 [total biomass/SPAD] (Normal) | 30 |
| NUpE [biomass/SPAD] (Low N) | 31 |
| NUpE [biomass/SPAD] (Normal) | 32 |
| No flowers (NUE) | 33 |
| No flowers (Normal) | 34 |
| Num of Flower Drought/NUE | 35 |
| Num of Flower Drought/Normal | 36 |
| Num of flowers (Drought) | 37 |
| Num. Flowers NUE/Normal | 38 |
| RWC (Normal) | 39 |
| RWC Drought | 40 |
| RWC Drought/Normal | 41 |
| RWC NUE | 42 |
| RWC NUE/Normal | 43 |
| SAPD 100% RWC NUE/Normal | 44 |
| SLA [leaf area/plant biomass] (Low N) | 45 |
| SLA [leaf area/plant biomass] (Normal) | 46 |
| SPAD (Normal) | 47 |
| SPAD 100% RWC (NUE) | 48 |
| SPAD 100% RWC (Normal) | 49 |
| SPAD NUE | 50 |
| SPAD NUE/Normal | 51 |
| Total Leaf Area [cm²] (Low N) | 52 |
| Total Leaf Area [cm²] (Normal) | 53 |
| Total Leaf Area [cm²]) (Drought) | 54 |
| Weight Flower clusters [g] (Normal) | 55 |
| Weight clusters (flowers) [g] (NUE) | 56 |
| Weight flower clusters [g] (Drought) | 57 |
| Yield/SLA (Low N) | 58 |
| Yield/SLA (Normal) | 59 |
| Yield/total leaf area (Low N) | 60 |
| Yield/total leaf area (Normal) | 61 |
| average red fruit weight [g] (NUE) | 62 |
| average red fruit weight [g] (Normal) | 63 |
| average red fruit weight [g] (Drought) | 64 |
| flower cluster weight Drought/NUE [g] | 65 |
| flower cluster weight Drought/Normal [g] | 66 |
| red fruit weight Drought/Normal [g] | 67 |

Provided are the tomato correlated parameters. "gr." = grams; "FW" = fresh weight; "NUE" = nitrogen use efficiency; "RWC" = relative water content; "NUpE" = nitrogen uptake efficiency; "SPAD" = chlorophyll levels; "HI" = harvest index (vegetative weight divided on yield); "SLA" = specific leaf area (leaf area divided by leaf dry weight), Treatment in the parenthesis.

Fruit Weight (grams)—At the end of the experiment [when 50% of the fruits were ripe (red)] all fruits from plots within blocks A-C were collected. The total fruits were counted and weighted. The average fruits weight was calculated by dividing the total fruit weight by the number of fruits.

Plant vegetative Weight (grams)—At the end of the experiment [when 50% of the fruit were ripe (red)] all plants from plots within blocks A-C were collected. Fresh weight was measured (grams).

Inflorescence Weight (grams)—At the end of the experiment [when 50% of the fruits were ripe (red)] two Inflorescence from plots within blocks A-C were collected. The Inflorescence weight (gr.) and number of flowers per inflorescence were counted.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Water use efficiency (WUE)—can be determined as the biomass produced per unit transpiration. To analyze WUE, leaf relative water content was measured in control and transgenic plants. Fresh weight (FW) was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to the following Formula I [(FW−DW/TW−DW)×100] as described above.

Plants that maintain high relative water content (RWC) compared to control lines were considered more tolerant to drought than those exhibiting reduced relative water content Experimental Results

TABLE 50

Measured parameters in Tomato accessions (lines 1-6)

| Ecotype/Treatment | Line-1 | Line-2 | Line-3 | Line-4 | Line-5 | Line-6 |
|---|---|---|---|---|---|---|
| 2 | 0.87 | 3.66 | 0.57 | 0.37 | 3.40 | 0.68 |
| 3 |  |  | 0.56 | 3.05 | 0.24 | 2.58 |
| 5 | 1.06 | 6.87 | 0.65 | 0.53 | 7.17 | 0.44 |
| 6 |  |  | 0.82 | 2.46 | 0.50 | 2.76 |
| 7 | 0.46 | 1.07 | 0.44 | 0.01 | 1.08 | 0.02 |
| 8 | 2.65 | 0.38 | 0.74 | 3.01 | 0.83 | 1.54 |
| 9 | 1.72 | 0.34 | 0.61 | 2.63 | 1.18 | 1.36 |
| 10 | 4.04 | 1.21 | 2.25 | 2.54 | 1.85 | 3.06 |
| 11 | 1.53 | 3.17 | 3.02 | 0.84 | 2.24 | 1.98 |
| 12 | 2.62 | 1.09 | 1.85 | 2.22 | 2.63 | 2.71 |
| 13 | 1.15 | 0.73 | 1.32 | 0.76 | 1.51 | 0.71 |
| 14 | 0.49 | 1.93 | 0.97 | 3.80 | 2.78 | 0.78 |
| 15 | 0.57 | 1.41 | 1.27 | 2.88 | 4.20 | 0.55 |
| 16 | 0.41 | 0.66 | 0.48 | 0.46 | 1.35 | 0.35 |
| 17 | 0.47 | 0.48 | 0.63 | 0.35 | 2.04 | 0.25 |
| 18 | 0.83 | 0.34 | 0.49 | 0.12 | 0.49 | 0.45 |
| 19 | 0.09 | 0.35 | 0.18 | 0.15 | 0.42 | 0.10 |
| 20 | 0.35 | 0.10 | 0.14 | 0.12 | 0.18 | 0.19 |
| 21 | 6.40 | 5.92 | 3.69 | 5.43 | 6.95 | 3.73 |
| 22 |  |  | 6.34 | 7.99 | 5.59 | 7.70 |
| 24 | 3.47 | 1.97 | 1.79 | 2.55 | 3.52 | 1.73 |
| 25 |  |  | 3.69 | 4.77 | 3.43 | 4.56 |
| 27 | 0.014 | 0.017 | 0.014 | 0.020 | 0.039 | 0.011 |
| 28 | 0.017 | 0.009 | 0.009 | 0.003 | 0.010 | 0.010 |
| 29 | 0.156 | 0.048 | 0.082 | 0.128 | 0.093 | 0.105 |
| 30 | 0.047 | 0.095 | 0.063 | 0.021 | 0.057 | 0.056 |
| 31 | 0.142 | 0.031 | 0.068 | 0.108 | 0.054 | 0.094 |
| 32 | 0.031 | 0.085 | 0.054 | 0.018 | 0.046 | 0.046 |
| 33 | 19.00 | 5.33 | 9.00 | 13.00 | 10.67 | 16.67 |
| 34 | 5.67 | 19.33 | 6.33 | 7.67 | 9.67 | 8.33 |
| 35 | 0.88 | 1.22 | 1.74 | 1.56 | 1.09 | 1.52 |
| 36 | 2.94 | 0.34 | 2.47 | 2.65 | 1.21 | 3.04 |
| 37 | 16.67 | 6.50 | 15.67 | 20.33 | 11.67 | 25.33 |
| 38 | 3.35 | 0.28 | 1.42 | 1.70 | 1.10 | 2.00 |
| 39 | 72.83 | 76.47 | 64.29 | 67.07 | 54.79 | 77.61 |
| 40 | 72.12 | 74.51 | 65.33 | 72.22 | 66.13 | 68.33 |
| 41 | 0.99 | 0.97 | 1.02 | 1.08 | 1.21 | 0.88 |
| 42 | 74.07 | 99.08 | 69.49 | 63.24 | 77.36 | 77.91 |
| 43 | 1.02 | 1.30 | 1.08 | 0.94 | 1.41 | 1.00 |
| 44 | 0.79 | 1.37 | 0.92 | 0.75 | 1.31 | 0.97 |
| 45 | 140.04 | 317.12 | 131.29 | 148.82 | 257.51 | 64.34 |
| 46 |  |  | 140.99 | 689.67 | 130.22 | 299.12 |
| 47 | 49.70 | 37.20 | 55.80 | 46.40 | 48.20 | 43.40 |
| 48 | 28.47 | 39.04 | 33.01 | 23.42 | 34.53 | 32.51 |
| 49 | 36.17 | 28.45 | 35.89 | 31.09 | 26.38 | 33.68 |

TABLE 50-continued

Measured parameters in Tomato accessions (lines 1-6)

| Ecotype/Treatment | Line-1 | Line-2 | Line-3 | Line-4 | Line-5 | Line-6 |
|---|---|---|---|---|---|---|
| 50 | 38.40 | 39.40 | 47.50 | 37.00 | 44.60 | 41.70 |
| 51 | 0.77 | 1.06 | 0.85 | 0.80 | 0.93 | 0.96 |
| 52 | 565.93 | 384.77 | 294.83 | 378.00 | 476.39 | 197.08 |
| 53 |  |  | 426.10 | 582.38 | 291.40 | 593.58 |
| 55 | 1.17 | 0.34 | 0.69 | 56.35 | 0.44 | 11.31 |
| 56 | 0.53 | 0.37 | 0.31 | 0.35 | 0.47 | 0.25 |
| 57 | 0.37 | 0.41 | 0.33 | 0.29 | 0.55 | 0.31 |
| 58 | 0.003 | 0.002 | 0.004 | 0.003 | 0.005 | 0.006 |
| 59 |  |  | 0.004 | 0.000 | 0.004 | 0.002 |
| 60 | 0.001 | 0.002 | 0.002 | 0.001 | 0.003 | 0.002 |
| 61 |  |  | 0.001 | 0.000 | 0.002 | 0.001 |
| 62 | 0.02 | 0.19 | 0.01 | 0.01 | 0.10 | 0.00 |
| 63 | 0.05 | 0.01 | 0.01 | 0.29 | 0.01 | 0.05 |
| 64 | 0.01 | 0.19 | 0.21 | 0.00 | 0.10 | 0.00 |
| 65 | 0.69 | 1.11 | 1.06 | 0.82 | 1.16 | 1.25 |
| 66 | 0.32 | 1.19 | 0.47 | 0.01 | 1.25 | 0.03 |
| 67 | 0.19 | 24.37 | 25.38 | 0.02 | 20.26 | 0.04 |

TABLE 51

Measured parameters in Tomato accessions (lines 7-12)

| Ecotype/Treatment | Line-7 | Line-8 | Line-9 | Line-10 | Line-11 | Line-12 |
|---|---|---|---|---|---|---|
| 1 |  |  |  |  |  | 0.80 |
| 2 | 0.45 | 0.47 | 0.54 | 0.39 | 0.97 | 0.91 |
| 3 | 6.32 | 5.75 | 0.38 | 0.30 | 1.95 | 2.53 |
| 4 |  |  |  |  |  | 0.89 |
| 5 |  | 0.55 | 0.75 | 0.58 | 1.27 | 1.34 |
| 6 | 5.32 | 5.24 | 0.61 | 0.66 | 2.70 | 0.70 |
| 7 | 0.37 | 0.81 | 0.55 | 0.36 | 0.95 | 0.80 |
| 8 | 3.70 | 1.22 | 0.58 | 0.55 | 1.06 | 0.49 |
| 9 | 4.02 | 1.01 | 0.61 | 0.64 | 0.95 | 0.51 |
| 10 | 3.13 | 2.54 | 1.84 | 1.52 | 1.91 | 1.86 |
| 11 | 0.85 | 2.09 | 3.21 | 2.75 | 1.81 | 3.77 |
| 12 | 3.41 | 2.11 | 1.95 | 1.76 | 1.72 | 1.92 |
| 13 | 5.06 | 0.89 | 0.67 | 2.17 | 0.38 | 1.27 |
| 14 | 0.02 | 1.16 | 2.07 | 1.51 | 2.41 | 2.06 |
| 15 | 0.09 | 1.03 | 1.39 | 3.28 | 0.91 | 2.62 |
| 16 | 0.01 | 0.51 | 0.44 | 0.47 | 1.59 | 0.39 |
| 17 | 0.05 | 0.45 | 0.29 | 1.02 | 0.60 | 0.49 |
| 18 | 0.53 | 0.44 | 0.21 | 0.31 | 0.66 | 0.19 |
| 19 | 0.00 | 0.17 | 0.19 | 0.24 | 0.45 | 0.17 |
| 20 | 0.38 | 0.17 | 0.06 | 0.10 | 0.27 | 0.05 |
| 21 | 4.39 | 6.72 | 6.66 | 4.39 | 3.90 | 5.29 |
| 22 | 7.85 | 6.22 | 6.16 | 5.65 | 4.39 | 4.44 |
| 23 |  |  |  |  |  | 5.15 |
| 24 | 1.87 | 3.54 | 3.28 | 2.52 | 2.61 | 2.61 |
| 25 | 4.44 | 3.15 | 3.37 | 3.13 | 2.40 | 2.02 |
| 26 |  |  |  |  |  | 2.55 |
| 27 | 0.000 | 0.015 | 0.014 | 0.013 | 0.064 | 0.010 |
| 28 | 0.012 | 0.008 | 0.004 | 0.006 | 0.017 | 0.004 |
| 29 | 0.114 | 0.091 | 0.076 | 0.056 | 0.141 | 0.055 |
| 30 | 0.032 | 0.047 | 0.058 | 0.060 | 0.062 | 0.083 |
| 31 | 0.113 | 0.075 | 0.061 | 0.043 | 0.077 | 0.046 |
| 32 | 0.020 | 0.039 | 0.055 | 0.054 | 0.045 | 0.079 |
| 33 | 6.00 | 16.00 | 15.00 | 6.00 | 17.00 | 13.00 |
| 34 | 5.00 | 8.33 | 10.00 | 7.00 | 9.00 | 8.00 |
| 35 | 4.96 | 1.08 | 0.98 | 4.94 | 0.88 | 0.79 |
| 36 | 5.95 | 2.08 | 1.47 | 4.24 | 1.67 | 1.29 |
| 37 | 29.73 | 17.33 | 14.67 | 29.67 | 15.00 | 10.33 |
| 38 | 1.20 | 1.92 | 1.50 | 0.86 | 1.89 | 1.63 |

TABLE 51-continued

Measured parameters in Tomato accessions (lines 7-12)

| Ecotype/Treatment | Line-7 | Line-8 | Line-9 | Line-10 | Line-11 | Line-12 |
|---|---|---|---|---|---|---|
| 39 | 58.18 | 66.51 | 64.71 | 75.25 | 66.23 | 63.21 |
| 40 | 78.13 | 18.46 | 73.21 | 62.50 | 67.21 | 75.76 |
| 41 | 1.34 | 0.28 | 1.13 | 0.83 | 1.01 | 1.20 |
| 42 | 80.49 | 67.40 | 67.16 | 66.07 | 69.57 | 69.30 |
| 43 | 1.38 | 1.01 | 1.04 | 0.88 | 1.05 | 1.10 |
| 44 | 1.11 | 0.95 | 0.79 | 0.92 | 0.94 | 1.36 |
| 45 | 144.60 | 246.05 | 405.55 | 299.32 | 86.19 | 182.32 |
| 46 | 1117.74 | 111.77 | 106.29 | 123.14 | 104.99 | 111.88 |
| 47 | 42.90 | 53.30 | 58.50 | 51.10 | 40.00 | 47.60 |
| 48 | 27.66 | 33.68 | 30.04 | 35.50 | 24.81 | 40.77 |
| 49 | 24.98 | 35.47 | 37.87 | 38.43 | 26.49 | 30.07 |
| 50 | 34.40 | 50.00 | 44.70 | 53.70 | 35.70 | 58.80 |
| 51 | 0.80 | 0.94 | 0.76 | 1.05 | 0.89 | 1.24 |
| 52 | 453.24 | 625.51 | 748.01 | 453.96 | 164.85 | 338.30 |
| 53 | 947.59 | 233.35 | 340.73 | 339.11 | 190.14 | 421.79 |
| 54 | | | | | | 337.63 |
| 55 | 0.79 | 0.58 | 0.73 | 0.83 | 0.86 | 0.50 |
| 56 | 0.29 | 0.47 | 0.40 | 0.30 | 0.82 | 0.40 |
| 57 | 0.45 | 0.56 | 0.30 | 0.31 | 0.31 | 0.31 |
| 58 | 0.000 | 0.002 | 0.001 | 0.002 | 0.018 | 0.002 |
| 59 | 0.000 | 0.004 | 0.002 | 0.003 | 0.006 | 0.002 |
| 60 | 0.000 | 0.001 | 0.001 | 0.001 | 0.010 | 0.001 |
| 61 | 0.001 | 0.002 | 0.001 | 0.001 | 0.003 | 0.000 |
| 62 | 0.01 | 0.01 | 0.01 | 0.01 | 0.02 | 0.01 |
| 63 | 0.23 | 0.29 | 0.01 | 0.01 | 0.06 | 0.01 |
| 64 | 0.03 | 0.01 | 0.01 | 0.00 | 0.01 | 0.01 |
| 65 | 1.52 | 1.19 | 0.76 | 1.04 | 0.38 | 0.78 |
| 66 | 0.56 | 0.96 | 0.42 | 0.38 | 0.36 | 0.62 |
| 67 | 0.15 | 0.02 | 0.86 | 0.74 | 0.09 | 1.72 |

TABLE 52

Measured parameters in Tomato accessions (lines 13-18)

| Ecotype/Treatment | Line-13 | Line-14 | Line-15 | Line-16 | Line-17 | Line-18 |
|---|---|---|---|---|---|---|
| 1 | 0.28 | 0.38 | 0.63 | 2.86 | 1.16 | 4.40 |
| 2 | 0.36 | 0.35 | 0.57 | 4.38 | 2.02 | 8.13 |
| 3 | 1.42 | 2.03 | 1.39 | 2.27 | 0.45 | 0.42 |
| 4 | 0.35 | 0.63 | 2.27 | 7.40 | 2.94 | 11.60 |
| 5 | 0.52 | 0.57 | 0.94 | 6.17 | 3.67 | 11.33 |
| 6 | 2.64 | 4.67 | 2.17 | 0.49 | 0.34 | 0.75 |
| 7 | 0.34 | 0.61 | 0.94 | 0.68 | 0.40 | 1.44 |
| 8 | 1.31 | 1.36 | 0.51 | 0.71 | 0.31 | 0.47 |
| 9 | 1.17 | 1.94 | 0.35 | 1.06 | 0.21 | 0.48 |
| 10 | 2.47 | 2.62 | 1.08 | 1.17 | 0.92 | 1.09 |
| 11 | 1.89 | 1.93 | 2.14 | 1.65 | 3.01 | 2.29 |
| 12 | 2.21 | 3.73 | 0.75 | 1.76 | 0.63 | 1.11 |
| 13 | 0.84 | 1.51 | 0.98 | 1.34 | 0.38 | 0.84 |
| 14 | 0.38 | 1.64 | 0.41 | 1.21 | 4.59 | 1.70 |
| 15 | 0.32 | 2.48 | 0.41 | 1.62 | 1.76 | 1.42 |
| 16 | 0.32 | 0.45 | 0.14 | 0.40 | 1.44 | 0.50 |
| 17 | 0.27 | 0.68 | 0.14 | 0.53 | 0.55 | 0.41 |
| 18 | 0.85 | 0.27 | 0.35 | 0.33 | 0.31 | 0.29 |
| 19 | 0.12 | 0.15 | 0.12 | 0.25 | 0.61 | 0.31 |

TABLE 52-continued

Measured parameters in Tomato accessions (lines 13-18)

| Ecotype/Treatment | Line-13 | Line-14 | Line-15 | Line-16 | Line-17 | Line-18 |
|---|---|---|---|---|---|---|
| 20 | 0.31 | 0.12 | 0.14 | 0.17 | 0.09 | 0.11 |
| 21 | 6.32 | 5.11 | 4.72 | 6.83 | 7.10 | 8.21 |
| 22 | 6.77 | 7.42 | 6.71 | 5.87 | 4.16 | 10.29 |
| 23 | 3.38 | 7.14 | 5.48 | 8.62 | 6.35 | 6.77 |
| 24 | 3.58 | 2.56 | 2.48 | 3.43 | 3.30 | 3.69 |
| 25 | 3.80 | 3.74 | 2.98 | 3.22 | 2.09 | 5.91 |
| 26 | 2.04 | 4.17 | 3.09 | 4.69 | 3.87 | 2.91 |
| 27 | 0.007 | 0.017 | 0.004 | 0.013 | 0.037 | 0.013 |
| 28 | 0.015 | 0.006 | 0.008 | 0.006 | 0.008 | 0.005 |
| 29 | 0.059 | 0.118 | 0.035 | 0.051 | 0.061 | 0.042 |
| 30 | 0.047 | 0.046 | 0.057 | 0.036 | 0.080 | 0.044 |
| 31 | 0.052 | 0.101 | 0.031 | 0.038 | 0.024 | 0.029 |
| 32 | 0.033 | 0.040 | 0.049 | 0.030 | 0.072 | 0.039 |
| 33 | 8.67 | 9.33 | 12.67 | 6.67 | 9.33 | 8.00 |
| 34 | 5.33 | 8.00 | 7.67 | 9.00 | 10.67 | 9.00 |
| 35 | 2.12 | 1.29 | 1.61 | 1.90 | 1.36 | 1.42 |
| 36 | 3.44 | 1.50 | 2.65 | 1.41 | 1.19 | 1.26 |
| 37 | 18.33 | 12.00 | 20.33 | 12.67 | 12.67 | 11.33 |
| 38 | 1.63 | 1.17 | 1.65 | 0.74 | 0.88 | 0.89 |
| 39 | 56.77 | 35.96 | 77.62 | 100.00 | 63.16 | 75.13 |
| 40 | 62.82 | 70.69 | 55.75 | 75.22 | 63.68 | 62.31 |
| 41 | 1.11 | 1.97 | 0.72 | 0.75 | 1.01 | 0.83 |
| 42 | 100.00 | 57.66 | 90.79 | 68.00 | 59.65 | 72.17 |
| 43 | 1.76 | 1.60 | 1.17 | 0.68 | 0.94 | 0.96 |
| 44 | 1.44 | 1.50 | 1.05 | 0.56 | 1.48 | 0.84 |
| 45 | 160.18 | 90.10 | 160.99 | 379.03 | 531.08 | 650.68 |
| 46 | 307.95 | 419.37 | 365.81 | 212.93 | 84.94 | 469.87 |
| 47 | 57.90 | 48.30 | 43.60 | 54.50 | 41.60 | 59.10 |
| 48 | 47.47 | 26.06 | 35.38 | 30.60 | 38.97 | 37.46 |
| 49 | 32.89 | 17.35 | 33.82 | 54.47 | 26.25 | 44.43 |
| 50 | 47.50 | 45.20 | 39.00 | 45.00 | 65.30 | 51.90 |
| 51 | 0.82 | 0.94 | 0.89 | 0.83 | 1.57 | 0.88 |
| 52 | 396.00 | 236.15 | 174.58 | 441.78 | 489.18 | 707.80 |
| 53 | 581.33 | 807.51 | 784.06 | 351.80 | 255.78 | 1078.10 |
| 54 | 130.78 | 557.93 | 176.67 | 791.86 | 517.05 | 832.27 |
| 55 | 1.02 | 0.70 | 0.38 | 0.66 | 0.70 | 0.33 |
| 56 | 0.35 | 0.43 | 0.35 | 0.45 | 0.28 | 0.47 |
| 57 | 8.36 | 0.29 | 0.34 | 0.44 | 0.27 | 0.43 |
| 58 | 0.002 | 0.005 | 0.001 | 0.001 | 0.003 | 0.001 |
| 59 | 0.003 | 0.001 | 0.001 | 0.002 | 0.004 | 0.001 |
| 60 | 0.001 | 0.002 | 0.001 | 0.001 | 0.003 | 0.001 |
| 61 | 0.001 | 0.000 | 0.000 | 0.001 | 0.001 | 0.000 |
| 62 | 0.01 | 0.05 | 0.36 | 0.04 | 0.63 | |
| 63 | 0.03 | 0.26 | 0.03 | 0.00 | 0.00 | 0.01 |
| 64 | 0.00 | 0.01 | 0.30 | 0.14 | 0.04 | 0.09 |
| 65 | 24.12 | 0.67 | 0.97 | 0.99 | 0.95 | 0.91 |
| 66 | 8.20 | 0.41 | 0.91 | 0.67 | 0.38 | 1.31 |
| 67 | 0.17 | 0.02 | 10.50 | 27.89 | 11.79 | 9.98 |

Provided are the values of each of the parameters (as described above) measured in tomato accessions (Seed ID) under all growth conditions. Growth conditions are specified in the experimental procedure section.

TABLE 53

Correlation between the expression level of selected genes of some embodiments of the invention in various tissues and the phenotypic performance under normal and stress conditions across tomato ecotypes

| Gene Name | R | P value | Exp. set | Corr. Set ID | Gene Name | R | P value | Exp. set | Corr. Set ID |
|---|---|---|---|---|---|---|---|---|---|
| LYM1228 | 0.78 | 7.60E−03 | 1 | 7 | LYM1228 | 0.89 | 5.31E−04 | 1 | 2 |
| LYM1228 | 0.84 | 2.26E−03 | 1 | 5 | LYM1228 | 0.74 | 1.41E−02 | 5 | 67 |
| LYM1228 | 0.82 | 3.57E−03 | 5 | 64 | LYM1229 | 0.92 | 5.03E−04 | 3 | 20 |
| LYM1229 | 0.82 | 6.77E−03 | 3 | 28 | LYM1229 | 0.73 | 1.55E−02 | 6 | 10 |
| LYM1229 | 0.73 | 1.64E−02 | 6 | 8 | LYM1229 | 0.73 | 1.73E−02 | 6 | 38 |
| LYM1230 | 0.83 | 3.24E−03 | 5 | 35 | LYM1231 | 0.71 | 3.20E−02 | 3 | 32 |
| LYM1231 | 0.77 | 2.52E−02 | 2 | 61 | LYM1232 | 0.76 | 1.69E−02 | 3 | 32 |
| LYM1232 | 0.75 | 1.98E−02 | 3 | 30 | LYM1232 | 0.78 | 8.00E−03 | 6 | 33 |
| LYM1233 | 0.70 | 5.12E−02 | 2 | 3 | LYM1233 | 0.71 | 2.15E−02 | 2 | 47 |
| LYM1233 | 0.72 | 1.99E−02 | 6 | 29 | LYM1233 | 0.84 | 2.26E−03 | 5 | 67 |
| LYM1240 | 0.88 | 9.01E−04 | 5 | 64 | LYM1240 | 0.75 | 2.03E−02 | 1 | 62 |
| LYM1240 | 0.76 | 3.02E−02 | 2 | 22 | LYM1240 | 0.70 | 5.10E−02 | 2 | 46 |
| LYM1240 | 0.79 | 1.91E−02 | 2 | 53 | LYM1240 | 0.77 | 2.51E−02 | 2 | 25 |

Provided are the correlations (R) between the expression levels yield improving genes and their homologs in various tissues [Expression (Exp) sets] and the phenotypic performance [yield, biomass, growth rate and/or vigor components (Correlation vector (Cor))] under normal conditions across tomato ecotypes. P = p value

Example 11

Production of Maize Transcriptome and High Throughput Correlation Analysis with Yield, NUE, and ABST Related Parameters Measured in Semi-Hydroponics Conditions Using 60K Maize Oligonucleotide Micro-Arrays Maize vigor related parameters under low nitrogen, 100 mM NaCl, low temperature (10±2° C.) and normal growth conditions—twelve Maize hybrids were grown in 5 repetitive plots, each containing 7 plants, at a net house under semi-hydroponics conditions. Briefly, the growing protocol was as follows: Maize seeds were sown in trays filled with a mix of vermiculite and peat in a 1:1 ratio. Following germination, the trays were transferred to the high salinity solution (100 mM NaCl in addition to the Full Hoagland solution), low temperature (10±2° C. in the presence of Full Hoagland solution), low nitrogen solution (the amount of total nitrogen was reduced in 90% from the full Hoagland solution (i.e., to a final concentration of 10% from full Hoagland solution, final amount of 1.6 mM N) or at Normal growth solution (Full Hoagland containing 16 mM N solution, at 28±2° C.). Plants were grown at 28±2° C.

Full Hoagland solution consists of: $KNO_3$—0.808 grams/liter, $MgSO_4$—0.12 grams/liter, $KH_2PO_4$—0.136 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

Analyzed maize tissues—Twelve selected maize hybrids were sampled per each treatment. Two tissues [leaves and root tip] growing at 100 mM NaCl, low temperature (10±2° C.), low Nitrogen (1.6 mM N) or under Normal conditions were sampled at the vegetative stage (V4-5) and RNA was extracted as described above. Each micro-array expression information tissue type has received a Set ID as summarized in Tables 54-57 below.

TABLE 54

Maize transcriptome expression sets under semi hydroponics conditions

| Expression set | Set ID |
|---|---|
| leaf at vegetative stage (V4-V5) under Normal conditions | 1 |
| root tip at vegetative stage (V4-V5) under Normal conditions | 2 |

Provided are the Maize transcriptome expression sets at normal conditions.

TABLE 55

Maize transcriptome expression sets under semi hydroponics conditions

| Expression set | Set ID |
|---|---|
| leaf at vegetative stage (V4-V5) under cold conditions | 1 |
| root tip at vegetative stage (V4-V5) under cold conditions | 2 |

Provided are the Maize transcriptome expression sets at cold conditions.

TABLE 56

Maize transcriptome expression sets under semi hydroponics conditions

| Expression set | Set ID |
|---|---|
| leaf at vegetative stage (V4-V5) under low N conditions (1.6 mM N) | 1 |
| root tip at vegetative stage (V4-V5) under low N conditions (1.6 mM N) | 2 |

Provided are the Maize transcriptome expression sets at low nitrogen conditions 1.6 Mm Nitrogen.

TABLE 57

Maize transcriptome expression sets under semi hydroponics conditions

| Expression set | Set ID |
|---|---|
| leaf at vegetative stage (V4-V5) under salinity conditions (NaCl 100 mM) | 1 |
| root tip at vegetative stage (V4-V5) under salinity conditions (NaCl 100 mM) | 2 |

Provided are the Maize transcriptome expression sets at 100 mM NaCl.

Experimental Results 12 different Maize hybrids were grown and characterized at the vegetative stage (V4-5) for the following parameters: "Leaves DW"=leaves dry weight per plant (average of five plants); "Plant Height growth"=was calculated as regression coefficient of plant height [cm] along time course (average of five plants); "Root DW" root dry weight per plant, all vegetative tissue above ground (average of four plants); "Shoot DW"—shoot dry weight per plant, all vegetative tissue above ground (average of four plants) after drying at 70° C. in oven for 48 hours; "Shoot FW"—shoot fresh weight per plant, all vegetative tissue above ground (average of four plants); "SPAD"—Chlorophyll content was determined using a Minolta SPAD 502 chlorophyll meter and measurement was performed 30 days post sowing. SPAD meter readings were done on young fully developed leaf. Three measurements per leaf were taken per plot. The average for each of the measured parameter was calculated and values are summarized in Tables 59-66 below. Subsequent correlation analysis was performed (Table 67-70). Results were then integrated to the database.

TABLE 58

Maize correlated parameters (vectors)

| Correlated parameter with | Correlation ID |
|---|---|
| Leaves DW (g) | 1 |
| Plant height growth (cm/day) | 2 |
| Root DW (g) | 3 |
| Root length (cm) | 4 |
| SPAD | 5 |
| Shoot DW (g) | 6 |
| Shoot FW (g) | 7 |

Provided are the Maize correlated parameters.

TABLE 59

Maize accessions, measured parameters under low nitrogen growth conditions

| Ecotype/Treatment | Line-1 | Line-2 | Line-3 | Line-4 | Line-5 | Line-6 |
|---|---|---|---|---|---|---|
| 1 | 0.57 | 0.45 | 0.46 | 0.48 | 0.36 | 0.51 |
| 2 | 0.75 | 0.81 | 0.88 | 0.69 | 0.83 | 0.84 |
| 3 | 0.38 | 0.35 | 0.25 | 0.36 | 0.31 | 0.30 |
| 4 | 44.50 | 45.63 | 44.25 | 43.59 | 40.67 | 42.03 |
| 5 | 21.43 | 21.24 | 22.23 | 24.56 | 22.75 | 26.47 |
| 6 | 2.56 | 1.96 | 2.01 | 1.94 | 1.94 | 2.52 |
| 7 | 23.27 | 20.58 | 19.26 | 20.02 | 17.98 | 22.06 |

Provided are the values of each of the parameters (as described above) measured in Maize accessions (Seed ID) under low nitrogen conditions. Growth conditions are specified in the experimental procedure section.

TABLE 60

Maize accessions, measured parameters under low nitrogen growth conditions

| Ecotype/Treatment | Line-7 | Line-8 | Line-9 | Line-10 | Line-11 | Line-12 |
|---|---|---|---|---|---|---|
| 1 | 0.53 | 0.58 | 0.55 | 0.51 | 0.56 | 0.39 |
| 2 | 0.78 | 0.92 | 0.89 | 0.85 | 0.80 | 0.64 |
| 3 | 0.29 | 0.31 | 0.29 | 0.32 | 0.43 | 0.17 |
| 4 | 42.65 | 45.06 | 45.31 | 42.17 | 41.03 | 37.65 |
| 5 | 22.08 | 25.09 | 23.73 | 25.68 | 25.02 | 19.51 |
| 6 | 2.03 | 2.37 | 2.09 | 2.17 | 2.62 | 1.53 |
| 7 | 21.28 | 22.13 | 20.29 | 19.94 | 22.50 | 15.93 |

Provided are the values of each of the parameters (as described above) measured in Maize accessions (Seed ID) under low nitrogen conditions. Growth conditions are specified in the experimental procedure section.

TABLE 61

Maize accessions, measured parameters under 100 mM NaCl growth conditions

| Ecotype/Treatment | Line-1 | Line-2 | Line-3 | Line-4 | Line-5 | Line-6 |
|---|---|---|---|---|---|---|
| 1 | 0.41 | 0.50 | 0.43 | 0.48 | 0.43 | 0.56 |
| 2 | 0.457 | 0.398 | 0.454 | 0.316 | 0.322 | 0.311 |
| 3 | 0.047 | 0.050 | 0.030 | 0.071 | 0.046 | 0.031 |
| 4 | 10.88 | 11.28 | 11.82 | 10.08 | 8.46 | 10.56 |
| 5 | 36.55 | 39.92 | 37.82 | 41.33 | 40.82 | 44.40 |
| 6 | 2.43 | 2.19 | 2.25 | 2.26 | 1.54 | 1.94 |
| 7 | 19.58 | 20.78 | 18.45 | 19.35 | 15.65 | 16.09 |

Provided are the values of each of the parameters (as described above) measured in Maize accessions (Seed ID) under 100 mM NaCl growth conditions. Growth conditions are specified in the experimental procedure section.

TABLE 62

Maize accessions, measured parameters under 100 mM NaCl growth conditions

| Ecotype/Treatment | Line-7 | Line-8 | Line-9 | Line-10 | Line-11 | Line-12 |
|---|---|---|---|---|---|---|
| 1 | 0.33 | 0.51 | 0.47 | 0.98 | 0.48 | 0.15 |
| 2 | 0.290 | 0.359 | 0.370 | 0.355 | 0.305 | 0.272 |
| 3 | 0.095 | 0.063 | 0.016 | 0.035 | 0.049 | 0.015 |
| 4 | 10.14 | 11.83 | 10.55 | 11.18 | 10.09 | 8.90 |
| 5 | 37.92 | 43.22 | 39.83 | 38.20 | 38.14 | 37.84 |
| 6 | 1.78 | 1.90 | 1.89 | 2.20 | 1.86 | 0.97 |
| 7 | 12.46 | 16.92 | 16.75 | 17.64 | 15.90 | 9.40 |

Provided are the values of each of the parameters (as described above) measured in Maize accessions (Seed ID) under 100 mM NaCl growth conditions. Growth conditions are specified in the experimental procedure section.

TABLE 63

Maize accessions, measured parameters under cold growth conditions

| Ecotype/Treatment | Line-1 | Line-2 | Line-3 | Line-4 | Line-5 | Line-6 |
|---|---|---|---|---|---|---|
| 1 | 1.19 | 1.17 | 1.02 | 1.18 | 1.04 | 1.23 |
| 2 | 2.15 | 1.93 | 2.12 | 1.80 | 2.32 | 2.15 |
| 3 | 0.047 | 0.068 | 0.100 | 0.081 | 0.066 | 0.067 |
| 4 | 28.88 | 29.11 | 27.08 | 32.38 | 32.68 | 32.89 |
| 5 | 5.74 | 4.86 | 3.98 | 4.22 | 4.63 | 4.93 |
| 6 | 73.79 | 55.46 | 53.26 | 54.92 | 58.95 | 62.36 |

Provided are the values of each of the parameters (as described above) measured in Maize accessions (Seed ID) under cold growth conditions. Growth conditions are specified in the experimental procedure section.

TABLE 64

Maize accessions, measured parameters under cold growth conditions

| Ecotype/Treatment | Line-7 | Line-8 | Line-9 | Line-10 | Line-11 | Line-12 |
|---|---|---|---|---|---|---|
| 1 | 1.13 | 0.98 | 0.88 | 1.28 | 1.10 | 0.60 |
| 2 | 2.49 | 2.01 | 1.95 | 2.03 | 1.85 | 1.21 |
| 3 | 0.137 | 0.067 | 0.073 | 0.020 | 0.052 | 0.057 |
| 4 | 31.58 | 33.01 | 28.65 | 31.43 | 30.64 | 30.71 |
| 5 | 4.82 | 4.03 | 3.57 | 3.99 | 4.64 | 1.89 |
| 6 | 63.65 | 54.90 | 48.25 | 52.83 | 55.08 | 29.61 |

Provided are the values of each of the parameters (as described above) measured in Maize accessions (Seed ID) under cold growth conditions. Growth conditions are specified in the experimental procedure section.

TABLE 65

Maize accessions, measured parameters under regular growth conditions

| Ecotype/Treatment | Line-1 | Line-2 | Line-3 | Line-4 | Line-5 | Line-6 |
|---|---|---|---|---|---|---|
| 1 | 1.161 | 1.099 | 0.924 | 1.013 | 0.935 | 0.907 |
| 2 | 1.994 | 1.919 | 1.927 | 1.934 | 2.152 | 1.948 |
| 3 | 0.140 | 0.106 | 0.227 | 0.155 | 0.077 | 0.049 |
| 4 | 20.15 | 15.89 | 18.59 | 18.72 | 16.38 | 14.93 |
| 5 | 34.50 | 35.77 | 34.70 | 34.42 | 35.26 | 37.52 |
| 6 | 5.27 | 4.67 | 3.88 | 5.08 | 4.10 | 4.46 |
| 7 | 79.00 | 62.85 | 59.73 | 63.92 | 60.06 | 64.67 |

Provided are the values of each of the parameters (as described above) measured in Maize accessions (Seed ID) under regular (non-stress) growth conditions. Growth conditions are specified in the experimental procedure section.

TABLE 66

Maize accessions, measured parameters under regular growth conditions

| Ecotype/Treatment | Line-7 | Line-8 | Line-9 | Line-10 | Line-11 | Line-12 |
|---|---|---|---|---|---|---|
| 1 | 1.105 | 1.006 | 1.011 | 1.02 | 1.23 | 0.44 |
| 2 | 2.234 | 1.937 | 1.965 | 2.05 | 1.74 | 1.26 |
| 3 | 0.175 | 0.101 | 0.069 | 0.10 | 0.14 | 0.03 |
| 4 | 17.48 | 15.74 | 15.71 | 17.58 | 16.13 | 17.43 |
| 5 | 36.50 | 36.07 | 33.74 | 34.34 | 35.74 | 29.04 |
| 6 | 4.68 | 4.59 | 4.08 | 4.61 | 5.42 | 2.02 |
| 7 | 68.10 | 65.81 | 58.31 | 61.87 | 70.04 | 35.96 |

Provided are the values of each of the parameters (as described above) measured in Maize accessions (Seed ID) under regular (non-stress) growth conditions. Growth conditions are specified in the experimental procedure section.

TABLE 67

Correlation between the expression level of selected genes of some embodiments of the invention in various tissues and the phenotypic performance under normal conditions across Maize accessions

| Gene Name | R | P value | Exp. set | Corr. Set ID | Gene Name | R | P value | Exp. set | Corr. Set ID |
|---|---|---|---|---|---|---|---|---|---|
| LYM1130 | 0.70 | 3.52E−02 | 2 | 6 | LYM1130 | 0.75 | 1.22E−02 | 1 | 2 |
| LYM1142 | 0.74 | 1.51E−02 | 1 | 4 | | | | | |
| LYM1151 | 0.75 | 1.88E−02 | 2 | 7 | LYM1151 | 0.83 | 5.31E−03 | 2 | 1 |
| LYM1151 | 0.75 | 1.94E−02 | 2 | 3 | LYM1151 | 0.84 | 5.03E−03 | 2 | 6 |
| LYM1156 | 0.70 | 2.38E−02 | 1 | 4 | LYM1163 | 0.71 | 2.10E−02 | 1 | 7 |
| LYM1167 | 0.79 | 1.06E−02 | 2 | 6 | LYM1167 | 0.74 | 1.50E−02 | 1 | 4 |
| LYM1171 | 0.73 | 1.65E−02 | 1 | 3 | LYM1171 | 0.71 | 2.18E−02 | 1 | 4 |
| LYM1176 | 0.79 | 6.96E−03 | 1 | 7 | LYM1176 | 0.76 | 1.06E−02 | 1 | 2 |

Provided are the correlations (R) between the expression levels of yield improving genes and their homologues in tissues [Leaves or roots; Expression sets (Exp)] and the phenotypic performance in various biomass, growth rate and/or vigor components [Correlation vector (corr.)] under normal conditions across Maize accessions. P = p value.

TABLE 68

Correlation between the expression level of selected genes of some embodiments of the invention in various tissues and the phenotypic performance under low nitrogen conditions across Maize accessions

| Gene Name | R | P value | Exp. set | Corr. Set ID | Gene Name | R | P value | Exp. set | Corr. Set ID |
|---|---|---|---|---|---|---|---|---|---|
| LYM1139 | 0.70 | 3.48E−02 | 2 | 5 | LYM1141 | 0.74 | 2.22E−02 | 2 | 4 |
| LYM1143 | 0.88 | 1.97E−03 | 2 | 7 | LYM1143 | 0.85 | 3.53E−03 | 2 | 1 |
| LYM1143 | 0.73 | 2.55E−02 | 2 | 6 | LYM1154 | 0.76 | 1.06E−02 | 1 | 3 |
| LYM1161 | 0.70 | 2.40E−02 | 1 | 4 | LYM1162 | 0.76 | 1.07E−02 | 1 | 5 |
| LYM1164 | 0.87 | 1.16E−03 | 1 | 4 | LYM1170 | 0.74 | 1.46E−02 | 1 | 5 |
| LYM1181 | 0.72 | 3.03E−02 | 2 | 7 | LYM1181 | 0.78 | 1.24E−02 | 2 | 1 |
| LYM1182 | 0.77 | 1.52E−02 | 2 | 5 | LYM1184 | 0.73 | 2.47E−02 | 2 | 3 |

Provided are the correlations (R) between the expression levels of yield improving genes and their homologues in tissues [Leaves or roots; Expression sets (Exp)] and the phenotypic performance in various biomass, growth rate and/or vigor components [Correlation vector (corr.)] under low nitrogen conditions across Maize accessions. P = p value.

TABLE 69

Correlation between the expression level of selected genes of some embodiments of the invention in various tissues and the phenotypic performance under cold conditions across Maize accessions

| Gene Name | R | P value | Exp. set | Corr. Set ID | Gene Name | R | P value | Exp. set | Corr. Set ID |
|---|---|---|---|---|---|---|---|---|---|
| LYM1129 | 0.71 | 4.91E−02 | 1 | 3 | LYM1130 | 0.87 | 5.50E−03 | 1 | 7 |
| LYM1130 | 0.88 | 3.86E−03 | 1 | 2 | LYM1130 | 0.83 | 1.03E−02 | 1 | 6 |
| LYM1130 | 0.85 | 3.45E−03 | 2 | 1 | LYM1130 | 0.71 | 3.16E−02 | 2 | 6 |
| LYM1137 | 0.81 | 1.54E−02 | 1 | 5 | LYM1139 | 0.75 | 3.30E−02 | 1 | 7 |
| LYM1139 | 0.80 | 1.82E−02 | 1 | 2 | LYM1139 | 0.71 | 4.70E−02 | 1 | 5 |
| LYM1142 | 0.74 | 3.52E−02 | 1 | 2 | LYM1146 | 0.73 | 3.92E−02 | 1 | 7 |
| LYM1149 | 0.70 | 5.13E−02 | 1 | 7 | LYM1149 | 0.80 | 1.81E−02 | 1 | 2 |
| LYM1154 | 0.72 | 2.83E−02 | 2 | 2 | LYM1158 | 0.81 | 1.54E−02 | 1 | 7 |
| LYM1158 | 0.87 | 4.48E−03 | 1 | 1 | LYM1158 | 0.76 | 2.96E−02 | 1 | 6 |
| LYM1159 | 0.73 | 3.89E−02 | 1 | 7 | LYM1159 | 0.87 | 4.89E−03 | 1 | 2 |
| LYM1159 | 0.75 | 3.19E−02 | 1 | 3 | LYM1162 | 0.76 | 2.95E−02 | 1 | 3 |
| LYM1164 | 0.71 | 5.07E−02 | 1 | 3 | LYM1167 | 0.71 | 5.06E−02 | 1 | 7 |
| LYM1169 | 0.70 | 3.47E−02 | 2 | 5 | LYM1170 | 0.85 | 3.57E−03 | 2 | 3 |
| LYM1176 | 0.74 | 3.75E−02 | 1 | 7 | LYM1176 | 0.81 | 1.49E−02 | 1 | 2 |
| LYM1177 | 0.74 | 3.65E−02 | 1 | 2 | LYM1185 | 0.73 | 4.05E−02 | 1 | 5 |
| LYM1185 | 0.70 | 3.56E−02 | 2 | 6 | LYM1186 | 0.74 | 3.76E−02 | 1 | 1 |
| LYM1187 | 0.75 | 3.11E−02 | 1 | 3 | | | | | |

Provided are the correlations (R) between the expression levels of yield improving genes and their homologues in tissues [Leaves or roots; Expression sets (Exp)] and the phenotypic performance in various biomass, growth rate and/or vigor components [Correlation vector (corr.)] under cold conditions (10 ± 2° C.) across Maize accessions. P = p value.

TABLE 70

Correlation between the expression level of selected genes of some embodiments of the invention in various tissues and the phenotypic performance under salinity conditions across Maize accessions

| Gene Name | R | P value | Exp. set | Corr. Set ID | Gene Name | R | P value | Exp. set | Corr. Set ID |
|---|---|---|---|---|---|---|---|---|---|
| LYM1129 | 0.71 | 3.17E−02 | 2 | 7 | LYM1134 | 0.78 | 1.28E−02 | 2 | 2 |
| LYM1135 | 0.83 | 2.75E−03 | 1 | 2 | LYM1139 | 0.77 | 1.49E−02 | 2 | 7 |
| LYM1140 | 0.78 | 1.36E−02 | 2 | 3 | LYM1141 | 0.74 | 2.13E−02 | 2 | 7 |
| LYM1142 | 0.73 | 2.49E−02 | 2 | 2 | LYM1142 | 0.79 | 6.50E−03 | 1 | 7 |
| LYM1142 | 0.78 | 7.64E−03 | 1 | 2 | LYM1142 | 0.72 | 1.89E−02 | 1 | 6 |
| LYM1152 | 0.76 | 1.70E−02 | 2 | 1 | LYM1146 | 0.77 | 1.52E−02 | 2 | 5 |
| LYM1154 | 0.87 | 2.26E−03 | 2 | 5 | LYM1154 | 0.83 | 5.84E−03 | 2 | 1 |
| LYM1154 | 0.78 | 7.90E−03 | 1 | 5 | LYM1158 | 0.86 | 3.11E−03 | 2 | 7 |
| LYM1162 | 0.80 | 5.37E−03 | 1 | 2 | LYM1162 | 0.86 | 1.37E−02 | 1 | 5 |
| LYM1163 | 0.71 | 3.26E−02 | 2 | 4 | LYM1169 | 0.87 | 2.11E−03 | 2 | 7 |
| LYM1169 | 0.82 | 6.71E−03 | 2 | 1 | LYM1169 | 0.92 | 5.16E−04 | 2 | 6 |
| LYM1169 | 0.85 | 1.82E−03 | 1 | 2 | LYM1170 | 0.80 | 9.90E−03 | 2 | 5 |
| LYM1177 | 0.72 | 1.83E−02 | 1 | 2 | LYM1184 | 0.76 | 1.07E−02 | 1 | 3 |
| LYM1186 | 0.75 | 1.89E−02 | 2 | 3 | LYM1187 | 0.86 | 1.56E−03 | 1 | 3 |

Provided are the correlations (R) between the expression levels of yield improving genes and their homologues in tissues [Leaves or roots; Expression sets (Exp)] and the phenotypic performance in various biomass, growth rate and/or vigor components [Correlation vector (corr.)] under salinity conditions (100 mM NaCl) across Maize accessions. P = p value.

Example 12

Production of Sorghum Transcriptome and High Throughput Correlation Analysis Using 60K Sorghum Oligonucleotide Micro-Array In order to produce a high throughput correlation analysis between plant phenotype and gene expression level, the present inventors utilized a sorghum oligonucleotide microarray, produced by Agilent Technologies [chem.(dot)agilent (dot)com/Scripts/PDS(dot)asp?1Page=50879]. The array oligonucleotide represents about 60,000 sorghum genes and transcripts. In order to define correlations between the levels of RNA expression with vigor related parameters, various plant characteristics of 10 different sorghum hybrids were analyzed. The correlation between the RNA levels and the characterized parameters was analyzed using Pearson correlation test [davidmlane(dot)com/hyperstat/A34739(dot) html].

Experimental Procedures

Correlation of Sorghum varieties across ecotypes grown in growth chambers under temperature of 30° C. or 14° C. at low light (100 μE) and high light (250 μE) conditions.

Analyzed Sorghum tissues—All 10 selected Sorghum hybrids were sample per each condition. Leaf tissue growing under 30° C. and low light (100 μE $m^{-2}$ $sec^{-1}$), 14° C. and low light (100 μE $m^{-2}$ $sec^{-1}$), 30° C. and high light (250 μE $m^{-2}$ $sec^{-1}$), 14° C. and high light (250 μE $m^{-2}$ $sec^{-1}$) were sampled at vegetative stage of four-five leaves and RNA was extracted as described above. Each micro-array expression information tissue type has received a Set ID as summarized in Table 71 below.

TABLE 71

Sorghum transcriptome expression sets in field experiments

| | |
|---|---|
| Sorghum/leaf; 14 Celsius degree; high light; light on | 1 |
| Sorghum/leaf; 14 Celsius degree; low light; light on | 2 |
| Sorghum/leaf; 30 Celsius degree; high light; light on | 3 |
| Sorghum/leaf; 30 Celsius degree; low light; light on | 4 |

Provided are the sorghum transcriptome expression sets.

The following parameters were collected by sampling 8-10 plants per plot or by measuring the parameter across all the plants within the plot.

Relative Growth Rate of vegetative dry weight was performed using Formula VII.

Leaves number—Plants were characterized for leaf number during growing period. In each measure, plants were measured for their leaf number by counting all the leaves of selected plants per plot.

Shoot FW—shoot fresh weight per plant, measurement of all vegetative tissue above ground.

Shoot DW—shoot dry weight per plant, measurement of all vegetative tissue above ground after drying at 70° C. in oven for 48 hours.

The average for each of the measured parameter was calculated and values are summarized in Tables 73-76 below. Subsequent correlation analysis was performed (Table 77). Results were then integrated to the database.

TABLE 72

Sorghum correlated parameters (vectors)

| Correlated parameter with | Correlation ID |
|---|---|
| Leaves number | 1 |
| RGR | 2 |
| Shoot DW | 3 |
| Shoot FW | 4 |

Provided are the Sorghum correlated parameters (vectors).

TABLE 73

Measured parameters in *Sorghum* accessions under 14° C. and low light (100 µE m$^{-2}$ sec$^{-1}$)

| Ecotype/Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 3 | 3 | 2.75 | 2.75 | 2.63 | 3 | 3.5 | 2.75 | 2.43 | 2 |
| 2 | 0.032 | −0.01 | −0.022 | 0.024 | −0.04 | −0.05 | 0.08 | NA | −0.1 | −0.07 |
| 3 | 0.041 | 0.013 | 0.013 | 0.009 | 0.011 | 0.01 | 0.03 | 0.01 | 0.01 | 0.01 |
| 4 | 0.55 | 0.3 | 0.33 | 0.28 | 0.36 | 0.36 | 0.58 | 0.22 | 0.18 | 0.3 |

Provided are the values of each of the parameters (as described above) measured in *Sorghum* accessions (Seed ID) under 14° C. and low light (100 µE m$^{-2}$ sec$^{-1}$).

TABLE 74

Measured parameters in *Sorghum* accessions under 30° C. and low light (100 µE m$^{-2}$ sec$^{-1}$)

| Ecotype/Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 5.27 | 5 | 4.75 | 4 | 4 | 4 | 5.25 | 4.5 | 3.75 | 4 |
| 2 | 0.099 | 0.098 | 0.09 | 0.122 | 0.108 | 0.08 | 0.11 | 0.12 | 0.04 | 0.04 |
| 3 | 0.114 | 0.079 | 0.071 | 0.056 | 0.093 | 0.08 | 0.04 | 0.06 | 0.04 | 0.05 |
| 4 | 1.35 | 1.05 | 0.88 | 0.95 | 1.29 | 1.13 | 0.71 | 0.79 | 0.67 | 0.82 |

Provided are the values of each of the parameters (as described above) measured in *Sorghum* accessions (Seed ID) under 30° C. and low light (100 µE m$^{-2}$ sec$^{-1}$).

TABLE 75

Measured parameters in *Sorghum* accessions under 30° C. and high light (250 µE m$^{-2}$ sec$^{-1}$)

| Ecotype/Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 4 | 3.7 | 3.5 | 3.33 | 4 | 4 | 3.6 | 3.4 | 3.3 | 3.4 |
| 2 | 0.098 | 0.096 | 0.087 | 0.07 | 0.094 | 0.12 | 0.1 | 0.1 | 0.11 | 0.12 |
| 3 | 0.076 | 0.05 | 0.047 | 0.036 | 0.065 | 0.09 | 0.05 | 0.04 | 0.04 | 0.06 |
| 4 | 0.77 | 0.52 | 0.49 | 0.38 | 0.71 | 0.86 | 0.49 | 0.45 | 0.44 | 0.67 |

Provided are the values of each of the parameters (as described above) measured in *Sorghum* accessions (Seed ID) under 30° C. and high light (250 µE m$^{-2}$ sec$^{-1}$).

TABLE 76

Measured parameters in Sorghum accessions under 14° C. and high light (250 µE m$^{-2}$ sec$^{-1}$)

| Ecotype/ Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 2 | 0.053 | 0.052 | 0.034 | 0.04 | 0.056 | 0.06 | 0.05 | 0.06 | 0.07 | 0.06 |
| 3 | 0.037 | 0.026 | 0.021 | 0.023 | 0.037 | 0.04 | 0.02 | 0.02 | 0.02 | 0.03 |
| 4 | 0.37 | 0.25 | 0.22 | 0.25 | 0.43 | 0.37 | 0.24 | 0.23 | 0.24 | 0.27 |

Provided are the values of each of the parameters (as described above) measured in Sorghum accessions (Seed ID) under 14° C. and high light (250 µE m$^{-2}$ sec$^{-1}$).

TABLE 77

Correlation between the expression level of selected genes of some embodiments of the invention in various tissues and the phenotypic performance

| Gene Name | R | P value | Exp. set | Corr. Set ID | Gene Name | R | P value | Exp. set | Corr. Set ID |
|---|---|---|---|---|---|---|---|---|---|
| LYM1196 | 0.75 | 1.18E−02 | 2 | 4 | LYM1196 | 0.73 | 2.61E−02 | 2 | 2 |
| LYM1201 | 0.72 | 1.07E−01 | 3 | 4 | LYM1201 | 0.71 | 1.15E−01 | 3 | 2 |
| LYM1201 | 0.77 | 7.53E−02 | 3 | 3 | LYM1202 | 0.81 | 4.91E−02 | 3 | 4 |
| LYM1202 | 0.86 | 2.88E−02 | 3 | 3 | LYM1202 | 0.80 | 5.87E−02 | 3 | 1 |
| LYM1204 | 0.73 | 9.87E−02 | 3 | 4 | LYM1204 | 0.79 | 6.19E−02 | 3 | 3 |
| LYM1206 | 0.82 | 4.06E−03 | 2 | 4 | LYM1206 | 0.72 | 2.90E−02 | 2 | 2 |
| LYM1206 | 0.94 | 5.61E−05 | 2 | 3 | LYM1208 | 0.74 | 9.37E−02 | 3 | 4 |
| LYM1208 | 0.81 | 5.20E−02 | 3 | 3 | LYM1210 | 0.75 | 8.30E−02 | 3 | 3 |
| LYM1239 | 0.77 | 8.50E−03 | 4 | 4 | LYM1239 | 0.77 | 9.81E−03 | 4 | 3 |

Provided are the correlations (R) between the expression levels of yield improving genes and their homologues in tissues [Leaves or roots; Expression sets (Exp)] and the phenotypic performance in various biomass, growth rate and/or vigor components [Correlation vector (corr.)] under 14° C. and low light (100 µE m$^{-2}$ sec$^{-1}$) conditions across sorghum accessions. P = p value.

Example 13

Production of Maize Transcriptome and High Throughput Correlation Analysis when Grown Under Normal and Defoliation Using 60K Maize Oligonucleotide Micro-Array To produce a high throughput correlation analysis, the present inventors utilized a Maize oligonucleotide micro-array, produced by Agilent Technologies [chem. (dot) agilent(dot)com/Scripts/PDS(dot)asp?1Page=50879]. The array oligonucleotide represents about 60K Maize genes and transcripts designed based on data from Public databases (Example 1). To define correlations between the levels of RNA expression and yield, biomass components or vigor related parameters, various plant characteristics of 13 different Maize hybrids were analyzed under normal and defoliation conditions. Same hybrids were subjected to RNA expression analysis. The correlation between the RNA levels and the characterized parameters was analyzed using Pearson correlation test [davidmlane(dot)com/hyperstat/A34739 (dot)html].

Experimental Procedures 13 maize hybrids lines were grown in 6 repetitive plots, in field. Maize seeds were planted and plants were grown in the field using commercial fertilization and irrigation protocols. After silking 3 plots in every hybrid line underwent the defoliation treatment. In this defoliation treatment all the leaves above the ear were removed. After the treatment all the plants were grown according to the same commercial fertilization and irrigation protocols.

Three tissues at flowering (R1) and grain filling (R3) developmental stage including leaf (flowering -R1), stem (flowering -R1 and grain filling -R3), and flowering meristem (flowering -R1) representing different plant characteristics, were sampled from treated and untreated plants. RNA was extracted as described in "GENERAL EXPERIMENTAL AND BIOINFORMATICS METHODS". For convenience, each micro-array expression information tissue type has received a Set ID as summarized in Tables 78-79 below.

TABLE 78

Tissues used for Maize transcriptome expression sets (Under normal conditions)

| Expression Set | Set ID |
|---|---|
| Female meristem at flowering stage under normal conditions | 1 |
| leaf at flowering stage under normal conditions | 2 |
| stem at flowering stage under normal conditions | 3 |
| stem at grain filling stage under normal conditions | 4 |

Provided are the identification (ID) number of each of the Maize expression sets.

TABLE 79

Tissues used for Maize transcriptome expression sets (Under defoliation treatment)

| Expression Set | Set ID |
|---|---|
| Female meristem at flowering stage under defoliation treatment | 1 |
| leaf at flowering stage under defoliation treatment | 2 |
| stem at flowering stage under defoliation treatment | 3 |
| stem at grain filling stage under defoliation treatment | 4 |

Provided are the identification (ID) number of each of the Maize expression sets.

The following parameters were collected by imaging.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb(dot)nih(dot)gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

1000 grain weight—At the end of the experiment all seeds from all plots were collected and weighed and the weight of 1000 was calculated.

Ear Area ($cm^2$)—At the end of the growing period 5 ears were, photographed and images were processed using the below described image processing system. The Ear area was measured from those images and was divided by the number of ears.

Ear Length and Ear Width (cm)—At the end of the growing period 6 ears were, photographed and images were processed using the below described image processing system. The Ear length and width (longest axis) was measured from those images and was divided by the number of ears.

Grain Area ($cm^2$)—At the end of the growing period the grains were separated from the ear. A sample of ~200 grains were weight, photographed and images were processed using the below described image processing system. The grain area was measured from those images and was divided by the number of grains.

Grain Length and Grain width (cm)—At the end of the growing period the grains were separated from the ear. A sample of ~200 grains were weighted, photographed and images were processed using the below described image processing system. The sum of grain lengths/or width (longest axis) was measured from those images and was divided by the number of grains.

Grain Perimeter (cm)—At the end of the growing period the grains were separated from the ear. A sample of ~200 grains were weight, photographed and images were processed using the below described image processing system. The sum of grain perimeter was measured from those images and was divided by the number of grains.

Ear filled grain area ($cm^2$)—At the end of the growing period 5 ears were photographed and images were processed using the below described image processing system. The Ear area filled with kernels was measured from those images and was divided by the number of Ears.

Filled per Whole Ear—was calculated as the length of the ear with grains out of the total ear.

Additional parameters were collected either by sampling 6 plants per plot or by measuring the parameter across all the plants within the plot.

Cob width [cm]—The diameter of the cob without grains was measured using a ruler.

Ear average weight [kg]—At the end of the experiment (when ears were harvested) total and 6 selected ears per plots were collected. The ears were weighted and the average ear per plant was calculated. The ear weight was normalized using the relative humidity to be 0%.

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located.

Ear row number—The number of rows per ear was counted.

Ear fresh weight per plant (GF)—During the grain filling period (GF) and total and 6 selected ears per plot were collected separately. The ears were weighted and the average ear weight per plant was calculated.

Ears dry weight—At the end of the experiment (when ears were harvested) total and 6 selected ears per plots were collected and weighted. The ear weight was normalized using the relative humidity to be 0%.

Ears fresh weight—At the end of the experiment (when ears were harvested) total and 6 selected ears per plots were collected and weighted.

Ears per plant-number of ears per plant were counted.

Grains weight (Kg.)—At the end of the experiment all ears were collected. Ears from 6 plants from each plot were separately threshed and grains were weighted.

Grains dry weight (Kg.)—At the end of the experiment all ears were collected. Ears from 6 plants from each plot were separately threshed and grains were weighted. The grain weight was normalized using the relative humidity to be 0%.

Grain weight per ear (Kg.)—At the end of the experiment all ears were collected. 5 ears from each plot were separately threshed and grains were weighted.

The average grain weight per ear was calculated by dividing the total grain weight by the number of ears.

Leaves area per plant (GF) and (HD) [LAI]=Total leaf area of 6 plants in a plot. This parameter was measured at two time points during the course of the experiment; at heading (HD) and during the grain filling period (GF). Measurement was performed using a Leaf area-meter at two time points in the course of the experiment; during the grain filling period and at the heading stage (VT).

Leaves fresh weight (GF) and (HD)—This parameter was measured at two time points during the course of the experiment; at heading (HD) and during the grain filling period (GF). Leaves used for measurement of the LAI were weighted.

Lower stem fresh weight (GF) (HD) and (H)—This parameter was measured at three time points during the course of the experiment: at heading (HD), during the grain filling period (GF) and at harvest (H). Lower internodes from at least 4 plants per plot were separated from the plant and weighted. The average internode weight per plant was calculated by dividing the total grain weight by the number of plants.

Lower stem length (GF) (HD) and (H)—This parameter was measured at three time points during the course of the experiment; at heading (HD), during the grain filling period (GF) and at harvest (H). Lower internodes from at least 4 plants per plot were separated from the plant and their length was measured using a ruler. The average internode length per plant was calculated by dividing the total grain weight by the number of plants.

Lower stem width (GF) (HD) and (H)—This parameter was measured at three time points during the course of the experiment: at heading (HD), during the grain filling period (GF) and at harvest (H). Lower internodes from at least 4 plants per plot were separated from the plant and their diameter was measured using a caliber. The average internode width per plant was calculated by dividing the total grain weight by the number of plants.

Plant height growth: the RGR of Plant Height was performed using Formula III above.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS).

Stem fresh weight (GF) and (HD)—This parameter was measured at two time points during the course of the experiment: at heading (HD) and during the grain filling period (GF). Stems of the plants used for measurement of the LAI were weighted.

Total dry matter—Total dry matter was performed using Formula LXIII above.

Upper stem fresh weight (GF) (HD) and (H)—This parameter was measured at three time points during the course of the experiment; at heading (HD), during the grain filling period (GF) and at harvest (H). Upper internodes from at least 4 plants per plot were separated from the plant and weighted. The average internode weight per plant was calculated by dividing the total grain weight by the number of plants.

Upper stem length (GF) (HD) and (H)—This parameter was measured at three time points during the course of the experiment; at heading (HD), during the grain filling period (GF) and at harvest (H). Upper internodes from at least 4 plants per plot were separated from the plant and their length was measured using a ruler. The average internode length per plant was calculated by dividing the total grain weight by the number of plants.

Upper stem width (GF) (HD) and (H) (mm)—This parameter was measured at three time points during the course of the experiment; at heading (HD), during the grain filling period (GF) and at harvest (H). Upper internodes from at least 4 plants per plot were separated from the plant and their diameter was measured using a caliber. The average internode width per plant was calculated by dividing the total grain weight by the number of plants.

Vegetative dry weight (Kg.)—total weight of the vegetative portion of 6 plants (above ground excluding roots) after drying at 70° C. in oven for 48 hours weight by the number of plants.

Vegetative fresh weight (Kg.)—total weight of the vegetative portion of 6 plants (above ground excluding roots).

Node number—nodes on the stem were counted at the heading stage of plant development.

TABLE 80

Maize correlated parameters (vectors) under normal conditions and under defoliation

| Normal conditions | | Defoliation | |
| --- | --- | --- | --- |
| Correlated parameter with | Correlation ID | Correlated parameter with | Correlation ID |
| 1000 grain weight [g] | 1 | 1000 grain weight | 1 |
| Cob width [mm] | 2 | Cob width | 2 |
| Ear Area [cm$^2$] | 3 | Ear Area (cm$^2$) | 3 |
| Ear filled grain area [cm$^2$] | 4 | Ear filled grain area [cm$^2$] | 4 |
| Ear Width [cm] | 5 | Ear Width [cm] | 5 |
| Ear average weight [g] | 6 | Ear average weight [g] | 6 |
| Ear height [cm] | 7 | Ear height [cm] | 7 |
| Ear length [cm] | 8 | Ear length [cm] | 8 |
| Ear row num | 9 | Ear row num | 9 |
| Ears dry weight [kg] | 11 | Ears dry weight [kg] | 10 |
| Ears fresh weight [kg] | 12 | Ears fresh weight [kg] | 11 |
| Ear fresh weight per plant (GF) [g/plant] | 10 | Ears per plant [number] | 12 |
| Ears per plant [number] | 13 | Filled per Whole Ear | 13 |
| Grain length [cm] | 16 | Grain Perimeter | 14 |
| Grain Perimeter [cm] | 15 | Grain length [cm] | 15 |
| Grain width [cm] | 17 | Grains dry weight | 16 |
| Grains dry weight [kg] | 18 | Grains weight [kg] | 17 |
| Grains weight [kg] | 19 | Grain weight per ear [kg] | 18 |
| Leaves area per plant (GF) [cm$^2$] | 23 | Leaves area per plant (hd) [cm$^2$] | 20 |
| Leaves area per plant (HD) [cm$^2$] | 24 | Lower stem fresh weight (H) [g] | 21 |
| Grain weight per ear [kg] | 20 | Lower stem fresh weight (HD) [g] | 22 |
| Leaves fresh weight (GF) [g] | 21 | Leaves fresh weight (HD) [g] | 23 |
| Leaves fresh weight (HD) [g] | 22 | Lower stem length (H) [cm] | 23 |
| Leaves temperature (GF) | 25 | Lower stem length (HD) [cm] | 24 |
| Lower stem fresh weight (GF) [g] | 26 | Lower stem width (H) [mm] | 25 |
| Lower stem fresh weight (H) [g] | 27 | Lower stem width (HD) [mm] | 26 |
| Lower stem fresh weight (HD) [g] | 28 | Node number | 27 |
| Lower stem length (GF) [cm] | 29 | Plant height [cm] | 28 |
| Lower stem length (H) [cm] | 30 | Plant height growth [cm/day] | 29 |
| Lower stem length (HD) [cm] | 31 | SPAD (GF) [value] | 30 |
| Lower stem width (GF) [mm] | 32 | Stem fresh weight (HD) [g] | 31 |
| Lower stem width (H) [mm] | 33 | Total dry matter [kg] | 32 |
| Lower stem width (HD) [mm] | 34 | Upper stem fresh weight (H) [g] | 33 |
| Node number | 35 | Upper stem length (H) [cm] | 34 |
| Plant height [cm] | 36 | Upper stem width (H) [mm] | 35 |
| Plant height growth [cm/day] | 37 | Vegetative dry weight [kg] | 36 |
| Filled per Whole Ear [value] | 14 | Vegetative fresh weight [kg] | 37 |
| SPAD (GF) [value] | 38 | Grain area [cm2] | 38 |
| Stem fresh weight (GF) [g] | 39 | | |
| Stem fresh weight (HD) [g] | 40 | | |
| Total dry matter [kg] | 41 | | |

TABLE 80-continued

Maize correlated parameters (vectors) under normal conditions and under defoliation

| Normal conditions | | Defoliation | |
|---|---|---|---|
| Correlated parameter with | Correlation ID | Correlated parameter with | Correlation ID |
| Upper stem fresh weight (GF) [g] | 42 | | |
| Upper stem fresh weight (H) [g] | 43 | | |
| Upper stem length (GF) [cm] | 44 | | |
| Upper stem length (H) [cm] | 45 | | |
| Upper stem width (GF) [mm] | 46 | | |
| Upper stem width (H) [mm] | 47 | | |
| Vegetative dry weight [kg] | 48 | | |
| Vegetative fresh weight [kg] | 49 | | |
| Grain area [$cm^2$] | 50 | | |

Thirteen maize varieties were grown, and characterized for parameters, as described above. The average for each parameter was calculated using the JMP software, and values are summarized in Tables 81-84 below. Subsequent correlation between the various transcriptome sets for all or sub set of lines was done by the bioinformatic unit and results were integrated into the database (Tables 85 and 86 below).

TABLE 81

Measured parameters in Maize Hybrid under normal conditions

| Ecotype/Treatment | Line-1 | Line-2 | Line-3 | Line-4 | Line-5 | Line-6 |
|---|---|---|---|---|---|---|
| 1 | 296.50 | 263.25 | 303.61 | 304.70 | 281.18 | 330.45 |
| 2 | 24.63 | 25.11 | 23.21 | 23.69 | 22.81 | 22.40 |
| 3 | 82.30 | 74.63 | 77.00 | 90.15 | 83.80 | 96.63 |
| 4 | 80.89 | 72.42 | 73.43 | 85.96 | 80.64 | 95.03 |
| 5 | 4.66 | 4.79 | 4.96 | 5.00 | 4.65 | 4.80 |
| 6 | 209.50 | 164.63 | 177.44 | 218.53 | 205.58 | 135.77 |
| 7 | 121.67 | 134.24 | 149.64 | 152.14 | 143.83 | 133.65 |
| 8 | 22.09 | 19.62 | 20.02 | 23.21 | 22.63 | 23.74 |
| 9 | 13.00 | 14.94 | 14.56 | 14.56 | 13.56 | 13.06 |
| 10 | 351.26 | 323.08 | 307.87 | 330.60 | 320.51 | 434.60 |
| 11 | 1.26 | 1.09 | 1.06 | 1.31 | 1.23 | 1.35 |
| 12 | 1.69 | 1.46 | 1.41 | 1.70 | 1.52 | 1.74 |
| 13 | 1.000 | 1.111 | 1.000 | 1.000 | 1.000 | 1.056 |
| 14 | 0.98 | 0.97 | 0.95 | 0.95 | 0.95 | 0.94 |
| 15 | 3.30 | 3.23 | 3.28 | 3.34 | 3.18 | 3.38 |
| 16 | 1.125 | 1.123 | 1.133 | 1.170 | 1.081 | 1.159 |
| 17 | 0.808 | 0.753 | 0.789 | 0.782 | 0.787 | 0.823 |
| 18 | 0.907 | 0.800 | 0.766 | 0.923 | 0.833 | 0.986 |
| 19 | 1.04 | 0.91 | 0.87 | 1.06 | 0.95 | 1.12 |
| 20 | 0.15 | 0.13 | 0.13 | 0.15 | 0.14 | 0.16 |
| 21 | 230.13 | 197.64 | 201.03 | 205.53 | 224.81 | 204.49 |
| 22 | 110.97 | 80.57 | 157.21 | 128.83 | 100.57 | 111.80 |
| 23 | 7034.60 | 6402.80 | 6353.07 | 6443.92 | 6835.50 | 6507.33 |
| 24 | 4341.25 | 3171.00 | 4205.50 | 4347.50 | 3527.00 | 4517.33 |
| 25 | 33.11 | 33.52 | 33.87 | 34.18 | 33.78 | 32.85 |
| 26 | 35.40 | 25.03 | 26.51 | 21.74 | 26.13 | 34.44 |
| 27 | 23.52 | 20.34 | 25.08 | 14.18 | 17.53 | 25.74 |
| 28 | 72.99 | 59.90 | 74.72 | 90.48 | 69.52 | 66.91 |
| 29 | 19.35 | 20.40 | 20.93 | 21.38 | 20.03 | 20.31 |
| 30 | 16.76 | 20.02 | 22.59 | 21.68 | 22.34 | 21.39 |
| 31 | 14.50 | 17.75 | 20.00 | 19.35 | 20.33 | 20.75 |
| 32 | 19.86 | 16.84 | 16.14 | 16.37 | 17.01 | 17.53 |
| 33 | 19.42 | 17.19 | 16.09 | 16.92 | 17.52 | 17.88 |
| 34 | 24.14 | 20.53 | 20.97 | 24.43 | 21.70 | 19.49 |
| 35 | 15.22 | 14.56 | 14.61 | 14.83 | 15.00 | 13.83 |
| 36 | 265.11 | 255.94 | 271.11 | 283.89 | 279.72 | 268.78 |
| 37 | 5.43 | 5.59 | 6.15 | 5.99 | 6.37 | 6.47 |
| 38 | 59.77 | 53.17 | 53.21 | 54.95 | 53.99 | 55.24 |
| 39 | 649.03 | 489.32 | 524.06 | 512.66 | 542.16 | 627.76 |
| 40 | 758.61 | 587.88 | 801.32 | 794.80 | 721.87 | 708.38 |
| 41 | 2.57 | 2.06 | 2.32 | 2.44 | 2.36 | 2.57 |
| 42 | 19.61 | 15.54 | 17.82 | 10.79 | 14.41 | 20.31 |
| 43 | 12.94 | 11.21 | 12.98 | 6.50 | 7.99 | 12.08 |
| 44 | 16.63 | 18.75 | 18.38 | 17.92 | 17.60 | 18.79 |
| 45 | 16.93 | 18.76 | 18.72 | 20.01 | 19.40 | 19.65 |
| 46 | 16.00 | 14.11 | 13.50 | 11.89 | 13.08 | 14.34 |
| 47 | 14.93 | 13.00 | 12.44 | 12.04 | 12.89 | 13.28 |

TABLE 81-continued

Measured parameters in Maize Hybrid under normal conditions

| Ecotype/Treatment | Line-1 | Line-2 | Line-3 | Line-4 | Line-5 | Line-6 |
|---|---|---|---|---|---|---|
| 48 | 1.31 | 0.97 | 1.25 | 1.13 | 1.13 | 1.21 |
| 49 | 3.16 | 2.25 | 2.61 | 2.60 | 2.42 | 2.64 |
| 50 | 0.72 | 0.67 | 0.71 | 0.72 | 0.67 | 0.75 |

TABLE 82

Measured parameters in Maize Hybrid under normal conditions, additional maize lines

| Ecotype/Treatment | Line-7 | Line-8 | Line-9 | Line-10 | Line-11 | Line-12 | Line-13 |
|---|---|---|---|---|---|---|---|
| 1 | 290.88 | 250.26 | 306.20 | 253.19 | 277.03 | 269.53 | 274.81 |
| 2 | 23.18 | 24.88 | 26.47 | 23.09 | 22.69 | 23.55 | 26.31 |
| 3 | 78.36 | 93.91 | 96.77 | 85.44 | 76.77 | NA | 97.99 |
| 4 | 74.41 | 92.31 | 95.43 | 83.28 | 74.35 | NA | 96.88 |
| 5 | 4.79 | 5.18 | 5.00 | 4.95 | 4.79 | NA | 5.43 |
| 6 | 147.49 | 207.11 | 228.44 | 215.92 | 198.69 | 188.50 | 254.42 |
| 7 | 118.39 | 145.24 | 133.78 | 143.71 | 134.17 | 143.00 | 147.78 |
| 8 | 20.31 | 22.60 | 23.84 | 21.74 | 20.04 | NA | 22.41 |
| 9 | 16.12 | 15.89 | 14.00 | 15.44 | 14.89 | 14.94 | 16.78 |
| 10 | 325.08 | 327.15 | 363.70 | 405.72 | 338.24 | 345.32 | 369.69 |
| 11 | 1.16 | 1.29 | 1.37 | 1.30 | 1.19 | 1.13 | 1.53 |
| 12 | 1.80 | 1.60 | 1.74 | 1.68 | 1.56 | 1.42 | 1.89 |
| 13 | 1.000 | 1.056 | 1.000 | 1.000 | 1.000 | 1.000 | 1.000 |
| 14 | 0.93 | 0.98 | 0.99 | 0.97 | 0.97 | NA | 0.99 |
| 15 | 3.25 | 3.18 | 3.29 | 3.27 | 3.22 | 3.15 | 3.38 |
| 16 | 1.142 | 1.118 | 1.151 | 1.163 | 1.124 | 1.090 | 1.206 |
| 17 | 0.740 | 0.730 | 0.774 | 0.739 | 0.756 | 0.757 | 0.760 |
| 18 | 0.820 | 0.921 | 1.017 | 0.942 | 0.852 | 0.813 | 1.142 |
| 19 | 0.94 | 1.05 | 1.15 | 1.08 | 0.97 | 0.92 | 1.29 |
| 20 | 0.14 | 0.15 | 0.17 | 0.16 | 0.14 | 0.14 | 0.19 |
| 21 | 212.41 | 181.43 | 199.22 | 206.91 | 168.54 | 199.42 | 200.12 |
| 22 | 116.75 | 106.95 | 85.97 | 102.71 | 105.73 | 102.12 | 143.06 |
| 23 | 7123.48 | 6075.21 | 6597.67 | 6030.40 | 6307.06 | 6617.65 | 6848.03 |
| 24 | 3984.75 | 3696.75 | 3926.67 | 3127.67 | 3942.75 | 3955.00 | 4854.00 |
| 25 | 33.19 | 33.66 | 33.78 | 32.64 | 33.95 | 33.28 | 33.90 |
| 26 | 27.61 | 25.26 | 26.18 | 34.31 | 25.50 | 23.06 | 25.59 |
| 27 | 20.60 | 16.35 | 18.90 | 27.30 | 22.35 | 19.26 | 22.82 |
| 28 | 60.36 | 63.07 | 55.89 | 82.13 | 60.02 | 58.70 | 116.12 |
| 29 | 18.08 | 20.18 | 19.81 | 22.89 | 19.81 | 19.53 | 21.40 |
| 30 | 17.07 | 20.69 | 18.48 | 23.31 | 19.39 | 19.66 | 19.97 |
| 31 | 15.00 | 18.68 | 20.50 | 22.57 | 19.83 | 14.50 | 20.33 |
| 32 | 18.11 | 17.09 | 16.87 | 17.49 | 16.62 | 17.10 | 17.38 |
| 33 | 17.96 | 18.42 | 17.43 | 18.07 | 17.68 | 17.61 | 18.93 |
| 34 | 23.47 | 20.97 | 21.46 | 21.41 | 22.12 | 23.25 | 24.31 |
| 35 | 14.28 | 14.72 | 15.44 | 14.33 | 14.44 | 14.89 | 14.39 |
| 36 | 244.25 | 273.56 | 273.22 | 295.33 | 259.25 | 257.89 | 277.19 |
| 37 | 4.82 | 6.01 | 5.99 | 6.66 | 5.99 | 5.62 | 6.53 |
| 38 | 55.38 | 56.76 | 55.81 | 58.54 | 51.68 | 55.16 | 54.16 |
| 39 | 507.78 | 549.34 | 509.74 | 662.13 | 527.43 | 474.68 | 544.03 |
| 40 | 660.70 | 724.58 | 618.46 | 837.56 | 612.81 | 728.00 | 950.29 |
| 41 | 2.23 | 2.73 | 2.33 | 2.40 | 2.20 | 2.08 | 2.84 |
| 42 | 15.85 | 14.39 | 17.85 | 20.42 | 13.93 | 13.05 | 16.45 |
| 43 | 9.72 | 6.98 | 9.40 | 13.58 | 9.20 | 7.69 | 10.17 |
| 44 | 17.07 | 17.52 | 18.15 | 18.61 | 17.69 | 18.15 | 18.64 |
| 45 | 16.42 | 18.34 | 16.63 | 19.38 | 16.71 | 16.27 | 15.92 |
| 46 | 15.04 | 13.63 | 14.73 | 14.61 | 13.17 | 12.77 | 14.15 |
| 47 | 13.10 | 13.48 | 13.42 | 13.27 | 13.14 | 12.53 | 13.79 |
| 48 | 1.07 | 1.44 | 0.96 | 1.10 | 1.01 | 0.95 | 1.31 |
| 49 | 2.22 | 2.90 | 2.22 | 2.83 | 2.29 | 2.15 | 2.90 |
| 50 | 0.66 | 0.65 | 0.70 | 0.68 | 0.67 | 0.65 | 0.72 |

TABLE 83

Measured parameters in Maize Hybrid under defoliation

| Ecotype/Treatment | Line-1 | Line-2 | Line-3 | Line-4 | Line-5 | Line-6 |
|---|---|---|---|---|---|---|
| 1 | 280.03 | 251.86 | 294.29 | 295.36 | 288.40 | 308.25 |
| 2 | 19.03 | 22.12 | 16.31 | 21.54 | 19.84 | 18.21 |
| 3 | 53.60 | 45.50 | 38.31 | 58.47 | 53.89 | 63.54 |

TABLE 83-continued

Measured parameters in Maize Hybrid under defoliation

| Ecotype/Treatment | Line-1 | Line-2 | Line-3 | Line-4 | Line-5 | Line-6 |
|---|---|---|---|---|---|---|
| 4 | 51.50 | 42.95 | 34.59 | 55.67 | 51.36 | 61.44 |
| 5 | 4.18 | 4.21 | 3.92 | 4.77 | 4.51 | 4.61 |
| 6 | 89.20 | 100.75 | 73.39 | 129.84 | 129.78 | 115.06 |
| 7 | 119.44 | 131.56 | 145.53 | 156.06 | 145.28 | 129.53 |
| 8 | 16.34 | 13.63 | 12.89 | 15.94 | 15.34 | 17.53 |
| 9 | 12.71 | 14.36 | 13.00 | 14.12 | 13.47 | 13.07 |
| 10 | 0.75 | 0.58 | 0.44 | 0.74 | 0.78 | 0.58 |
| 11 | 0.97 | 0.83 | 0.63 | 0.98 | 1.01 | 0.80 |
| 12 | 1.000 | 0.944 | 1.000 | 0.944 | 1.000 | 0.941 |
| 13 | 0.954 | 0.915 | 0.873 | 0.950 | 0.948 | 0.961 |
| 14 | 3.109 | 3.144 | 3.179 | 3.207 | 3.196 | 3.230 |
| 15 | 1.052 | 1.080 | 1.079 | 1.110 | 1.087 | 1.094 |
| 16 | 0.523 | 0.400 | 0.289 | 0.517 | 0.547 | 0.398 |
| 17 | 0.604 | 0.456 | 0.331 | 0.588 | 0.624 | 0.458 |
| 18 | 0.09 | 0.07 | 0.05 | 0.09 | 0.09 | 0.08 |
| 19 | 112.27 | 94.99 | 125.14 | 144.48 | 112.50 | 116.16 |
| 20 | 3914.00 | 3480.00 | 4276.50 | 4985.50 | 4643.50 | 4223.00 |
| 21 | 23.02 | 26.50 | 26.98 | 15.24 | 18.19 | 37.21 |
| 22 | 64.16 | 53.81 | 56.41 | 80.95 | 71.27 | 66.69 |
| 23 | 16.29 | 21.44 | 20.85 | 22.58 | 22.94 | 21.62 |
| 24 | 15.15 | 18.50 | 16.67 | 18.07 | 18.00 | 19.83 |
| 25 | 19.54 | 16.90 | 15.79 | 17.01 | 17.12 | 18.17 |
| 26 | 24.30 | 20.57 | 21.06 | 24.87 | 20.85 | 20.46 |
| 27 | 15.17 | 14.39 | 15.00 | 15.11 | 14.50 | 14.22 |
| 28 | 251.42 | 248.64 | 268.06 | 285.11 | 278.83 | 261.88 |
| 29 | 6.38 | 6.32 | 6.31 | 6.93 | 6.83 | 7.14 |
| 30 | 61.21 | 57.36 | 58.02 | 62.36 | 60.72 | 62.22 |
| 31 | 713.54 | 538.04 | 705.53 | 803.33 | 703.36 | 664.23 |
| 32 | 1.54 | 1.37 | 1.44 | 1.53 | 1.57 | 1.57 |
| 33 | 8.68 | 11.08 | 14.10 | 4.89 | 6.04 | 13.95 |
| 34 | 16.24 | 18.83 | 17.74 | 19.64 | 20.74 | 20.14 |
| 35 | 14.27 | 12.82 | 12.69 | 11.09 | 12.00 | 13.03 |
| 36 | 0.79 | 0.78 | 1.00 | 0.79 | 0.79 | 1.00 |
| 37 | 2.51 | 1.96 | 2.80 | 2.11 | 2.20 | 2.79 |
| 38 | 0.65 | 0.63 | 0.67 | 0.68 | 0.68 | 0.68 |

35

TABLE 84

Measured parameters in Maize Hybrid under defoliation, additional maize lines

| Ecotype/Treatment | Line-7 | Line-8 | Line-9 | Line-10 | Line-11 | Line-12 | Line-13 |
|---|---|---|---|---|---|---|---|
| 1 | 230.12 | 271.25 | 259.43 | 243.98 | 262.41 | 248.64 | 244.16 |
| 2 | 19.77 | 22.44 | 20.28 | 19.64 | 22.32 | 23.31 | 27.78 |
| 3 | 39.83 | 47.33 | 65.90 | 43.83 | 43.28 | 52.30 | 58.31 |
| 4 | 36.31 | 43.34 | 64.80 | 39.56 | 40.43 | 49.28 | 55.69 |
| 5 | 4.10 | 4.20 | 4.66 | 4.06 | 4.01 | 4.41 | 4.98 |
| 6 | 85.04 | 33.10 | 161.76 | 89.36 | 87.68 | 88.18 | 124.58 |
| 7 | 123.38 | 135.00 | 136.50 | 136.39 | 130.32 | 139.71 | 143.44 |
| 8 | 13.21 | 14.82 | 17.60 | 13.78 | 13.75 | 15.53 | 14.87 |
| 9 | 14.06 | 13.75 | 13.94 | 12.79 | 13.00 | 14.29 | 15.83 |
| 10 | 0.45 | 0.63 | 0.80 | 0.54 | 0.55 | 0.51 | 0.75 |
| 11 | 0.65 | 0.82 | 1.15 | 0.88 | 0.79 | 0.69 | 0.99 |
| 12 | 0.889 | 1.000 | 0.882 | 1.000 | 1.056 | 0.944 | 1.000 |
| 13 | 0.905 | 0.905 | 0.983 | 0.890 | 0.918 | 0.940 | 0.950 |
| 14 | 3.130 | 3.016 | 3.117 | 3.086 | 3.030 | 2.976 | 3.153 |
| 15 | 1.066 | 1.024 | 1.084 | 1.054 | 1.025 | 0.995 | 1.095 |
| 16 | 0.302 | 0.439 | 0.667 | 0.359 | 0.377 | 0.344 | 0.531 |
| 17 | 0.345 | 0.505 | 0.767 | 0.411 | 0.435 | 0.394 | 0.609 |
| 18 | 0.06 | 0.07 | 0.12 | 0.06 | 0.06 | 0.06 | 0.09 |
| 19 | 113.78 | 93.74 | 89.86 | 86.98 | 117.27 | 150.68 | 161.65 |
| 20 | 3436.00 | 4593.00 | 4315.50 | 4020.50 | 4154.00 | 4851.50 | 3750.00 |
| 21 | 27.88 | 17.33 | 20.51 | 25.36 | 28.41 | 23.16 | 38.80 |
| 22 | 64.19 | 76.23 | 57.85 | 69.98 | 67.30 | 72.90 | 83.58 |
| 23 | 18.76 | 20.88 | 17.83 | 20.70 | 20.43 | 20.11 | 24.13 |
| 24 | 16.10 | 14.83 | 17.50 | 23.67 | 19.00 | 16.45 | 20.60 |
| 25 | 18.21 | 17.23 | 17.88 | 17.12 | 17.53 | 18.63 | 19.87 |
| 26 | 20.96 | 22.47 | 21.23 | 19.85 | 21.29 | 23.58 | 21.37 |
| 27 | 14.39 | 14.67 | 15.61 | 14.39 | 14.06 | 14.61 | 14.00 |
| 28 | 254.64 | 261.94 | 268.88 | 272.71 | 262.50 | 266.33 | 279.14 |
| 29 | 6.48 | 6.28 | 7.04 | 7.20 | 7.34 | 6.94 | 7.27 |

TABLE 84-continued

Measured parameters in Maize Hybrid under defoliation, additional maize lines

| Ecotype/ Treatment | Line-7 | Line-8 | Line-9 | Line-10 | Line-11 | Line-12 | Line-13 |
|---|---|---|---|---|---|---|---|
| 30 | 59.65 | 59.99 | 56.76 | 65.70 | 57.94 | 60.31 | 57.71 |
| 31 | 673.24 | 738.37 | 692.23 | 619.79 | 729.23 | 794.64 | 847.52 |
| 32 | 1.34 | 1.47 | 1.66 | 1.48 | 1.31 | 1.48 | 1.71 |
| 33 | 10.93 | 6.48 | 9.01 | 10.69 | 10.38 | 8.49 | 12.29 |
| 34 | 17.18 | 19.12 | 16.74 | 15.96 | 17.31 | 18.19 | 17.77 |
| 35 | 14.25 | 12.77 | 13.52 | 13.08 | 13.43 | 13.21 | 14.72 |
| 36 | 0.88 | 0.84 | 0.86 | 0.94 | 0.76 | 0.96 | 0.97 |
| 37 | 2.54 | 2.48 | 2.35 | 2.59 | 2.41 | 2.70 | 2.72 |
| 38 | 0.63 | 0.61 | 0.62 | 0.62 | 0.60 | 0.58 | 0.63 |

Tables 85 and 86 hereinbelow provide the correlations (R) between the expression levels yield improving genes and their homologues in various tissues [Expression (Exp) sets] and the phenotypic performance [yield, biomass, growth rate and/or vigor components (Correlation vector (Cor))] under normal and defoliation conditions across maize varieties. P=p value.

TABLE 85

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LYM1129 | 0.78 | 4.71E−03 | 2 | 35 | LYM1130 | 0.71 | 6.37E−03 | 1 | 31 |
| LYM1130 | 0.80 | 1.70E−03 | 3 | 30 | LYM1130 | 0.75 | 4.96E−03 | 3 | 36 |
| LYM1130 | 0.83 | 7.75E−04 | 3 | 45 | LYM1131 | 0.75 | 3.07E−03 | 1 | 19 |
| LYM1131 | 0.76 | 2.55E−03 | 1 | 20 | LYM1131 | 0.76 | 2.55E−03 | 1 | 18 |
| LYM1131 | 0.77 | 3.35E−03 | 3 | 44 | LYM1131 | 0.73 | 1.15E−02 | 2 | 12 |
| LYM1131 | 0.73 | 1.14E−02 | 2 | 16 | LYM1131 | 0.78 | 4.42E−03 | 2 | 42 |
| LYM1132 | 0.72 | 5.76E−03 | 1 | 22 | LYM1132 | 0.70 | 1.54E−02 | 4 | 21 |
| LYM1133 | 0.73 | 4.91E−03 | 1 | 34 | LYM1133 | 0.72 | 5.63E−03 | 1 | 33 |
| LYM1133 | 0.78 | 7.27E−03 | 2 | 8 | LYM1134 | 0.72 | 7.90E−03 | 3 | 36 |
| LYM1134 | 0.80 | 1.82E−03 | 3 | 28 | LYM1134 | 0.79 | 2.15E−03 | 3 | 29 |
| LYM1134 | 0.72 | 1.32E−02 | 2 | 40 | LYM1134 | 0.78 | 4.32E−03 | 2 | 44 |
| LYM1134 | 0.78 | 4.59E−03 | 2 | 10 | LYM1136 | 0.81 | 2.76E−03 | 4 | 19 |
| LYM1136 | 0.71 | 1.38E−02 | 4 | 11 | LYM1136 | 0.72 | 1.25E−02 | 4 | 12 |
| LYM1136 | 0.71 | 1.45E−02 | 4 | 16 | LYM1136 | 0.72 | 1.30E−02 | 4 | 42 |
| LYM1136 | 0.77 | 5.84E−03 | 4 | 10 | LYM1136 | 0.81 | 2.66E−03 | 4 | 20 |
| LYM1136 | 0.81 | 2.66E−03 | 4 | 18 | LYM1136 | 0.78 | 4.99E−03 | 2 | 17 |
| LYM1138 | 0.70 | 7.61E−03 | 1 | 2 | LYM1138 | 0.86 | 7.58E−04 | 4 | 2 |
| LYM1138 | 0.86 | 6.79E−04 | 4 | 41 | LYM1138 | 0.75 | 1.33E−02 | 4 | 4 |
| LYM1138 | 0.85 | 1.72E−03 | 4 | 14 | LYM1138 | 0.71 | 2.27E−02 | 4 | 3 |
| LYM1138 | 0.85 | 8.98E−04 | 4 | 48 | LYM1138 | 0.76 | 7.00E−03 | 4 | 49 |
| LYM1138 | 0.71 | 1.52E−02 | 4 | 20 | LYM1138 | 0.74 | 9.59E−03 | 4 | 33 |
| LYM1138 | 0.71 | 1.52E−02 | 4 | 18 | LYM1139 | 0.74 | 3.81E−03 | 1 | 35 |
| LYM1139 | 0.77 | 2.26E−03 | 1 | 49 | LYM1139 | 0.71 | 9.21E−03 | 3 | 15 |
| LYM1139 | 0.70 | 1.08E−02 | 3 | 48 | LYM1139 | 0.79 | 2.32E−03 | 3 | 49 |
| LYM1139 | 0.73 | 7.07E−03 | 3 | 10 | LYM1139 | 0.76 | 4.00E−03 | 3 | 33 |
| LYM1139 | 0.71 | 1.50E−02 | 2 | 24 | LYM1139 | 0.74 | 8.83E−03 | 2 | 48 |
| LYM1139 | 0.80 | 3.33E−03 | 2 | 22 | LYM1139 | 0.80 | 3.31E−03 | 2 | 49 |
| LYM1139 | 0.73 | 1.15E−02 | 2 | 33 | LYM1140 | 0.74 | 5.96E−03 | 3 | 40 |
| LYM1140 | 0.77 | 3.66E−03 | 3 | 28 | LYM1140 | 0.71 | 1.36E−02 | 4 | 9 |
| LYM1140 | 0.77 | 5.11E−03 | 4 | 27 | LYM1141 | 0.75 | 4.93E−03 | 3 | 47 |
| LYM1141 | 0.84 | 6.36E−04 | 3 | 32 | LYM1141 | 0.72 | 7.79E−03 | 3 | 38 |
| LYM1141 | 0.73 | 6.91E−03 | 3 | 25 | LYM1141 | 0.77 | 5.30E−03 | 4 | 47 |
| LYM1141 | 0.88 | 3.56E−04 | 4 | 32 | LYM1141 | 0.74 | 8.62E−03 | 4 | 40 |
| LYM1142 | 0.71 | 6.26E−03 | 1 | 40 | LYM1142 | 0.79 | 1.46E−03 | 1 | 39 |
| LYM1142 | 0.90 | 2.36E−05 | 1 | 49 | LYM1142 | 0.75 | 4.79E−03 | 3 | 40 |
| LYM1142 | 0.74 | 9.65E−03 | 4 | 19 | LYM1142 | 0.76 | 6.61E−03 | 4 | 11 |
| LYM1142 | 0.77 | 5.42E−03 | 4 | 16 | LYM1142 | 0.73 | 1.55E−02 | 4 | 3 |
| LYM1142 | 0.72 | 1.87E−02 | 4 | 5 | LYM1142 | 0.73 | 1.13E−02 | 4 | 20 |
| LYM1142 | 0.73 | 1.13E−02 | 4 | 18 | LYM1143 | 0.72 | 5.66E−03 | 1 | 2 |
| LYM1143 | 0.78 | 2.91E−03 | 3 | 2 | LYM1143 | 0.78 | 2.75E−03 | 3 | 34 |
| LYM1143 | 0.77 | 3.73E−03 | 3 | 28 | LYM1143 | 0.74 | 9.04E−03 | 3 | 14 |
| LYM1143 | 0.79 | 3.50E−03 | 4 | 19 | LYM1143 | 0.75 | 8.05E−03 | 4 | 11 |
| LYM1143 | 0.85 | 8.59E−04 | 4 | 2 | LYM1143 | 0.75 | 8.44E−03 | 4 | 41 |
| LYM1143 | 0.78 | 8.29E−03 | 4 | 4 | LYM1143 | 0.73 | 1.01E−02 | 4 | 44 |
| LYM1143 | 0.76 | 1.15E−02 | 4 | 14 | LYM1143 | 0.72 | 1.89E−02 | 4 | 3 |
| LYM1143 | 0.76 | 6.31E−03 | 4 | 29 | LYM1143 | 0.80 | 3.10E−03 | 4 | 20 |
| LYM1143 | 0.80 | 3.10E−03 | 4 | 18 | LYM1143 | 0.90 | 1.55E−04 | 2 | 2 |
| LYM1143 | 0.75 | 1.22E−02 | 2 | 14 | LYM1143 | 0.73 | 1.15E−02 | 2 | 23 |

TABLE 85-continued

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LYM1146 | 0.70 | 1.11E−02 | 3 | 49 | LYM1146 | 0.72 | 1.30E−02 | 4 | 39 |
| LYM1146 | 0.72 | 1.34E−02 | 2 | 28 | LYM1146 | 0.85 | 9.22E−04 | 2 | 49 |
| LYM1149 | 0.75 | 3.21E−03 | 1 | 45 | LYM1149 | 0.72 | 7.91E−03 | 3 | 41 |
| LYM1149 | 0.72 | 7.94E−03 | 3 | 29 | LYM1149 | 0.75 | 8.28E−03 | 4 | 36 |
| LYM1149 | 0.74 | 9.89E−03 | 4 | 29 | LYM1149 | 0.72 | 1.28E−02 | 2 | 19 |
| LYM1149 | 0.79 | 4.00E−03 | 2 | 11 | LYM1149 | 0.77 | 5.42E−03 | 2 | 37 |
| LYM1149 | 0.72 | 1.18E−02 | 2 | 31 | LYM1149 | 0.79 | 3.49E−03 | 2 | 36 |
| LYM1149 | 0.80 | 5.10E−03 | 2 | 4 | LYM1149 | 0.93 | 8.86E−05 | 2 | 8 |
| LYM1149 | 0.81 | 4.88E−03 | 2 | 3 | LYM1149 | 0.71 | 1.42E−02 | 2 | 20 |
| LYM1149 | 0.71 | 1.42E−02 | 2 | 18 | LYM1151 | 0.74 | 8.77E−03 | 2 | 26 |
| LYM1151 | 0.74 | 8.69E−03 | 2 | 42 | LYM1152 | 0.75 | 7.98E−03 | 4 | 27 |
| LYM1152 | 0.77 | 5.84E−03 | 4 | 43 | LYM1153 | 0.74 | 3.76E−03 | 1 | 25 |
| LYM1153 | 0.79 | 3.78E−03 | 4 | 13 | LYM1153 | 0.82 | 2.02E−03 | 2 | 13 |
| LYM1153 | 0.79 | 3.52E−03 | 2 | 10 | LYM1153 | 0.81 | 2.52E−03 | 2 | 17 |
| LYM1156 | 0.72 | 5.33E−03 | 1 | 31 | LYM1156 | 0.79 | 1.47E−03 | 1 | 42 |
| LYM1156 | 0.74 | 6.40E−03 | 3 | 37 | LYM1156 | 0.71 | 9.50E−03 | 3 | 31 |
| LYM1156 | 0.74 | 5.73E−03 | 3 | 28 | LYM1156 | 0.81 | 2.33E−03 | 3 | 14 |
| LYM1156 | 0.76 | 4.01E−03 | 3 | 29 | LYM1156 | 0.73 | 1.11E−02 | 4 | 37 |
| LYM1156 | 0.76 | 6.59E−03 | 4 | 30 | LYM1156 | 0.72 | 1.25E−02 | 4 | 40 |
| LYM1156 | 0.85 | 9.53E−04 | 4 | 7 | LYM1156 | 0.76 | 6.29E−03 | 4 | 28 |
| LYM1156 | 0.85 | 8.01E−04 | 4 | 29 | LYM1158 | 0.75 | 7.41E−03 | 4 | 13 |
| LYM1158 | 0.73 | 1.08E−02 | 2 | 9 | LYM1158 | 0.79 | 6.25E−03 | 2 | 14 |
| LYM1158 | 0.74 | 1.52E−02 | 2 | 5 | LYM1159 | 0.75 | 2.91E−03 | 1 | 33 |
| LYM1162 | 0.75 | 5.37E−03 | 1 | 5 | LYM1162 | 0.79 | 2.37E−03 | 3 | 40 |
| LYM1162 | 0.85 | 4.62E−04 | 3 | 28 | LYM1162 | 0.72 | 1.33E−02 | 4 | 19 |
| LYM1162 | 0.72 | 1.28E−02 | 4 | 11 | LYM1162 | 0.72 | 1.26E−02 | 4 | 40 |
| LYM1162 | 0.88 | 3.26E−04 | 4 | 28 | LYM1162 | 0.79 | 3.89E−03 | 4 | 16 |
| LYM1162 | 0.72 | 1.77E−02 | 4 | 5 | LYM1162 | 0.71 | 1.51E−02 | 4 | 22 |
| LYM1162 | 0.72 | 1.29E−02 | 4 | 20 | LYM1162 | 0.72 | 1.29E−02 | 4 | 18 |
| LYM1162 | 0.71 | 2.04E−02 | 2 | 4 | LYM1163 | 0.75 | 4.65E−03 | 3 | 21 |
| LYM1164 | 0.71 | 1.38E−02 | 4 | 13 | LYM1164 | 0.71 | 1.49E−02 | 2 | 45 |
| LYM1165 | 0.71 | 1.47E−02 | 4 | 48 | LYM1165 | 0.77 | 6.02E−03 | 4 | 33 |
| LYM1165 | 0.81 | 4.67E−03 | 2 | 5 | LYM1167 | 0.73 | 6.52E−03 | 3 | 19 |
| LYM1167 | 0.74 | 5.94E−03 | 3 | 11 | LYM1167 | 0.77 | 3.16E−03 | 3 | 6 |
| LYM1167 | 0.74 | 6.04E−03 | 3 | 20 | LYM1167 | 0.74 | 6.04E−03 | 3 | 18 |
| LYM1167 | 0.73 | 1.03E−02 | 4 | 29 | LYM1167 | 0.77 | 6.07E−03 | 2 | 13 |
| LYM1168 | 0.73 | 6.50E−03 | 3 | 29 | LYM1168 | 0.72 | 1.27E−02 | 4 | 9 |
| LYM1169 | 0.73 | 6.50E−03 | 3 | 32 | LYM1169 | 0.78 | 4.88E−03 | 4 | 2 |
| LYM1169 | 0.74 | 1.45E−02 | 4 | 14 | LYM1169 | 0.70 | 2.30E−02 | 4 | 5 |
| LYM1169 | 0.70 | 1.58E−02 | 2 | 10 | LYM1170 | 0.71 | 6.22E−03 | 1 | 47 |
| LYM1170 | 0.80 | 9.53E−04 | 1 | 32 | LYM1171 | 0.79 | 2.12E−03 | 3 | 19 |
| LYM1171 | 0.78 | 2.49E−03 | 3 | 11 | LYM1171 | 0.84 | 6.86E−04 | 3 | 41 |
| LYM1171 | 0.74 | 6.10E−03 | 3 | 28 | LYM1171 | 0.78 | 3.02E−03 | 3 | 49 |
| LYM1171 | 0.79 | 2.07E−03 | 3 | 20 | LYM1171 | 0.79 | 2.07E−03 | 3 | 18 |
| LYM1172 | 0.76 | 3.79E−03 | 3 | 37 | LYM1172 | 0.79 | 3.97E−03 | 4 | 37 |
| LYM1172 | 0.76 | 6.19E−03 | 4 | 31 | LYM1172 | 0.85 | 9.93E−04 | 4 | 30 |
| LYM1172 | 0.75 | 8.09E−03 | 4 | 7 | LYM1172 | 0.85 | 9.04E−04 | 4 | 29 |
| LYM1172 | 0.72 | 1.22E−02 | 2 | 11 | LYM1172 | 0.71 | 1.41E−02 | 2 | 36 |
| LYM1172 | 0.70 | 1.63E−02 | 2 | 41 | LYM1172 | 0.83 | 1.43E−03 | 2 | 6 |
| LYM1172 | 0.71 | 1.42E−02 | 2 | 40 | LYM1172 | 0.82 | 1.80E−03 | 2 | 28 |
| LYM1172 | 0.78 | 4.35E−03 | 2 | 29 | LYM1172 | 0.72 | 5.52E−03 | 1 | 32 |
| LYM1173 | 0.77 | 2.21E−03 | 1 | 26 | LYM1173 | 0.77 | 2.09E−03 | 1 | 39 |
| LYM1173 | 0.79 | 1.32E−03 | 1 | 38 | LYM1174 | 0.82 | 5.24E−04 | 1 | 32 |
| LYM1174 | 0.80 | 1.73E−03 | 3 | 25 | LYM1174 | 0.70 | 1.55E−02 | 4 | 41 |
| LYM1174 | 0.76 | 6.75E−03 | 4 | 48 | LYM1175 | 0.76 | 1.14E−02 | 2 | 8 |
| LYM1175 | 0.72 | 1.33E−02 | 2 | 1 | LYM1176 | 0.71 | 1.41E−02 | 4 | 13 |
| LYM1177 | 0.79 | 2.17E−03 | 3 | 49 | LYM1177 | 0.74 | 9.40E−03 | 2 | 6 |
| LYM1177 | 0.79 | 3.50E−03 | 2 | 40 | LYM1178 | 0.71 | 1.04E−02 | 3 | 27 |
| LYM1178 | 0.78 | 4.91E−03 | 4 | 35 | LYM1178 | 0.80 | 3.23E−03 | 4 | 1 |
| LYM1178 | 0.71 | 1.50E−02 | 4 | 17 | LYM1178 | 0.73 | 1.08E−02 | 2 | 35 |
| LYM1179 | 0.78 | 2.96E−03 | 3 | 2 | LYM1179 | 0.74 | 9.45E−03 | 4 | 40 |
| LYM1179 | 0.74 | 9.46E−03 | 4 | 44 | LYM1179 | 0.72 | 1.21E−02 | 4 | 28 |
| LYM1180 | 0.76 | 2.49E−03 | 1 | 38 | LYM1180 | 0.71 | 9.60E−03 | 3 | 19 |
| LYM1180 | 0.78 | 3.06E−03 | 3 | 12 | LYM1180 | 0.75 | 4.80E−03 | 3 | 40 |
| LYM1180 | 0.71 | 1.01E−02 | 3 | 20 | LYM1180 | 0.71 | 1.01E−02 | 3 | 18 |
| LYM1181 | 0.83 | 4.13E−04 | 1 | 47 | LYM1181 | 0.75 | 3.44E−03 | 1 | 46 |
| LYM1181 | 0.78 | 1.71E−03 | 1 | 32 | LYM1181 | 0.84 | 3.68E−04 | 1 | 26 |
| LYM1181 | 0.80 | 1.13E−03 | 1 | 39 | LYM1181 | 0.77 | 2.00E−03 | 1 | 42 |
| LYM1181 | 0.72 | 5.17E−03 | 1 | 10 | LYM1181 | 0.75 | 8.47E−03 | 4 | 13 |
| LYM1181 | 0.72 | 1.33E−02 | 2 | 24 | LYM1181 | 0.73 | 1.58E−02 | 2 | 8 |
| LYM1181 | 0.74 | 8.60E−03 | 2 | 1 | LYM1181 | 0.78 | 4.83E−03 | 2 | 17 |
| LYM1182 | 0.72 | 1.19E−02 | 4 | 34 | LYM1183 | 0.70 | 7.25E−03 | 1 | 36 |
| LYM1183 | 0.76 | 2.37E−03 | 1 | 29 | LYM1184 | 0.74 | 6.29E−03 | 3 | 9 |

TABLE 85-continued

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LYM1184 | 0.77 | 3.64E−03 | 3 | 40 | LYM1184 | 0.70 | 1.07E−02 | 3 | 29 |
| LYM1185 | 0.74 | 1.53E−02 | 2 | 8 | LYM1186 | 0.83 | 4.73E−04 | 1 | 9 |
| LYM1186 | 0.73 | 1.14E−02 | 4 | 33 | LYM1187 | 0.71 | 9.84E−03 | 3 | 36 |
| LYM1187 | 0.77 | 3.18E−03 | 3 | 45 | LYM1187 | 0.74 | 9.25E−03 | 2 | 19 |
| LYM1187 | 0.74 | 8.67E−03 | 2 | 11 | LYM1187 | 0.78 | 4.86E−03 | 2 | 40 |
| LYM1187 | 0.88 | 3.16E−04 | 2 | 28 | LYM1187 | 0.73 | 1.13E−02 | 2 | 16 |
| LYM1187 | 0.70 | 1.54E−02 | 2 | 22 | LYM1187 | 0.75 | 8.43E−03 | 2 | 20 |
| LYM1187 | 0.75 | 8.43E−03 | 2 | 18 | LYM1163 | 0.76 | 3.76E−03 | 3 | 50 |
| LYM1136 | 0.72 | 8.76E−03 | 3 | 50 | LYM1139 | 0.77 | 3.27E−03 | 3 | 50 |
| LYM1153 | 0.74 | 9.61E−03 | 2 | 50 | | | | | |

TABLE 86

Correlation between the expression level of selected genes of some embodiments of the invention in various tissues and the phenotypic performance under defoliation treatment across maize varieties

| Gene Name | R | P value | Exp. set | Corr. Set ID | Gene Name | R | P value | Exp. set | Corr. Set ID |
|---|---|---|---|---|---|---|---|---|---|
| LYM1129 | 0.74 | 5.47E−03 | 3 | 14 | LYM1129 | 0.74 | 9.12E−03 | 4 | 24 |
| LYM1131 | 0.73 | 6.61E−03 | 1 | 24 | LYM1131 | 0.75 | 4.82E−03 | 3 | 2 |
| LYM1131 | 0.77 | 3.54E−03 | 3 | 31 | LYM1131 | 0.75 | 4.60E−03 | 3 | 9 |
| LYM1131 | 0.72 | 1.19E−02 | 4 | 26 | LYM1133 | 0.71 | 9.86E−03 | 1 | 32 |
| LYM1133 | 0.71 | 1.01E−02 | 2 | 20 | LYM1133 | 0.80 | 1.63E−03 | 2 | 26 |
| LYM1134 | 0.81 | 1.36E−03 | 1 | 30 | LYM1134 | 0.71 | 1.47E−02 | 4 | 10 |
| LYM1137 | 0.79 | 2.35E−03 | 2 | 24 | LYM1138 | 0.75 | 5.34E−03 | 1 | 5 |
| LYM1138 | 0.73 | 6.75E−03 | 1 | 4 | LYM1138 | 0.78 | 2.98E−03 | 1 | 18 |
| LYM1138 | 0.74 | 5.74E−03 | 1 | 17 | LYM1138 | 0.70 | 1.11E−02 | 1 | 7 |
| LYM1138 | 0.73 | 6.74E−03 | 1 | 3 | LYM1138 | 0.74 | 5.63E−03 | 1 | 16 |
| LYM1138 | 0.71 | 1.03E−02 | 3 | 24 | LYM1138 | 0.91 | 3.83E−05 | 2 | 26 |
| LYM1139 | 0.82 | 1.02E−03 | 1 | 29 | LYM1140 | 0.71 | 1.03E−02 | 3 | 30 |
| LYM1140 | 0.77 | 3.14E−03 | 2 | 35 | LYM1140 | 0.70 | 1.61E−02 | 4 | 2 |
| LYM1140 | 0.76 | 6.14E−03 | 4 | 9 | LYM1140 | 0.70 | 1.54E−02 | 4 | 36 |
| LYM1141 | 0.76 | 4.05E−03 | 1 | 30 | LYM1141 | 0.84 | 5.61E−04 | 3 | 34 |
| LYM1141 | 0.72 | 1.27E−02 | 4 | 34 | LYM1142 | 0.80 | 1.94E−03 | 1 | 27 |
| LYM1142 | 0.72 | 8.41E−03 | 1 | 12 | LYM1142 | 0.78 | 2.61E−03 | 1 | 18 |
| LYM1142 | 0.70 | 1.05E−02 | 1 | 17 | LYM1142 | 0.70 | 1.05E−02 | 1 | 16 |
| LYM1142 | 0.79 | 2.09E−03 | 3 | 12 | LYM1142 | 0.85 | 4.32E−04 | 2 | 12 |
| LYM1142 | 0.70 | 1.64E−02 | 4 | 24 | LYM1143 | 0.80 | 1.77E−03 | 3 | 28 |
| LYM1143 | 0.72 | 8.59E−03 | 3 | 23 | LYM1143 | 0.75 | 4.76E−03 | 3 | 32 |
| LYM1143 | 0.78 | 2.54E−03 | 3 | 11 | LYM1143 | 0.81 | 1.25E−03 | 3 | 18 |
| LYM1143 | 0.87 | 2.31E−04 | 3 | 17 | LYM1143 | 0.81 | 1.27E−03 | 3 | 7 |
| LYM1143 | 0.83 | 8.99E−04 | 3 | 10 | LYM1143 | 0.86 | 2.81E−04 | 3 | 16 |
| LYM1143 | 0.71 | 1.02E−02 | 2 | 28 | LYM1143 | 0.71 | 1.04E−02 | 2 | 32 |
| LYM1143 | 0.71 | 9.11E−03 | 2 | 11 | LYM1143 | 0.70 | 1.12E−02 | 2 | 18 |
| LYM1143 | 0.80 | 1.86E−03 | 2 | 17 | LYM1143 | 0.81 | 1.39E−03 | 2 | 10 |
| LYM1143 | 0.79 | 2.18E−03 | 2 | 16 | LYM1143 | 0.77 | 5.51E−03 | 4 | 23 |
| LYM1143 | 0.71 | 1.44E−02 | 4 | 2 | LYM1143 | 0.73 | 1.02E−02 | 4 | 32 |
| LYM1143 | 0.72 | 1.31E−02 | 4 | 17 | LYM1143 | 0.71 | 1.35E−02 | 4 | 10 |
| LYM1143 | 0.71 | 1.51E−02 | 4 | 16 | | | | | |
| LYM1149 | 0.71 | 1.04E−02 | 1 | 14 | LYM1149 | 0.81 | 1.36E−03 | 1 | 1 |
| LYM1151 | 0.75 | 4.74E−03 | 1 | 13 | LYM1151 | 0.71 | 1.35E−02 | 4 | 15 |
| LYM1151 | 0.70 | 1.59E−02 | 4 | 14 | LYM1152 | 0.76 | 3.77E−03 | 2 | 26 |
| LYM1153 | 0.73 | 7.05E−03 | 1 | 12 | LYM1153 | 0.84 | 7.21E−04 | 1 | 1 |
| LYM1153 | 0.74 | 5.83E−03 | 2 | 34 | LYM1153 | 0.77 | 3.17E−03 | 2 | 1 |
| LYM1154 | 0.72 | 8.27E−03 | 3 | 10 | LYM1155 | 0.75 | 5.33E−03 | 1 | 12 |
| LYM1155 | 0.72 | 8.37E−03 | 2 | 36 | LYM1156 | 0.74 | 6.11E−03 | 1 | 23 |
| LYM1157 | 0.71 | 9.33E−03 | 1 | 35 | LYM1157 | 0.76 | 4.42E−03 | 1 | 25 |
| LYM1157 | 0.70 | 1.09E−02 | 1 | 37 | LYM1157 | 0.79 | 2.13E−03 | 2 | 2 |
| LYM1158 | 0.79 | 2.33E−03 | 1 | 30 | LYM1158 | 0.78 | 2.67E−03 | 1 | 24 |
| LYM1159 | 0.71 | 9.95E−03 | 3 | 25 | LYM1159 | 0.90 | 1.68E−04 | 4 | 25 |
| LYM1159 | 0.72 | 1.33E−02 | 4 | 37 | LYM1160 | 0.78 | 2.50E−03 | 1 | 30 |
| LYM1160 | 0.71 | 9.64E−03 | 2 | 37 | LYM1160 | 0.74 | 8.60E−03 | 4 | 25 |
| LYM1161 | 0.73 | 6.74E−03 | 1 | 24 | LYM1161 | 0.71 | 1.49E−02 | 4 | 19 |
| LYM1162 | 0.73 | 6.67E−03 | 1 | 27 | LYM1162 | 0.80 | 1.64E−03 | 1 | 18 |
| LYM1162 | 0.71 | 9.53E−03 | 1 | 17 | LYM1162 | 0.75 | 5.38E−03 | 1 | 24 |
| LYM1162 | 0.71 | 1.01E−02 | 1 | 16 | LYM1162 | 0.81 | 1.36E−03 | 3 | 2 |
| LYM1162 | 0.79 | 2.49E−03 | 2 | 35 | LYM1162 | 0.73 | 7.54E−03 | 2 | 25 |
| LYM1162 | 0.83 | 1.76E−03 | 4 | 25 | LYM1162 | 0.79 | 3.60E−03 | 4 | 37 |

TABLE 86-continued

Correlation between the expression level of selected genes of some embodiments of the invention in various tissues and the phenotypic performance under defoliation treatment across maize varieties

| Gene Name | R | P value | Exp. set | Corr. Set ID | Gene Name | R | P value | Exp. set | Corr. Set ID |
|---|---|---|---|---|---|---|---|---|---|
| LYM1163 | 0.77 | 3.08E−03 | 1 | 27 | LYM1163 | 0.76 | 4.45E−03 | 1 | 26 |
| LYM1163 | 0.79 | 2.12E−03 | 3 | 26 | LYM1163 | 0.75 | 7.91E−03 | 4 | 25 |
| LYM1163 | 0.73 | 1.09E−02 | 4 | 26 | LYM1165 | 0.79 | 3.71E −03 | 4 | 26 |
|  |  |  |  |  | LYM1167 | 0.80 | 3.05E−03 | 4 | 37 |
| LYM1168 | 0.77 | 3.24E−03 | 3 | 2 | LYM1169 | 0.72 | 8.51E−03 | 2 | 23 |
| LYM1170 | 0.72 | 8.78E−03 | 1 | 13 | LYM1170 | 0.77 | 3.34E−03 | 1 | 18 |
| LYM1170 | 0.71 | 9.63E−03 | 1 | 17 | LYM1170 | 0.72 | 8.03E−03 | 1 | 8 |
| LYM1170 | 0.70 | 1.09E−02 | 1 | 16 | LYM1171 | 0.71 | 1.39E−02 | 4 | 14 |
| LYM1172 | 0.79 | 2.19E−03 | 1 | 5 | LYM1172 | 0.76 | 3.95E−03 | 1 | 32 |
| LYM1172 | 0.76 | 4.43E−03 | 1 | 17 | LYM1172 | 0.83 | 7.43E−04 | 1 | 10 |
| LYM1172 | 0.76 | 4.25E−03 | 1 | 16 | LYM1172 | 0.76 | 4.31E−03 | 3 | 34 |
| LYM1172 | 0.81 | 1.51E−03 | 3 | 1 | LYM1172 | 0.80 | 3.03E−03 | 4 | 7 |
| LYM1173 | 0.79 | 2.22E−03 | 3 | 35 | LYM1173 | 0.91 | 3.79E−05 | 3 | 25 |
| LYM1173 | 0.74 | 6.00E−03 | 3 | 37 | LYM1174 | 0.72 | 8.01E−03 | 1 | 34 |
| LYM1174 | 0.80 | 1.97E−03 | 3 | 34 | LYM1174 | 0.74 | 6.43E−03 | 2 | 25 |
| LYM1174 | 0.84 | 1.36E−03 | 4 | 20 | LYM1174 | 0.74 | 8.78E−03 | 4 | 26 |
| LYM1175 | 0.72 | 1.33E−02 | 4 | 33 | LYM1176 | 0.76 | 4.34E−03 | 3 | 34 |
| LYM1176 | 0.77 | 3.28E−03 | 3 | 15 | LYM1176 | 0.80 | 1.87E−03 | 3 | 14 |
| LYM1176 | 0.85 | 8.21E−04 | 4 | 15 | LYM1176 | 0.83 | 1.67E−03 | 4 | 14 |
| LYM1176 | 0.75 | 7.91E−03 | 4 | 10 | LYM1176 | 0.70 | 1.58E−02 | 4 | 16 |
| LYM1177 | 0.81 | 1.30E−03 | 3 | 1 | LYM1178 | 0.74 | 5.55E−03 | 3 | 27 |
| LYM1178 | 0.76 | 4.43E−03 | 3 | 26 | LYM1178 | 0.71 | 9.14E−03 | 2 | 27 |
| LYM1178 | 0.78 | 2.61E−03 | 2 | 26 | LYM1178 | 0.87 | 4.45E−04 | 4 | 26 |
| LYM1179 | 0.71 | 9.65E−03 | 3 | 34 | LYM1179 | 0.72 | 8.50E−03 | 3 | 1 |
| LYM1179 | 0.71 | 1.01E−02 | 2 | 21 | LYM1179 | 0.72 | 1.19E−02 | 4 | 5 |
| LYM1179 | 0.73 | 1.12E−02 | 4 | 6 | LYM1180 | 0.72 | 8.66E−03 | 1 | 31 |
| LYM1180 | 0.81 | 1.25E−03 | 3 | 25 | LYM1180 | 0.75 | 8.39E−03 | 4 | 5 |
| LYM1180 | 0.76 | 6.13E−03 | 4 | 4 | LYM1180 | 0.88 | 3.84E−04 | 4 | 32 |
| LYM1180 | 0.77 | 6.00E−03 | 4 | 11 | LYM1180 | 0.81 | 2.26E−03 | 4 | 18 |
| LYM1180 | 0.78 | 4.58E−03 | 4 | 17 | LYM1180 | 0.79 | 4.11E−03 | 4 | 3 |
| LYM1180 | 0.75 | 7.88E−03 | 4 | 10 | LYM1180 | 0.79 | 4.20E−03 | 4 | 16 |
| LYM1181 | 0.72 | 8.26E−03 | 1 | 21 | LYM1181 | 0.76 | 3.87E−03 | 2 | 27 |
| LYM1181 | 0.76 | 4.49E−03 | 2 | 4 | LYM1181 | 0.72 | 8.65E−03 | 2 | 14 |
| LYM1181 | 0.76 | 3.87E−03 | 2 | 13 | LYM1181 | 0.73 | 7.16E−03 | 2 | 32 |
| LYM1181 | 0.79 | 2.27E−03 | 2 | 11 | LYM1181 | 0.81 | 1.31E−03 | 2 | 18 |
| LYM1181 | 0.85 | 4.31E−04 | 2 | 17 | LYM1181 | 0.76 | 4.06E−03 | 2 | 3 |
| LYM1181 | 0.85 | 4.63E−04 | 2 | 10 | LYM1181 | 0.85 | 4.20E−04 | 2 | 16 |
| LYM1181 | 0.70 | 1.64E−02 | 4 | 35 | LYM1182 | 0.76 | 6.10E−03 | 4 | 28 |
| LYM1182 | 0.76 | 6.28E−03 | 4 | 7 | LYM1183 | 0.70 | 1.05E−02 | 1 | 12 |
| LYM1184 | 0.72 | 8.95E−03 | 1 | 30 | LYM1184 | 0.75 | 5.03E−03 | 1 | 36 |
| LYM1184 | 0.70 | 1.12E−02 | 1 | 24 | LYM1184 | 0.82 | 1.09E−03 | 3 | 2 |
| LYM1184 | 0.74 | 6.31E−03 | 3 | 9 | LYM1184 | 0.75 | 4.65E−03 | 2 | 35 |
| LYM1184 | 0.73 | 7.13E−03 | 2 | 25 | LYM1184 | 0.78 | 2.58E−03 | 1 | 6 |
| LYM1185 | 0.70 | 1.09E−02 | 3 | 15 | LYM1185 | 0.71 | 9.38E−03 | 3 | 11 |
| LYM1185 | 0.80 | 1.87E−03 | 3 | 6 | LYM1185 | 0.71 | 1.00E−02 | 3 | 18 |
| LYM1185 | 0.76 | 4.11E−03 | 2 | 5 | LYM1185 | 0.79 | 2.22E−03 | 2 | 6 |
| LYM1185 | 0.74 | 5.70E−03 | 2 | 7 | LYM1186 | 0.70 | 1.07E−02 | 1 | 33 |
| LYM1187 | 0.71 | 1.04E−02 | 2 | 12 | LYM1187 | 0.78 | 2.97E−03 | 2 | 24 |
| LYM1187 | 0.71 | 1.48E−02 | 4 | 26 | LYM1181 | 0.75 | 4.54E−03 | 2 | 38 |
| LYM1129 | 0.73 | 6.75E−03 | 3 | 38 | LYM1130 | 0.74 | 5.60E−03 | 2 | 38 |
| LYM1134 | 0.79 | 4.01E−03 | 4 | 38 | LYM1141 | 0.72 | 7.70E−03 | 3 | 38 |
| LYM1149 | 0.81 | 1.45E−03 | 1 | 38 | LYM1154 | 0.75 | 4.59E−03 | 3 | 38 |
| LYM1171 | 0.78 | 4.78E−03 | 4 | 38 | LYM1172 | 0.72 | 7.84E−03 | 3 | 38 |
| LYM1174 | 0.74 | 5.77E−03 | 3 | 38 | LYM1176 | 0.82 | 1.13E−03 | 3 | 38 |
| LYM1176 | 0.77 | 5.93E−03 | 4 | 38 | LYM1177 | 0.71 | 9.47E−03 | 1 | 38 |

Example 14

Production of Barley Transcriptome and High Throughput Correlation Analysis Using 60K Barley Oligonucleotide Micro-Array In order to produce a high throughput correlation analysis, the present inventors utilized a Barley oligonucleotide micro-array, produced by Agilent Technologies [chem.(dot)agilent(dot)com/Scripts/PDS(dot)asp?1Page=50879]. The array oligonucleotide represents about 33,777 Barley genes and transcripts. In order to define correlations between the levels of RNA expression and yield or vigor related parameters, various plant characteristics of 55 different Barley accessions were analyzed. Same accessions were subjected to RNA expression analysis. The correlation between the RNA levels and the characterized parameters was analyzed using Pearson correlation test [davidmlane(dot)com/hyperstat/A34739(dot)html].

Experimental Procedures

Four tissues at different developmental stages [leaf, flag leaf, spike and peduncle], representing different plant characteristics, were sampled and RNA was extracted as described hereinabove under "GENERAL EXPERIMENTAL AND BIOINFORMATICS METHODS".

For convenience, each micro-array expression information tissue type has received a Set ID as summarized in Table 87 below.

TABLE 87

Barley transcriptome expression sets

| Expression Set | Set ID |
| --- | --- |
| Flag leaf at booting stage under normal conditions | 1 |
| Spike at grain filling stage under normal conditions | 2 |
| Spike at booting stage under normal conditions | 3 |
| Stem at booting stage under normal conditions | 4 |

Provided are the identification (ID) letters of each of the Barley expression sets.

Barley yield components and vigor related parameters assessment—55 Barley accessions in 5 repetitive blocks (named A, B, C, D and E), each containing 48 plants per plot were grown in field. Plants were phenotyped on a daily basis. Harvest was conducted while 50% of the spikes were dry to avoid spontaneous release of the seeds. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb(dot)nih(dot)gov/]. Next, analyzed data was saved to text files and processed using the JMP statistical analysis software (SAS institute).

At the end of the experiment (50% of the spikes were dry) all spikes from plots within blocks A-E were collected, and the following measurements were performed:

% reproductive tiller percentage—The percentage of reproductive tillers at flowering was performed using Formula XXVI above.

1000 grain weight (gr)—At the end of the experiment all grains from all plots were collected and weighted and the weight of 1000 were calculated.

Average seedling dry weight (gr)—Weight of seedling after drying/number of plants.

Average shoot dry weight (gr)—Weight of Shoot at flowering stage after drying/number of plants.

Average spike weight (g)—Calculate spikes dry weight after drying at 70° C. in oven for 48 hours, at harvest/num of spikes.

Average spike dry weight per plant (g)—At the end of the experiment the biomass and spikes weight of each plot was separated, measured and divided by the number of plants.

Vegetative dry weight (g)—Total weight of the vegetative portion above ground (excluding roots) after drying at 70° C. in oven for 48 hours. The biomass weight of each plot was measured and divided by the number of plants.

Field spike length (cm)—Measure spike length without the Awns at harvest.

Grain Area ($cm^2$)—A sample of ~200 grains were weighted, photographed and images were processed using the below described image processing system. The grain area was measured from those images and was divided by the number of grains.

Grain Length and Grain width (cm)—A sample of ~200 grains was weighted, photographed and images were processed using the below described image processing system. The sum of grain lengths and width (longest axis) was measured from those images and was divided by the number of grains.

Grain Perimeter (cm)—A sample of ~200 grains were weight, photographed and images were processed using the below described image processing system. The sum of grain perimeter was measured from those images and was divided by the number of grains.

Grains per spike—The total number of grains from 5 spikes that were manually threshed was counted. The average grain per spike was calculated by dividing the total grain number by the number of spikes.

Grain yield per plant (gr)—The total grains from 5 spikes that were manually threshed were weighted. The grain yield was calculated by dividing the total weight by the plants number.

Grain yield per spike (gr)—The total grains from 5 spikes that were manually threshed were weighted. The grain yield was calculated by dividing the total weight by the spike number.

Growth habit scoring—At growth stage 10 (booting), each of the plants was scored for its growth habit nature. The scale that was used was 1 for prostate nature till 9 for erect.

Harvest Index (for Barley)—The harvest index was performed using Formula XVIII (above).

Number days to anthesis—Calculated as the number of days from sowing till 50% of the plot arrive anthesis.

Number days to maturity—Calculated as the number of days from sowing till 50% of the plot arrive maturity.

Plant height—At harvest stage (50% of spikes were dry), each of the plants was measured for its height using measuring tape. Height was measured from ground level to top of the longest spike excluding awns.

Reproductive period—Calculate number of days from booting to maturity.

Reproductive tillers number—Number of Reproductive tillers with flag leaf at flowering.

Relative Growth Rate—RGR of vegetative dry weight was performed using Formula VII above.

Spike area ($cm^2$)—At the end of the growing period 5 'spikes' were photographed and images were processed using the below described image processing system. The 'spike' area was measured from those images and was divided by the number of 'spikes'.

Spike length and width analysis—At the end of the experiment the length and width of five chosen spikes per plant were measured using measuring tape excluding the awns.

Spike max width—Measured by imaging the max width of 10-15 spikes randomly distributed within a pre-defined 0.5 m2 of a plot. Measurements were carried out at the middle of the spike.

Spikes Index—The Spikes index was performed using Formula XXVII above.

Spike number analysis—The spikes per plant were counted at harvest.

No. of tillering—tillers were counted per plant at heading stage (mean per plot).

Total dry mater per plant—Calculated as Vegetative portion above ground plus all the spikes dry weight per plant.

TABLE 88

Barley correlated parameters (vectors)

| Correlated parameter with | Correlation ID |
| --- | --- |
| % reproductive tiller percentage (%) | 1 |
| 1000 grain weight (gr) | 2 |

TABLE 88-continued

Barley correlated parameters (vectors)

| Correlated parameter with | Correlation ID |
|---|---|
| Average spike dry weight per plant (H) (g) | 3 |
| Average vegetative dry weight per plant (H) (g) | 4 |
| Average shoot dry weight (F) (gr) | 5 |
| Average spike weight (H) (g) | 6 |
| Grain Perimeter (cm) | 7 |
| Grain Area (cm$^2$) | 8 |
| Grain Length (cm) | 9 |
| Grain width (cm) | 10 |
| Grains per spike (number) | 11 |
| Grain yield per plant (gr) | 12 |
| Grain yield per spike (gr) | 13 |
| Growth habit (scores 1-9) | 14 |
| Harvest Index (value) | 15 |
| Number days to anthesis (days) | 16 |
| Number days to maturity (days) | 17 |
| Plant height (cm) | 18 |
| RGR | 19 |
| Reproductive period (days) | 20 |
| Reproductive tillers number (F) (number) | 21 |
| Spike area (cm$^2$) | 22 |
| Spike length (cm) | 23 |
| Spike width (cm) | 24 |
| Spike max width (cm) | 25 |
| Spike index (cm) | 26 |
| Spikes per plant (numbers) | 27 |
| Tillering (Heading) (number) | 28 |
| Total dry matter per plant (kg) | 29 |
| Average seedling dry weight (gr) | 30 |
| Field spike length (cm) | 31 |

Provided are the Barley correlated parameters (vectors).

Experimental Results 55 different Barley accessions were grown and characterized for 31 parameters as described above. Among the 55 lines and ecotypes, 27 are *Hordeum spontaneum* and 19 are *Hordeum vulgare*. The average for each of the measured parameters of all Barley accessions was calculated using the JMP software and values are summarized in Tables 89-96 below. Subsequent correlation analysis across all 55 lines and ecotypes between the various transcriptome expression sets (Table 87) and the average parameters was conducted and results were integrated to the database (Table 104 below). Tables 97-100 show phenotypic data of *Hordeum spontaneum* lines and ecotypes, and the correlation data between the various transcriptome expression sets (Table 87) and the average parameters is shown in Table 105 below. Tables 101-103 show phenotypic data of *Hordeum vulgare* lines and ecotypes, and the correlation data between the various transcriptome expression sets (Table 87) and the average parameters is shown in Table 106 below.

TABLE 89

Measured parameters of correlation IDs in Barley accessions
Provided are the values of each of the parameters measured in Barley accessions (1-7) according to the correlation identifications (see Table 88).

| Ecotype/Treatment | Line-1 | Line-2 | Line-3 | Line-4 | Line-5 | Line-6 | Line-7 |
|---|---|---|---|---|---|---|---|
| 1 | 4.31 | 18.25 | 9.16 | 40.15 | 33.22 | NA | 7.86 |
| 2 | 50.11 | 49.98 | 31.77 | 52.43 | 47.22 | 49.33 | 53.02 |
| 3 | 80.88 | 60.47 | 36.42 | 69.45 | 61.03 | 63.22 | 88.26 |
| 4 | 46.33 | 85.03 | 82.74 | 127.37 | 79.51 | 82.95 | 68.92 |
| 5 | 11.34 | 52.57 | 48.28 | 126.89 | 60.56 | NA | 31.40 |
| 6 | 3.33 | 1.56 | 2.37 | 3.11 | 3.18 | 2.85 | 3.37 |
| 7 | 2.62 | 2.41 | 2.31 | 2.67 | 2.62 | 2.59 | 2.59 |
| 8 | 0.30 | 0.28 | 0.24 | 0.30 | 0.29 | 0.29 | 0.30 |
| 9 | 1.09 | 0.97 | 0.92 | 1.07 | 1.09 | 1.07 | 1.05 |
| 10 | 0.40 | 0.41 | 0.35 | 0.41 | 0.39 | 0.39 | 0.41 |
| 11 | 56.51 | 21.05 | 45.16 | 44.35 | 47.12 | 43.51 | 55.88 |
| 12 | 64.98 | 37.47 | NA | 51.69 | 49.15 | 46.44 | NA |
| 13 | 2.91 | 1.02 | 1.37 | 2.33 | 2.23 | 2.14 | 2.85 |
| 14 | 4.20 | 1.00 | 1.40 | 2.60 | 2.60 | 1.00 | 2.60 |
| 15 | 0.51 | 0.25 | NA | 0.26 | 0.35 | 0.32 | NA |
| 16 | 90.80 | 124.40 | 122.00 | NA | 122.00 | NA | 102.60 |
| 17 | 148.00 | 170.00 | 157.00 | 170.00 | 167.40 | 170.00 | 158.80 |
| 18 | 83.97 | 79.87 | 99.04 | 122.46 | 108.03 | 87.00 | 97.03 |
| 19 | 2.45 | 3.96 | 3.91 | 4.75 | 4.12 | NA | 3.24 |
| 20 | 57.20 | 45.60 | 35.00 | NA | 48.00 | NA | 56.20 |
| 21 | 1.00 | 9.20 | 5.00 | 19.20 | 14.63 | NA | 2.80 |
| 22 | 9.90 | 7.82 | 9.68 | 11.07 | 10.17 | 9.98 | 9.94 |
| 23 | 9.49 | 10.26 | 7.88 | 7.97 | 8.42 | 8.12 | 7.61 |
| 24 | 1.23 | 0.87 | 1.44 | 1.68 | 1.47 | 1.51 | 1.57 |
| 25 | 1.41 | 1.05 | 1.59 | 1.79 | 1.60 | 1.61 | 1.70 |
| 26 | 0.64 | 0.42 | 0.30 | 0.35 | 0.44 | 0.43 | 0.56 |
| 27 | 45.27 | 56.27 | 31.50 | 32.42 | 35.40 | 36.73 | 36.93 |
| 28 | 24.00 | 48.70 | 52.00 | 47.60 | 45.00 | NA | 35.20 |
| 29 | 127.22 | 145.50 | 119.15 | 196.82 | 140.54 | 146.17 | 157.18 |
| 30 | 0.053 | 0.059 | 0.044 | 0.051 | 0.053 | 0.047 | 0.066 |
| 31 | 9.57 | NA | 7.66 | 7.93 | 8.13 | NA | 7.21 |

Provided are the values of each of the parameters measured in Barley accessions (1-7) according to the correlation identifications (see Table 88).

TABLE 90

Barley accessions, additional measured parameters

| Ecotype/Treatment | Line-8 | Line-9 | Line-10 | Line-11 | Line-12 | Line-13 | Line-14 |
|---|---|---|---|---|---|---|---|
| 1 | 16.67 | 5.64 | 5.29 | 18.34 | 4.03 | 8.83 | 4.82 |
| 2 | 61.33 | 49.97 | 51.70 | 56.46 | 53.97 | 50.36 | 56.81 |
| 3 | 91.89 | 99.05 | 66.99 | 60.22 | 87.61 | 71.76 | 76.71 |
| 4 | 82.88 | 56.80 | 64.14 | 54.23 | 73.23 | 49.50 | 47.63 |
| 5 | 44.57 | 9.71 | 38.18 | 46.74 | 42.32 | 11.62 | 9.33 |
| 6 | 4.13 | 3.47 | 3.15 | 1.88 | 3.35 | 3.60 | 3.24 |
| 7 | 2.78 | 2.66 | 2.63 | 2.28 | 2.54 | 2.37 | 2.71 |
| 8 | 0.33 | 0.29 | 0.30 | 0.28 | 0.30 | 0.27 | 0.32 |
| 9 | 1.15 | 1.09 | 1.08 | 0.88 | 1.03 | 0.96 | 1.12 |
| 10 | 0.42 | 0.39 | 0.39 | 0.45 | 0.42 | 0.41 | 0.41 |
| 11 | 58.33 | 56.03 | 59.08 | 27.27 | 55.87 | 61.53 | 50.80 |
| 12 | 78.18 | 79.86 | 54.34 | 46.37 | 71.89 | 56.24 | 61.63 |
| 13 | 3.47 | 2.60 | 2.84 | 1.51 | 2.84 | 2.98 | 2.85 |
| 14 | 1.00 | 5.00 | 3.00 | 1.00 | 1.00 | 2.20 | 3.00 |
| 15 | 0.45 | 0.51 | 0.41 | 0.40 | 0.45 | 0.48 | 0.50 |
| 16 | 111.60 | 86.80 | 106.20 | 117.80 | 111.60 | 85.40 | 90.00 |
| 17 | 156.20 | 159.60 | 157.00 | 162.20 | 159.60 | 157.00 | 150.50 |
| 18 | 104.01 | 70.78 | 98.11 | 57.88 | 94.52 | 73.20 | 78.65 |
| 19 | 3.82 | 2.30 | 3.60 | 3.83 | 3.63 | 2.43 | 2.26 |
| 20 | 44.60 | 72.80 | 50.80 | 44.40 | 46.00 | 71.60 | 61.50 |
| 21 | 6.30 | 1.20 | 2.10 | 10.00 | 2.60 | 1.63 | 1.00 |
| 22 | 9.89 | 9.58 | 11.19 | 8.76 | 10.49 | 10.83 | 11.23 |
| 23 | 6.39 | 7.73 | 8.45 | 10.55 | 7.60 | 7.87 | 9.42 |
| 24 | 1.83 | 1.50 | 1.57 | 0.96 | 1.63 | 1.63 | 1.43 |
| 25 | 1.93 | 1.59 | 1.71 | 1.17 | 1.75 | 1.72 | 1.58 |
| 26 | 0.51 | 0.64 | 0.51 | 0.53 | 0.55 | 0.61 | 0.62 |
| 27 | 32.10 | 48.53 | 29.80 | 50.80 | 32.40 | 26.80 | 42.42 |
| 28 | 38.50 | 21.50 | 36.10 | 57.25 | 42.20 | 19.13 | 21.63 |
| 29 | 178.63 | 155.85 | 131.13 | 114.45 | 160.84 | 121.26 | 124.34 |
| 30 | 0.052 | 0.062 | 0.051 | 0.062 | 0.060 | 0.056 | 0.045 |
| 31 | 5.65 | 7.94 | 8.55 | 10.59 | 7.44 | 7.36 | 9.60 |

Provided are the values of each of the parameters measured in Barley accessions (8-14) according to the correlation identifications (see Table 88).

TABLE 91

Barley accessions, additional measured parameters

| Ecotype/Treatment | Line-15 | Line-16 | Line-17 | Line-18 | Line-19 | Line-20 | Line-21 |
|---|---|---|---|---|---|---|---|
| 1 | 29.49 | 5.01 | 3.74 | 11.42 | 5.13 | 4.07 | 6.62 |
| 2 | 57.98 | 51.44 | 58.07 | 53.45 | 48.66 | 39.48 | 41.96 |
| 3 | 81.14 | 77.90 | 68.17 | 70.73 | 54.13 | 48.72 | 64.51 |
| 4 | 66.51 | 77.50 | 81.58 | 67.92 | 81.05 | 66.73 | 91.79 |
| 5 | 47.56 | 30.93 | NA | 35.49 | 38.41 | NA | 41.56 |
| 6 | 3.12 | 1.69 | 1.66 | 3.50 | 1.16 | 2.95 | 1.36 |
| 7 | 2.90 | 2.28 | 2.42 | 2.65 | 2.16 | 2.16 | 2.45 |
| 8 | 0.34 | 0.27 | 0.30 | 0.30 | 0.26 | 0.23 | 0.23 |
| 9 | 1.22 | 0.89 | 0.96 | 1.08 | 0.83 | 0.85 | 0.94 |
| 10 | 0.41 | 0.42 | 0.44 | 0.40 | 0.42 | 0.39 | 0.36 |
| 11 | 45.48 | 24.77 | 21.15 | 59.72 | 17.46 | 63.19 | 19.87 |
| 12 | 64.82 | 56.43 | 49.68 | 54.97 | 40.33 | NA | NA |
| 13 | 2.39 | 1.21 | 1.18 | 2.93 | 0.83 | 2.38 | 0.78 |
| 14 | 1.00 | 1.00 | 3.80 | 3.80 | 1.00 | 3.40 | 1.00 |
| 15 | 0.44 | 0.36 | 0.33 | 0.40 | 0.29 | NA | NA |
| 16 | 113.20 | 113.40 | 98.50 | 109.60 | 119.40 | 98.80 | 119.40 |
| 17 | 158.00 | 170.00 | 170.00 | 155.20 | 170.00 | 156.20 | 170.00 |
| 18 | 90.73 | 64.27 | 82.73 | 94.12 | 63.47 | 102.12 | 94.80 |
| 19 | 3.89 | 3.46 | NA | 3.60 | 3.64 | NA | 3.74 |
| 20 | 44.80 | 56.60 | 71.50 | 45.60 | 50.60 | 57.40 | 50.60 |
| 21 | 17.00 | 3.00 | 1.00 | 3.80 | 4.20 | 1.00 | 4.63 |
| 22 | 7.89 | 9.15 | 8.57 | 11.30 | 7.04 | 8.37 | 7.28 |
| 23 | 6.68 | 12.05 | 10.74 | 8.60 | 8.94 | 6.03 | 10.99 |
| 24 | 1.45 | 0.88 | 0.92 | 1.56 | 0.92 | 1.67 | 0.76 |
| 25 | 1.52 | 1.03 | 1.10 | 1.72 | 1.08 | 1.75 | 0.90 |
| 26 | 0.55 | 0.50 | 0.45 | 0.51 | 0.39 | 0.42 | 0.41 |
| 27 | 39.73 | 71.33 | 65.40 | 33.27 | 82.47 | 32.87 | 73.13 |

TABLE 91-continued

Barley accessions, additional measured parameters

| Ecotype/Treatment | Line-15 | Line-16 | Line-17 | Line-18 | Line-19 | Line-20 | Line-21 |
|---|---|---|---|---|---|---|---|
| 28 | 59.80 | 62.50 | 31.20 | 34.00 | 78.90 | 26.50 | 69.88 |
| 29 | 147.66 | 155.41 | 149.76 | 138.64 | 135.18 | 115.45 | 156.29 |
| 30 | 0.051 | 0.037 | 0.047 | 0.043 | 0.056 | 0.053 | 0.055 |
| 31 | 6.23 | NA | NA | 8.57 | NA | 6.26 | NA |

Provided are the values of each of the parameters measured in Barley accessions (15-21) according to the correlation identifications (see Table 88).

TABLE 92

Barley accessions, additional measured parameters

| Ecotype/Treatment | Line-22 | Line-23 | Line-24 | Line-25 | Line-26 | Line-27 | Line-28 |
|---|---|---|---|---|---|---|---|
| 1 | 3.51 | 7.34 | 31.12 | NA | NA | 11.07 | 21.67 |
| 2 | 18.60 | 42.65 | 39.67 | 24.43 | 28.42 | 28.40 | 23.52 |
| 3 | 33.60 | 33.22 | 52.10 | 33.28 | 47.69 | 52.78 | 52.54 |
| 4 | 50.17 | 45.22 | 67.20 | 43.40 | 79.51 | 61.09 | 59.71 |
| 5 | 174.82 | 8.39 | 51.83 | NA | NA | 38.46 | 38.79 |
| 6 | 0.90 | 3.09 | 1.22 | 0.91 | 0.92 | 1.08 | 0.95 |
| 7 | 2.65 | 2.19 | 2.44 | 2.90 | 2.62 | 2.66 | 2.68 |
| 8 | 0.25 | 0.25 | 0.25 | 0.27 | 0.25 | 0.25 | 0.24 |
| 9 | 1.11 | 0.88 | 0.96 | 1.20 | 1.07 | 1.08 | 1.11 |
| 10 | 0.31 | 0.39 | 0.37 | 0.32 | 0.32 | 0.33 | 0.31 |
| 11 | 16.30 | 60.49 | 17.54 | 12.00 | 20.01 | 20.00 | 17.01 |
| 12 | NA | NA | NA | NA | NA | NA | NA |
| 13 | 0.31 | 2.43 | 0.67 | 0.31 | 0.56 | 0.56 | 0.38 |
| 14 | 1.00 | 3.00 | 1.00 | 1.00 | 1.00 | 1.00 | 1.00 |
| 15 | NA | NA | NA | NA | NA | NA | NA |
| 16 | 95.60 | 90.00 | 111.00 | 83.60 | 122.00 | 111.40 | 109.20 |
| 17 | 133.00 | 161.40 | 145.80 | 140.20 | 153.00 | 143.00 | 140.40 |
| 18 | 90.49 | 88.53 | 90.10 | 92.47 | 99.08 | 91.69 | 94.67 |
| 19 | 5.01 | 2.12 | 3.97 | NA | NA | 3.67 | 3.68 |
| 20 | 37.40 | 71.40 | 34.80 | 56.60 | 31.00 | 31.60 | 31.20 |
| 21 | 1.88 | 1.00 | 15.50 | NA | NA | 7.10 | 15.70 |
| 22 | 4.98 | 11.56 | 6.52 | 5.39 | 8.16 | 8.08 | 5.73 |
| 23 | 8.58 | 9.02 | 8.63 | 7.96 | 10.20 | 10.52 | 8.35 |
| 24 | 0.68 | 1.53 | 0.88 | 0.81 | 0.97 | 0.92 | 0.78 |
| 25 | 0.79 | 1.68 | 1.01 | 0.88 | 1.05 | 1.01 | 0.90 |
| 26 | 0.41 | 0.42 | 0.44 | 0.44 | 0.38 | 0.46 | 0.47 |
| 27 | 88.07 | 20.53 | 48.53 | 51.33 | 65.80 | 55.80 | 65.60 |
| 28 | 55.25 | 14.00 | 48.50 | NA | NA | 69.00 | 76.40 |
| 29 | 83.76 | 78.44 | 119.30 | 76.68 | 127.20 | 113.88 | 112.25 |
| 30 | 0.027 | 0.058 | 0.047 | 0.048 | 0.044 | 0.045 | 0.046 |
| 31 | 9.74 | 9.06 | 8.69 | 8.90 | 10.13 | 10.61 | 9.60 |

Provided are the values of each of the parameters measured in Barley accessions (22-28) according to the correlation identifications (see Table 88).

TABLE 93

Barley accessions, additional measured parameters

| Ecotype/Treatment | Line-29 | Line-30 | Line-31 | Line-32 | Line-33 | Line-34 | Line-35 |
|---|---|---|---|---|---|---|---|
| 1 | 3.93 | 16.51 | 3.19 | 10.55 | 26.51 | 15.15 | 4.28 |
| 2 | 45.71 | 26.47 | 23.14 | 27.64 | 29.37 | 27.74 | 42.12 |
| 3 | 83.98 | 47.05 | 48.92 | 47.26 | 48.82 | 46.56 | 89.21 |
| 4 | 45.36 | 60.37 | 67.39 | 67.12 | 61.35 | 59.03 | 71.31 |
| 5 | 10.63 | 29.60 | 14.28 | 37.74 | 39.23 | 34.46 | 41.16 |
| 6 | 2.99 | 0.85 | 0.85 | 0.89 | 1.10 | 1.09 | 2.93 |
| 7 | 2.77 | 2.66 | 2.57 | 2.93 | 3.16 | 2.99 | 2.97 |
| 8 | 0.30 | 0.25 | 0.24 | 0.29 | 0.33 | 0.29 | 0.30 |
| 9 | 1.13 | 1.09 | 1.06 | 1.23 | 1.33 | 1.27 | 1.16 |
| 10 | 0.39 | 0.32 | 0.32 | 0.33 | 0.34 | 0.32 | 0.39 |
| 11 | 56.85 | 18.19 | 13.50 | 12.83 | 14.49 | 13.72 | 54.84 |
| 12 | NA | NA | NA | NA | NA | NA | NA |
| 13 | 2.63 | 0.46 | 0.31 | 0.37 | 0.43 | 0.39 | 2.14 |
| 14 | 2.20 | 1.00 | 1.00 | 1.00 | 1.00 | 1.00 | 1.00 |
| 15 | NA | NA | NA | NA | NA | NA | NA |

TABLE 93-continued

Barley accessions, additional measured parameters

| Ecotype/Treatment | Line-29 | Line-30 | Line-31 | Line-32 | Line-33 | Line-34 | Line-35 |
|---|---|---|---|---|---|---|---|
| 16 | 89.20 | 104.00 | 89.20 | 97.80 | 113.60 | 109.20 | 110.40 |
| 17 | 151.60 | 140.20 | 140.40 | 140.40 | 145.80 | 143.00 | 156.20 |
| 18 | 66.65 | 105.78 | 112.21 | 103.83 | 105.74 | 107.45 | 100.65 |
| 19 | 2.37 | 3.42 | 2.67 | 3.64 | 3.65 | 3.51 | 3.74 |
| 20 | 62.40 | 36.20 | 51.20 | 42.60 | 32.20 | 33.80 | 45.80 |
| 21 | 1.00 | 12.30 | 1.10 | 8.50 | 18.67 | 11.00 | 2.50 |
| 22 | 8.94 | 4.69 | 5.47 | 5.92 | 6.16 | 6.88 | 11.03 |
| 23 | 7.75 | 6.85 | 8.51 | 8.32 | 9.80 | 9.28 | 8.77 |
| 24 | 1.37 | 0.81 | 0.75 | 0.83 | 0.74 | 0.88 | 1.53 |
| 25 | 1.52 | 0.91 | 0.85 | 0.96 | 0.82 | 0.94 | 1.60 |
| 26 | 0.65 | 0.44 | 0.42 | 0.41 | 0.41 | 0.44 | 0.56 |
| 27 | 44.87 | 77.13 | 85.00 | 67.53 | 50.87 | 55.67 | 38.60 |
| 28 | 26.50 | 76.60 | 35.30 | 75.30 | 68.50 | 66.80 | 55.80 |
| 29 | 129.34 | 107.42 | 116.31 | 114.38 | 104.47 | 105.59 | 160.52 |
| 30 | 0.049 | 0.037 | 0.044 | 0.047 | 0.042 | 0.056 | 0.051 |
| 31 | 7.97 | 8.24 | 9.14 | 8.71 | 9.82 | 10.00 | 8.47 |

Provided are the values of each of the parameters measured in Barley accessions (29-35) according to the correlation identifications (see Table 88).

TABLE 94

Barley accessions, additional measured parameters

| Ecotype/Treatment | Line-36 | Line-37 | Line-38 | Line-39 | Line-40 | Line-41 | Line-42 |
|---|---|---|---|---|---|---|---|
| 1 | 9.46 | 4.75 | NA | 4.60 | 21.49 | 21.20 | 14.49 |
| 2 | 26.38 | 19.78 | 31.00 | 47.79 | 32.57 | 36.89 | 24.24 |
| 3 | 43.46 | 27.36 | 44.56 | 69.91 | 44.21 | 50.54 | 44.04 |
| 4 | 48.56 | 31.46 | 59.31 | 43.15 | 72.36 | 91.79 | 63.37 |
| 5 | 23.84 | 11.91 | NA | 8.31 | 55.42 | 55.88 | 31.34 |
| 6 | 0.74 | 1.15 | 1.32 | 3.51 | 1.45 | 1.40 | 0.93 |
| 7 | 3.17 | 2.74 | 2.69 | 2.93 | 2.38 | 2.67 | 3.05 |
| 8 | 0.30 | 0.26 | 0.26 | 0.32 | 0.23 | 0.28 | 0.30 |
| 9 | 1.30 | 1.11 | 1.10 | 1.21 | 0.95 | 1.09 | 1.28 |
| 10 | 0.31 | 0.32 | 0.33 | 0.39 | 0.33 | 0.36 | 0.33 |
| 11 | 11.25 | 16.11 | 21.71 | 58.20 | 34.19 | 20.75 | 11.50 |
| 12 | NA | NA | NA | NA | NA | NA | NA |
| 13 | 0.24 | 0.32 | 0.66 | 2.82 | 0.94 | 0.75 | 0.31 |
| 14 | 1.00 | 1.00 | 1.00 | 3.80 | 1.00 | 1.40 | 1.00 |
| 15 | NA | NA | NA | NA | NA | NA | NA |
| 16 | 108.40 | 91.60 | 115.60 | 84.20 | 118.00 | 116.80 | 111.00 |
| 17 | 140.40 | 133.00 | 145.80 | 148.00 | 153.80 | 144.20 | 140.20 |
| 18 | 106.34 | 78.29 | 107.63 | 77.57 | 93.91 | 126.08 | 107.15 |
| 19 | 3.17 | 2.50 | NA | 2.12 | 4.03 | NA | 3.44 |
| 20 | 32.00 | 41.40 | 30.20 | 63.80 | 36.00 | 27.40 | 29.25 |
| 21 | 7.40 | 1.50 | NA | 0.81 | 14.80 | 15.50 | 10.70 |
| 22 | 5.17 | 7.72 | 8.37 | 7.41 | 7.83 | 8.38 | 5.09 |
| 23 | 7.81 | 11.96 | 11.32 | 7.52 | 8.33 | 10.12 | 8.27 |
| 24 | 0.79 | 0.75 | 0.86 | 1.16 | 1.15 | 0.99 | 0.72 |
| 25 | 0.91 | 0.92 | 0.94 | 1.31 | 1.24 | 1.06 | 0.82 |
| 26 | 0.47 | 0.48 | 0.43 | 0.62 | 0.37 | 0.36 | 0.41 |
| 27 | 64.67 | 50.93 | 48.40 | 32.00 | 43.40 | 45.80 | 73.53 |
| 28 | 69.30 | 32.20 | NA | 15.81 | 66.40 | 75.13 | 71.20 |
| 29 | 92.02 | 58.82 | 110.88 | 113.06 | 116.57 | 149.88 | 107.41 |
| 30 | 0.056 | 0.033 | 0.036 | 0.062 | 0.049 | NA | 0.057 |
| 31 | 8.36 | 12.49 | 11.03 | 8.21 | 7.97 | 10.44 | 8.66 |

Provided are the values of each of the parameters measured in Barley accessions (36-42) according to the correlation identifications (see Table 88).

TABLE 95

Barley accessions, additional measured parameters

| Ecotype/Treatment | Line-43 | Line-44 | Line-45 | Line-46 | Line-47 | Line-48 | Line-49 |
|---|---|---|---|---|---|---|---|
| 1 | 17.05 | 12.52 | 9.87 | 10.75 | 10.80 | 14.99 | 16.12 |
| 2 | 27.81 | 23.34 | 31.77 | 27.36 | 25.70 | 24.92 | 26.31 |
| 3 | 50.12 | 40.37 | 55.92 | 33.55 | 31.74 | 50.70 | 44.59 |

TABLE 95-continued

Barley accessions, additional measured parameters

| Ecotype/Treatment | Line-43 | Line-44 | Line-45 | Line-46 | Line-47 | Line-48 | Line-49 |
|---|---|---|---|---|---|---|---|
| 4 | 69.41 | 58.51 | 61.56 | 42.29 | 41.24 | 71.38 | 73.03 |
| 5 | 32.88 | 35.99 | 42.56 | 19.47 | 26.16 | 39.22 | 49.89 |
| 6 | 0.96 | 0.82 | 1.34 | 1.16 | 1.18 | 0.94 | 1.05 |
| 7 | 2.77 | 2.94 | 3.18 | 3.06 | 2.75 | 2.62 | 2.99 |
| 8 | 0.26 | 0.29 | 0.33 | 0.30 | 0.26 | 0.24 | 0.29 |
| 9 | 1.14 | 1.25 | 1.32 | 1.25 | 1.13 | 1.06 | 1.25 |
| 10 | 0.33 | 0.32 | 0.35 | 0.34 | 0.32 | 0.32 | 0.33 |
| 11 | 17.55 | 10.65 | 15.98 | 14.58 | 17.44 | 18.90 | 14.60 |
| 12 | NA | NA | NA | NA | NA | NA | NA |
| 13 | 0.47 | 0.25 | 0.53 | 0.43 | 0.45 | 0.47 | 0.40 |
| 14 | 1.00 | 1.00 | 1.00 | 1.00 | 1.00 | 1.00 | 1.00 |
| 15 | NA | NA | NA | NA | NA | NA | NA |
| 16 | 111.00 | 111.00 | 111.00 | 99.20 | 105.80 | 111.00 | 117.20 |
| 17 | 146.00 | 140.20 | 143.00 | 133.00 | 133.00 | 143.00 | 148.20 |
| 18 | 106.69 | 96.26 | 99.81 | 91.75 | 80.80 | 105.57 | 101.87 |
| 19 | 3.52 | 3.60 | 3.75 | 2.94 | 3.29 | 3.68 | 3.84 |
| 20 | 35.00 | 29.20 | 32.00 | 33.80 | 27.20 | 32.00 | 31.00 |
| 21 | 15.00 | 11.70 | 6.90 | 5.50 | 10.30 | 12.40 | 13.33 |
| 22 | 5.03 | 4.88 | 8.33 | 7.43 | 6.71 | 6.61 | 7.10 |
| 23 | 8.45 | 7.95 | 10.21 | 11.52 | 10.17 | 9.09 | 9.79 |
| 24 | 0.65 | 0.72 | 0.96 | 0.76 | 0.77 | 0.94 | 0.85 |
| 25 | 0.76 | 0.82 | 1.04 | 0.91 | 0.92 | 0.97 | 0.95 |
| 26 | 0.42 | 0.41 | 0.48 | 0.44 | 0.46 | 0.42 | 0.38 |
| 27 | 79.33 | 61.67 | 49.13 | 55.10 | 56.67 | 62.20 | 70.93 |
| 28 | 86.70 | 90.70 | 71.40 | 58.50 | 90.90 | 87.50 | 108.50 |
| 29 | 119.53 | 98.88 | 117.49 | 75.84 | 72.98 | 122.08 | 117.62 |
| 30 | 0.040 | 0.034 | 0.048 | 0.045 | 0.039 | 0.065 | 0.046 |
| 31 | 9.91 | 8.51 | 10.18 | 11.82 | 10.58 | 9.42 | 10.04 |

Provided are the values of each of the parameters measured in Barley accessions (43-49) according to the correlation identifications (see Table 88).

TABLE 96

Barley accessions, additional measured parameters

| Ecotype/Treatment | Line-50 | Line-51 | Line-52 | Line-53 | Line-54 | Line-55 |
|---|---|---|---|---|---|---|
| 1 | 31.13 | NA | 15.51 | 6.88 | 7.07 | 6.72 |
| 2 | 30.08 | 24.82 | 26.46 | 21.49 | 43.66 | 47.91 |
| 3 | 36.91 | 26.20 | 57.49 | 47.76 | 43.70 | 68.61 |
| 4 | 50.75 | 52.91 | 73.30 | 65.81 | 56.28 | NA |
| 5 | 37.91 | NA | 38.72 | 29.92 | 14.62 | 67.47 |
| 6 | 1.01 | 1.01 | 0.84 | 0.75 | 3.71 | 2.78 |
| 7 | 3.06 | 3.24 | 2.90 | 2.65 | 2.24 | 2.56 |
| 8 | 0.31 | 0.32 | 0.26 | 0.25 | 0.25 | 0.28 |
| 9 | 1.26 | 1.36 | 1.17 | 1.10 | 0.88 | 1.05 |
| 10 | 0.35 | 0.33 | 0.32 | 0.31 | 0.40 | 0.38 |
| 11 | 13.58 | 13.07 | 19.84 | 17.16 | 65.39 | 43.77 |
| 12 | NA | NA | NA | NA | 34.58 | 53.97 |
| 13 | 0.40 | 0.32 | 0.50 | 0.38 | 2.64 | 2.06 |
| 14 | 1.00 | 1.00 | 1.00 | 1.00 | 5.00 | 1.80 |
| 15 | NA | NA | NA | NA | 0.35 | NA |
| 16 | 113.00 | 122.60 | 111.00 | 107.60 | 88.40 | 128.00 |
| 17 | 143.60 | 152.00 | 142.40 | 140.40 | 157.00 | 170.00 |
| 18 | 95.35 | 80.26 | 105.02 | 98.42 | 93.79 | 90.30 |
| 19 | NA | NA | 3.66 | 3.41 | 2.18 | 4.23 |
| 20 | 30.60 | 29.40 | 31.40 | 32.80 | 68.60 | 42.00 |
| 21 | 20.20 | NA | 18.30 | 6.60 | 2.50 | 3.10 |
| 22 | 6.86 | 8.62 | 7.16 | 5.75 | 10.74 | 10.04 |
| 23 | 9.38 | 11.73 | 10.01 | 8.78 | 8.54 | 8.59 |
| 24 | 0.87 | 0.87 | 0.86 | 0.77 | 1.49 | 1.45 |
| 25 | 0.94 | 0.97 | 0.94 | 0.89 | 1.68 | 1.57 |
| 26 | 0.42 | 0.33 | 0.44 | 0.42 | 0.44 | NA |
| 27 | 39.27 | 45.00 | 74.58 | 74.53 | 20.80 | 38.00 |
| 28 | 64.60 | NA | 113.50 | 95.60 | 15.60 | 43.20 |
| 29 | 87.66 | 79.11 | 130.79 | 113.58 | 99.98 | NA |
| 30 | NA | 0.040 | 0.040 | 0.045 | 0.053 | 0.054 |
| 31 | 9.41 | 11.67 | 10.60 | 9.72 | 8.26 | 9.22 |

Provided are the values of each of the parameters measured in Barley accessions (50-55) according to the correlation identifications (see Table 88).

TABLE 97

Measured parameters of correlation Ids in Barley Hordeum spontaneum accessions

| Ecotype/Treatment | Line-21 | Line-22 | Line-24 | Line-25 | Line-26 | Line-27 | Line-28 |
|---|---|---|---|---|---|---|---|
| 1 | 6.62 | 3.51 | 31.12 | NA | NA | 11.07 | 21.67 |
| 2 | 41.96 | 18.60 | 39.67 | 24.43 | 28.42 | 28.40 | 23.52 |
| 3 | 64.51 | 33.60 | 52.10 | 33.28 | 47.69 | 52.78 | 52.54 |
| 4 | 91.79 | 50.17 | 67.20 | 43.40 | 79.51 | 61.09 | 59.71 |
| 5 | 41.56 | 174.82 | 51.83 | NA | NA | 38.46 | 38.79 |
| 6 | 1.36 | 0.90 | 1.22 | 0.91 | 0.92 | 1.08 | 0.95 |
| 7 | 2.45 | 2.65 | 2.44 | 2.90 | 2.62 | 2.66 | 2.68 |
| 8 | 0.23 | 0.25 | 0.25 | 0.27 | 0.25 | 0.25 | 0.24 |
| 9 | 0.94 | 1.11 | 0.96 | 1.20 | 1.07 | 1.08 | 1.11 |
| 10 | 0.36 | 0.31 | 0.37 | 0.32 | 0.32 | 0.33 | 0.31 |

TABLE 97-continued

Measured parameters of correlation Ids in Barley Hordeum spontaneum accessions

| Ecotype/Treatment | Line-21 | Line-22 | Line-24 | Line-25 | Line-26 | Line-27 | Line-28 |
|---|---|---|---|---|---|---|---|
| 11 | 19.87 | 16.30 | 17.54 | 12.00 | 20.01 | 20.00 | 17.01 |
| 12 | NA | NA | NA | NA | NA | NA | NA |
| 13 | 0.78 | 0.31 | 0.67 | 0.31 | 0.56 | 0.56 | 0.38 |
| 14 | 1.00 | 1.00 | 1.00 | 1.00 | 1.00 | 1.00 | 1.00 |
| 15 | NA | NA | NA | NA | NA | NA | NA |
| 16 | 119.40 | 95.60 | 111.00 | 83.60 | 122.00 | 111.40 | 109.20 |
| 17 | 170.00 | 133.00 | 145.80 | 140.20 | 153.00 | 143.00 | 140.40 |
| 18 | 94.80 | 90.49 | 90.10 | 92.47 | 99.08 | 91.69 | 94.67 |
| 19 | 3.74 | 5.01 | 3.97 | NA | NA | 3.67 | 3.68 |
| 20 | 50.60 | 37.40 | 34.80 | 56.60 | 31.00 | 31.60 | 31.20 |
| 21 | 4.63 | 1.88 | 15.50 | NA | NA | 7.10 | 15.70 |
| 22 | 7.28 | 4.98 | 6.52 | 5.39 | 8.16 | 8.08 | 5.73 |
| 23 | 10.99 | 8.58 | 8.63 | 7.96 | 10.20 | 10.52 | 8.35 |
| 24 | 0.76 | 0.68 | 0.88 | 0.81 | 0.97 | 0.92 | 0.78 |
| 25 | 0.90 | 0.79 | 1.01 | 0.88 | 1.05 | 1.01 | 0.90 |
| 26 | 0.41 | 0.41 | 0.44 | 0.44 | 0.38 | 0.46 | 0.47 |
| 27 | 73.13 | 88.07 | 48.53 | 51.33 | 65.80 | 55.80 | 65.60 |
| 28 | 69.88 | 55.25 | 48.50 | NA | NA | 69.00 | 76.40 |
| 29 | 156.29 | 83.76 | 119.30 | 76.68 | 127.20 | 113.88 | 112.25 |
| 30 | 0.055 | 0.027 | 0.047 | 0.048 | 0.044 | 0.045 | 0.046 |
| 31 | NA | 9.74 | 8.69 | 8.90 | 10.13 | 10.61 | 9.60 |

Provided are the values of each of the parameters measured in Barley *Hordeum spontaneum* accessions (21-22, 24-28) according to the correlation identifications (see Table 88).

TABLE 98

Measured parameters of correlation Ids in Barley Hordeum spontaneum accessions

| Ecotype/Treatment | Line-30 | Line-31 | Line-32 | Line-33 | Line-34 | Line-36 | Line-37 |
|---|---|---|---|---|---|---|---|
| 1 | 16.51 | 3.19 | 10.55 | 26.51 | 15.15 | 9.46 | 4.75 |
| 2 | 26.47 | 23.14 | 27.64 | 29.37 | 27.74 | 26.38 | 19.78 |
| 3 | 47.05 | 48.92 | 47.26 | 48.82 | 46.56 | 43.46 | 27.36 |
| 4 | 60.37 | 67.39 | 67.12 | 61.35 | 59.03 | 48.56 | 31.46 |
| 5 | 29.60 | 14.28 | 37.74 | 39.23 | 34.46 | 23.84 | 11.91 |
| 6 | 0.85 | 0.85 | 0.89 | 1.10 | 1.09 | 0.74 | 1.15 |
| 7 | 2.66 | 2.57 | 2.93 | 3.16 | 2.99 | 3.17 | 2.74 |
| 8 | 0.25 | 0.24 | 0.29 | 0.33 | 0.29 | 0.30 | 0.26 |
| 9 | 1.09 | 1.06 | 1.23 | 1.33 | 1.27 | 1.30 | 1.11 |
| 10 | 0.32 | 0.32 | 0.33 | 0.34 | 0.32 | 0.31 | 0.32 |
| 11 | 18.19 | 13.50 | 12.83 | 14.49 | 13.72 | 11.25 | 16.11 |
| 12 | NA | NA | NA | NA | NA | NA | NA |
| 13 | 0.46 | 0.31 | 0.37 | 0.43 | 0.39 | 0.24 | 0.32 |
| 14 | 1.00 | 1.00 | 1.00 | 1.00 | 1.00 | 1.00 | 1.00 |
| 15 | NA | NA | NA | NA | NA | NA | NA |
| 16 | 104.00 | 89.20 | 97.80 | 113.60 | 109.20 | 108.40 | 91.60 |
| 17 | 140.20 | 140.40 | 140.40 | 145.80 | 143.00 | 140.40 | 133.00 |
| 18 | 105.78 | 112.21 | 103.83 | 105.74 | 107.45 | 106.34 | 78.29 |
| 19 | 3.42 | 2.67 | 3.64 | 3.65 | 3.51 | 3.17 | 2.50 |
| 20 | 36.20 | 51.20 | 42.60 | 32.20 | 33.80 | 32.00 | 41.40 |
| 21 | 12.30 | 1.10 | 8.50 | 18.67 | 11.00 | 7.40 | 1.50 |
| 22 | 4.69 | 5.47 | 5.92 | 6.16 | 6.88 | 5.17 | 7.72 |
| 23 | 6.85 | 8.51 | 8.32 | 9.80 | 9.28 | 7.81 | 11.96 |
| 24 | 0.81 | 0.75 | 0.83 | 0.74 | 0.88 | 0.79 | 0.75 |
| 25 | 0.91 | 0.85 | 0.96 | 0.82 | 0.94 | 0.91 | 0.92 |
| 26 | 0.44 | 0.42 | 0.41 | 0.41 | 0.44 | 0.47 | 0.48 |
| 27 | 77.13 | 85.00 | 67.53 | 50.87 | 55.67 | 64.67 | 50.93 |
| 28 | 76.60 | 35.30 | 75.30 | 68.50 | 66.80 | 69.30 | 32.20 |
| 29 | 107.42 | 116.31 | 114.38 | 104.47 | 105.59 | 92.02 | 58.82 |
| 30 | 0.037 | 0.044 | 0.047 | 0.042 | 0.056 | 0.056 | 0.033 |
| 31 | 8.24 | 9.14 | 8.71 | 9.82 | 10.00 | 8.36 | 12.49 |

Provided are the values of each of the parameters measured in Barley *Hordeum spontaneum* accessions (30-34, 36-37) according to the correlation identifications (see Table 88).

TABLE 99

Measured parameters of correlation Ids in Barley Hordeum spontaneum accessions

| Ecotype/Treatment | Line-38 | Line-41 | Line-42 | Line-43 | Line-44 | Line-45 | Line-46 |
|---|---|---|---|---|---|---|---|
| 1 | NA | 21.20 | 14.49 | 17.05 | 12.52 | 9.87 | 10.75 |
| 2 | 31.00 | 36.89 | 24.24 | 27.81 | 23.34 | 31.77 | 27.36 |
| 3 | 44.56 | 50.54 | 44.04 | 50.12 | 40.37 | 55.92 | 33.55 |
| 4 | 59.31 | 91.79 | 63.37 | 69.41 | 58.51 | 61.56 | 42.29 |
| 5 | NA | 55.88 | 31.34 | 32.88 | 35.99 | 42.56 | 19.47 |
| 6 | 1.32 | 1.40 | 0.93 | 0.96 | 0.82 | 1.34 | 1.16 |
| 7 | 2.69 | 2.67 | 3.05 | 2.77 | 2.94 | 3.18 | 3.06 |
| 8 | 0.26 | 0.28 | 0.30 | 0.26 | 0.29 | 0.33 | 0.30 |
| 9 | 1.10 | 1.09 | 1.28 | 1.14 | 1.25 | 1.32 | 1.25 |
| 10 | 0.33 | 0.36 | 0.33 | 0.33 | 0.32 | 0.35 | 0.34 |
| 11 | 21.71 | 20.75 | 11.50 | 17.55 | 10.65 | 15.98 | 14.58 |
| 12 | NA | NA | NA | NA | NA | NA | NA |
| 13 | 0.66 | 0.75 | 0.31 | 0.47 | 0.25 | 0.53 | 0.43 |
| 14 | 1.00 | 1.40 | 1.00 | 1.00 | 1.00 | 1.00 | 1.00 |
| 15 | NA | NA | NA | NA | NA | NA | NA |
| 16 | 115.60 | 116.80 | 111.00 | 111.00 | 111.00 | 111.00 | 99.20 |
| 17 | 145.80 | 144.20 | 140.20 | 146.00 | 140.20 | 143.00 | 133.00 |
| 18 | 107.63 | 126.08 | 107.15 | 106.69 | 96.26 | 99.81 | 91.75 |
| 19 | NA | NA | 3.44 | 3.52 | 3.60 | 3.75 | 2.94 |
| 20 | 30.20 | 27.40 | 29.25 | 35.00 | 29.20 | 32.00 | 33.80 |
| 21 | NA | 15.50 | 10.70 | 15.00 | 11.70 | 6.90 | 5.50 |
| 22 | 8.37 | 8.38 | 5.09 | 5.03 | 4.88 | 8.33 | 7.43 |
| 23 | 11.32 | 10.12 | 8.27 | 8.45 | 7.95 | 10.21 | 11.52 |
| 24 | 0.86 | 0.99 | 0.72 | 0.65 | 0.72 | 0.96 | 0.76 |
| 25 | 0.94 | 1.06 | 0.82 | 0.76 | 0.82 | 1.04 | 0.91 |
| 26 | 0.43 | 0.36 | 0.41 | 0.42 | 0.41 | 0.48 | 0.44 |
| 27 | 48.40 | 45.80 | 73.53 | 79.33 | 61.67 | 49.13 | 55.10 |
| 28 | NA | 75.13 | 71.20 | 86.70 | 90.70 | 71.40 | 58.50 |
| 29 | 110.88 | 149.88 | 107.41 | 119.53 | 98.88 | 117.49 | 75.84 |
| 30 | 0.036 | NA | 0.057 | 0.040 | 0.034 | 0.048 | 0.045 |
| 31 | 11.03 | 10.44 | 8.66 | 9.91 | 8.51 | 10.18 | 11.82 |

Provided are the values of each of the parameters measured in Barley *Hordeum spontaneum* accessions (38, 41-46) according to the correlation identifications (see Table 88).

TABLE 100

Measured parameters of correlation Ids in Barley Hordeum spontaneum accessions

| Ecotype/Treatment | Line-47 | Line-48 | Line-49 | Line-51 | Line-52 | Line-53 |
|---|---|---|---|---|---|---|
| 1 | 10.80 | 14.99 | 16.12 | NA | 15.51 | 6.88 |
| 2 | 25.70 | 24.92 | 26.31 | 24.82 | 26.46 | 21.49 |
| 3 | 31.74 | 50.70 | 44.59 | 26.20 | 57.49 | 47.76 |
| 4 | 41.24 | 71.38 | 73.03 | 52.91 | 73.30 | 65.81 |
| 5 | 26.16 | 39.22 | 49.89 | NA | 38.72 | 29.92 |
| 6 | 1.18 | 0.94 | 1.05 | 1.01 | 0.84 | 0.75 |
| 7 | 2.75 | 2.62 | 2.99 | 3.24 | 2.90 | 2.65 |
| 8 | 0.26 | 0.24 | 0.29 | 0.32 | 0.26 | 0.25 |
| 9 | 1.13 | 1.06 | 1.25 | 1.36 | 1.17 | 1.10 |
| 10 | 0.32 | 0.32 | 0.33 | 0.33 | 0.32 | 0.31 |
| 11 | 17.44 | 18.90 | 14.60 | 13.07 | 19.84 | 17.16 |
| 12 | NA | NA | NA | NA | NA | NA |
| 13 | 0.45 | 0.47 | 0.40 | 0.32 | 0.50 | 0.38 |
| 14 | 1.00 | 1.00 | 1.00 | 1.00 | 1.00 | 1.00 |
| 15 | NA | NA | NA | NA | NA | NA |
| 16 | 105.80 | 111.00 | 117.20 | 122.60 | 111.00 | 107.60 |
| 17 | 133.00 | 143.00 | 148.20 | 152.00 | 142.40 | 140.40 |
| 18 | 80.80 | 105.57 | 101.87 | 80.26 | 105.02 | 98.42 |
| 19 | 3.29 | 3.68 | 3.84 | NA | 3.66 | 3.41 |
| 20 | 27.20 | 32.00 | 31.00 | 29.40 | 31.40 | 32.80 |
| 21 | 10.30 | 12.40 | 13.33 | NA | 18.30 | 6.60 |
| 22 | 6.71 | 6.61 | 7.10 | 8.62 | 7.16 | 5.75 |
| 23 | 10.17 | 9.09 | 9.79 | 11.73 | 10.01 | 8.78 |
| 24 | 0.77 | 0.94 | 0.85 | 0.87 | 0.86 | 0.77 |
| 25 | 0.92 | 0.97 | 0.95 | 0.97 | 0.94 | 0.89 |
| 26 | 0.46 | 0.42 | 0.38 | 0.33 | 0.44 | 0.42 |
| 27 | 56.67 | 62.20 | 70.93 | 45.00 | 74.58 | 74.53 |
| 28 | 90.90 | 87.50 | 108.50 | NA | 113.50 | 95.60 |
| 29 | 72.98 | 122.08 | 117.62 | 79.11 | 130.79 | 113.58 |
| 30 | 0.039 | 0.065 | 0.046 | 0.040 | 0.040 | 0.045 |
| 31 | 10.58 | 9.42 | 10.04 | 11.67 | 10.60 | 9.72 |

Provided are the values of each of the parameters measured in Barley *Hordeum spontaneum* accessions (47-49, 51-53) according to the correlation identifications (see Table 88).

TABLE 101

Measured parameters of correlation Ids in Barley *Hordeum vulgare* accessions

| Ecotype/Treatment | Line-1 | Line-2 | Line-4 | Line-5 | Line-6 | Line-8 | Line-9 |
|---|---|---|---|---|---|---|---|
| 1 | 4.31 | 18.25 | 40.15 | 33.22 | NA | 16.67 | 5.64 |
| 2 | 50.11 | 49.98 | 52.43 | 47.22 | 49.33 | 61.33 | 49.97 |
| 3 | 80.88 | 60.47 | 69.45 | 61.03 | 63.22 | 91.89 | 99.05 |
| 4 | 46.33 | 85.03 | 127.37 | 79.51 | 82.95 | 82.88 | 56.80 |

TABLE 101-continued

Measured parameters of correlation Ids in Barley *Hordeum vulgare* accessions

| Ecotype/Treatment | Line-1 | Line-2 | Line-4 | Line-5 | Line-6 | Line-8 | Line-9 |
|---|---|---|---|---|---|---|---|
| 5 | 11.34 | 52.57 | 126.89 | 60.56 | NA | 44.57 | 9.71 |
| 6 | 3.33 | 1.56 | 3.11 | 3.18 | 2.85 | 4.13 | 3.47 |
| 7 | 2.62 | 2.41 | 2.67 | 2.62 | 2.59 | 2.78 | 2.66 |
| 8 | 0.30 | 0.28 | 0.30 | 0.29 | 0.29 | 0.33 | 0.29 |
| 9 | 1.09 | 0.97 | 1.07 | 1.09 | 1.07 | 1.15 | 1.09 |
| 10 | 0.40 | 0.41 | 0.41 | 0.39 | 0.39 | 0.42 | 0.39 |
| 11 | 56.51 | 21.05 | 44.35 | 47.12 | 43.51 | 58.33 | 56.03 |
| 12 | 64.98 | 37.47 | 51.69 | 49.15 | 46.44 | 78.18 | 79.86 |
| 13 | 2.91 | 1.02 | 2.33 | 2.23 | 2.14 | 3.47 | 2.60 |
| 14 | 4.20 | 1.00 | 2.60 | 2.60 | 1.00 | 1.00 | 5.00 |
| 15 | 0.51 | 0.25 | 0.26 | 0.35 | 0.32 | 0.45 | 0.51 |
| 16 | 90.80 | 124.40 | NA | 122.00 | NA | 111.60 | 86.80 |
| 17 | 148.00 | 170.00 | 170.00 | 167.40 | 170.00 | 156.20 | 159.60 |
| 18 | 83.97 | 79.87 | 122.46 | 108.03 | 87.00 | 104.01 | 70.78 |
| 19 | 2.45 | 3.96 | 4.75 | 4.12 | NA | 3.82 | 2.30 |
| 20 | 57.20 | 45.60 | NA | 48.00 | NA | 44.60 | 72.80 |
| 21 | 1.00 | 9.20 | 19.20 | 14.63 | NA | 6.30 | 1.20 |
| 22 | 9.90 | 7.82 | 11.07 | 10.17 | 9.98 | 9.89 | 9.58 |
| 23 | 9.49 | 10.26 | 7.97 | 8.42 | 8.12 | 6.39 | 7.73 |
| 24 | 1.23 | 0.87 | 1.68 | 1.47 | 1.51 | 1.83 | 1.50 |
| 25 | 1.41 | 1.05 | 1.79 | 1.60 | 1.61 | 1.93 | 1.59 |
| 26 | 0.64 | 0.42 | 0.35 | 0.44 | 0.43 | 0.51 | 0.64 |
| 27 | 45.27 | 56.27 | 32.42 | 35.40 | 36.73 | 32.10 | 48.53 |
| 28 | 24.00 | 48.70 | 47.60 | 45.00 | NA | 38.50 | 21.50 |
| 29 | 127.22 | 145.50 | 196.82 | 140.54 | 146.17 | 178.63 | 155.85 |
| 30 | 0.053 | 0.059 | 0.051 | 0.053 | 0.047 | 0.052 | 0.062 |
| 31 | 9.57 | NA | 7.93 | 8.13 | NA | 5.65 | 7.94 |

Provided are the values of each of the parameters measured in Barley *Hordeum vulgare* accessions (1-2, 4-6, 8-9) according to the correlation identifications (see Table 88).

TABLE 102

Measured parameters of correlation Ids in Barley *Hordeum vulgare* accessions

| Ecotype/Treatment | Line-10 | Line-11 | Line-12 | Line-13 | Line-14 | Line-15 | Line-16 |
|---|---|---|---|---|---|---|---|
| 1 | 5.29 | 18.34 | 4.03 | 8.83 | 4.82 | 29.49 | 5.01 |
| 2 | 51.70 | 56.46 | 53.97 | 50.36 | 56.81 | 57.98 | 51.44 |
| 3 | 66.99 | 60.22 | 87.61 | 71.76 | 76.71 | 81.14 | 77.90 |
| 4 | 64.14 | 54.23 | 73.23 | 49.50 | 47.63 | 66.51 | 77.50 |
| 5 | 38.18 | 46.74 | 42.32 | 11.62 | 9.33 | 47.56 | 30.93 |
| 6 | 3.15 | 1.88 | 3.35 | 3.60 | 3.24 | 3.12 | 1.69 |
| 7 | 2.63 | 2.28 | 2.54 | 2.37 | 2.71 | 2.90 | 2.28 |
| 8 | 0.30 | 0.28 | 0.30 | 0.27 | 0.32 | 0.34 | 0.27 |
| 9 | 1.08 | 0.88 | 1.03 | 0.96 | 1.12 | 1.22 | 0.89 |
| 10 | 0.39 | 0.45 | 0.42 | 0.41 | 0.41 | 0.41 | 0.42 |
| 11 | 59.08 | 27.27 | 55.87 | 61.53 | 50.80 | 45.48 | 24.77 |
| 12 | 54.34 | 46.37 | 71.89 | 56.24 | 61.63 | 64.82 | 56.43 |
| 13 | 2.84 | 1.51 | 2.84 | 2.98 | 2.85 | 2.39 | 1.21 |
| 14 | 3.00 | 1.00 | 1.00 | 2.20 | 3.00 | 1.00 | 1.00 |
| 15 | 0.41 | 0.40 | 0.45 | 0.48 | 0.50 | 0.44 | 0.36 |
| 16 | 106.20 | 117.80 | 111.60 | 85.40 | 90.00 | 113.20 | 113.40 |
| 17 | 157.00 | 162.20 | 159.60 | 157.00 | 150.50 | 158.00 | 170.00 |
| 18 | 98.11 | 57.88 | 94.52 | 73.20 | 78.65 | 90.73 | 64.27 |
| 19 | 3.60 | 3.83 | 3.63 | 2.43 | 2.26 | 3.89 | 3.46 |
| 20 | 50.80 | 44.40 | 46.00 | 71.60 | 61.50 | 44.80 | 56.60 |
| 21 | 2.10 | 10.00 | 2.60 | 1.63 | 1.00 | 17.00 | 3.00 |
| 22 | 11.19 | 8.76 | 10.49 | 10.83 | 11.23 | 7.89 | 9.15 |
| 23 | 8.45 | 10.55 | 7.60 | 7.87 | 9.42 | 6.68 | 12.05 |
| 24 | 1.57 | 0.96 | 1.63 | 1.63 | 1.43 | 1.45 | 0.88 |
| 25 | 1.71 | 1.17 | 1.75 | 1.72 | 1.58 | 1.52 | 1.03 |
| 26 | 0.51 | 0.53 | 0.55 | 0.61 | 0.62 | 0.55 | 0.50 |
| 27 | 29.80 | 50.80 | 32.40 | 26.80 | 42.42 | 39.73 | 71.33 |
| 28 | 36.10 | 57.25 | 42.20 | 19.13 | 21.63 | 59.80 | 62.50 |
| 29 | 131.13 | 114.45 | 160.84 | 121.26 | 124.34 | 147.66 | 155.41 |
| 30 | 0.051 | 0.062 | 0.060 | 0.056 | 0.045 | 0.051 | 0.037 |
| 31 | 8.55 | 10.59 | 7.44 | 7.36 | 9.60 | 6.23 | NA |

Provided are the values of each of the parameters measured in Barley *Hordeum vulgare* accessions (10-16) according to the correlation identifications (see Table 88).

TABLE 103

**Measured parameters of correlation Ids in Barley *Hordeum vulgare* accessions**

| Ecotype/Treatment | Line-17 | Line-18 | Line-19 | Line-54 | Line-55 |
|---|---|---|---|---|---|
| 1 | 3.74 | 11.42 | 5.13 | 7.07 | 6.72 |
| 2 | 58.07 | 53.45 | 48.66 | 43.66 | 47.91 |
| 3 | 68.17 | 70.73 | 54.13 | 43.70 | 68.61 |
| 4 | 81.58 | 67.92 | 81.05 | 56.28 | NA |
| 5 | NA | 35.49 | 38.41 | 14.62 | 67.47 |
| 6 | 1.66 | 3.50 | 1.16 | 3.71 | 2.78 |
| 7 | 2.42 | 2.65 | 2.16 | 2.24 | 2.56 |
| 8 | 0.30 | 0.30 | 0.26 | 0.25 | 0.28 |
| 9 | 0.96 | 1.08 | 0.83 | 0.88 | 1.05 |
| 10 | 0.44 | 0.40 | 0.42 | 0.40 | 0.38 |
| 11 | 21.15 | 59.72 | 17.46 | 65.39 | 43.77 |
| 12 | 49.68 | 54.97 | 40.33 | 34.58 | 53.97 |
| 13 | 1.18 | 2.93 | 0.83 | 2.64 | 2.06 |
| 14 | 3.80 | 3.80 | 1.00 | 5.00 | 1.80 |
| 15 | 0.33 | 0.40 | 0.29 | 0.35 | NA |
| 16 | 98.50 | 109.60 | 119.40 | 88.40 | 128.00 |
| 17 | 170.00 | 155.20 | 170.00 | 157.00 | 170.00 |
| 18 | 82.73 | 94.12 | 63.47 | 93.79 | 90.30 |
| 19 | NA | 3.60 | 3.64 | 2.18 | 4.23 |
| 20 | 71.50 | 45.60 | 50.60 | 68.60 | 42.00 |
| 21 | 1.00 | 3.80 | 4.20 | 2.50 | 3.10 |
| 22 | 8.57 | 11.30 | 7.04 | 10.74 | 10.04 |
| 23 | 10.74 | 8.60 | 8.94 | 8.54 | 8.59 |
| 24 | 0.92 | 1.56 | 0.92 | 1.49 | 1.45 |
| 25 | 1.10 | 1.72 | 1.08 | 1.68 | 1.57 |
| 26 | 0.45 | 0.51 | 0.39 | 0.44 | NA |
| 27 | 65.40 | 33.27 | 82.47 | 20.80 | 38.00 |
| 28 | 31.20 | 34.00 | 78.90 | 15.60 | 43.20 |
| 29 | 149.76 | 138.64 | 135.18 | 99.98 | NA |
| 30 | 0.047 | 0.043 | 0.056 | 0.053 | 0.054 |
| 31 | NA | 8.57 | NA | 8.26 | 9.22 |

Provided are the values of each of the parameters measured in Barley *Hordeum vulgare* accessions (17-19, 54-55) according to the correlation identifications (see Table 88).

TABLE 104

Correlation between the expression level of the selected polynucleotides of the invention and their homologues in specific tissues or developmental stages and the phenotypic performance across all 55 Barley accessions

| Gene Name | R | P value | Exp. set | Corr. Set ID | Gene Name | R | P value | Exp. set | Corr. Set ID |
|---|---|---|---|---|---|---|---|---|---|
| LYM1015 | 0.71 | 9.98E−04 | 2 | 12 | LYM1015 | 0.83 | 4.34E−05 | 2 | 15 |
| LYM1016 | 0.71 | 9.48E−04 | 3 | 12 | LYM1023 | 0.77 | 2.88E−04 | 3 | 15 |
| LYM1026 | 0.71 | 1.08E−08 | 3 | 2 | LYM1026 | 0.74 | 1.61E−09 | 3 | 13 |
| LYM1026 | 0.72 | 6.15E−09 | 3 | 6 | LYM1026 | 0.72 | 6.13E−09 | 2 | 2 |
| LYM1026 | 0.74 | 1.45E−09 | 2 | 10 | LYM1027 | 0.82 | 2.64E−05 | 2 | 12 |
| LYM1027 | 0.89 | 1.52E−06 | 2 | 15 | LYM1031 | 0.78 | 4.17E−11 | 2 | 13 |
| LYM1031 | 0.71 | 1.27E−03 | 2 | 15 | LYM1031 | 0.76 | 2.16E−10 | 2 | 3 |
| LYM1031 | 0.73 | 5.43E−09 | 2 | 26 | LYM1031 | 0.76 | 3.24E−10 | 2 | 6 |
| LYM1031 | 0.74 | 1.54E−09 | 2 | 11 | LYM1034 | 0.70 | 1.15E−03 | 3 | 12 |
| LYM1034 | 0.75 | 5.68E−04 | 3 | 15 | LYM1034 | 0.80 | 1.31E−04 | 1 | 15 |
| LYM1034 | 0.76 | 8.23E−11 | 1 | 26 | LYM1037 | 0.74 | 7.64E−04 | 2 | 15 |
| LYM1040 | 0.76 | 3.92E−04 | 3 | 15 | LYM1041 | 0.71 | 9.67E−04 | 3 | 12 |
| LYM1042 | 0.74 | 1.75E−09 | 3 | 2 | LYM1042 | 0.74 | 9.90E−10 | 3 | 3 |
| LYM1042 | 0.77 | 7.63E−11 | 2 | 2 | LYM1042 | 0.76 | 2.06E−10 | 2 | 10 |
| LYM1048 | 0.70 | 1.94E−08 | 3 | 2 | LYM1048 | 0.74 | 1.37E−09 | 3 | 13 |
| LYM1048 | 0.72 | 4.07E−09 | 3 | 3 | LYM1048 | 0.73 | 2.10E−09 | 3 | 6 |
| LYM1048 | 0.73 | 1.18E−09 | 1 | 24 | LYM1048 | 0.72 | 1.23E−09 | 1 | 2 |
| LYM1048 | 0.75 | 1.12E−10 | 1 | 13 | LYM1048 | 0.76 | 7.08E−11 | 1 | 6 |
| LYM1048 | 0.74 | 3.47E−10 | 1 | 25 | LYM1048 | 0.73 | 1.13E−09 | 1 | 11 |
| LYM1048 | 0.75 | 5.33E−10 | 2 | 2 | LYM1048 | 0.75 | 5.04E−10 | 2 | 13 |
| LYM1048 | 0.73 | 1.84E−09 | 2 | 3 | LYM1048 | 0.74 | 1.05E−09 | 2 | 6 |
| LYM1048 | 0.72 | 4.11E−09 | 2 | 10 | LYM1048 | 0.72 | 2.45E−09 | 4 | 2 |
| LYM1048 | 0.75 | 2.50E−10 | 4 | 13 | LYM1048 | 0.72 | 2.53E−09 | 4 | 3 |
| LYM1048 | 0.73 | 1.23E−09 | 4 | 26 | LYM1048 | 0.72 | 1.85E−09 | 4 | 6 |
| LYM1051 | 0.71 | 8.06E−09 | 3 | 3 | LYM1053 | 0.70 | 1.74E−03 | 3 | 15 |
| LYM1053 | 0.73 | 3.50E−09 | 3 | 26 | LYM1054 | 0.77 | 3.41E−04 | 2 | 15 |
| LYM1054 | 0.73 | 3.53E−09 | 2 | 26 | LYM1056 | 0.72 | 1.61E−09 | 1 | 24 |
| LYM1056 | 0.72 | 2.60E−09 | 1 | 6 | LYM1056 | 0.72 | 1.93E−09 | 1 | 25 |
| LYM1056 | 0.71 | 4.18E−09 | 1 | 11 | LYM1056 | 0.71 | 9.36E−09 | 2 | 13 |
| LYM1056 | 0.73 | 3.24E−09 | 2 | 6 | LYM1056 | 0.71 | 1.10E−08 | 2 | 11 |
| LYM1060 | 0.70 | 1.66E−03 | 3 | 15 | LYM1062 | 0.71 | 1.45E−03 | 1 | 15 |
| LYM1066 | 0.71 | 1.30E−08 | 3 | 2 | LYM1066 | 0.71 | 1.01E−08 | 3 | 13 |
| LYM1066 | 0.73 | 6.30E−10 | 1 | 24 | LYM1066 | 0.80 | 1.00E−12 | 1 | 2 |
| LYM1066 | 0.80 | 8.16E−13 | 1 | 13 | LYM1066 | 0.78 | 7.36E−12 | 1 | 6 |
| LYM1066 | 0.76 | 5.19E−11 | 1 | 10 | LYM1066 | 0.76 | 8.58E−11 | 1 | 25 |
| LYM1066 | 0.75 | 2.27E−10 | 1 | 11 | LYM1066 | 0.75 | 8.34E−10 | 2 | 2 |
| LYM1066 | 0.77 | 1.47E−10 | 2 | 13 | LYM1066 | 0.74 | 1.63E−09 | 2 | 6 |
| LYM1066 | 0.74 | 1.23E−09 | 2 | 10 | LYM1066 | 0.72 | 4.02E−09 | 2 | 11 |
| LYM1066 | 0.78 | 1.72E−11 | 4 | 2 | LYM1066 | 0.79 | 7.32E−12 | 4 | 10 |
| LYM1069 | 0.73 | 8.31E−04 | 2 | 15 | LYM1070 | 0.70 | 1.70E−03 | 1 | 15 |
| LYM1070 | 0.71 | 1.54E−03 | 2 | 15 | LYM1076 | 0.79 | 1.49E−04 | 4 | 15 |

Provided are the correlations (R) and p-values (P) between the expression levels of selected genes of some embodiments of the invention in various tissues or developmental stages (Expression sets) and the phenotypic performance in various yield (seed yield, oil yield, oil content), biomass, growth rate and/or vigor components [Correlation (Corr.) vector (Vec.) Expression (Exp.)] Corr. Vector = correlation vector specified in Table b; Exp. Set = expression set specified in Table 87.

TABLE 105

Correlation between the expression level of the selected polynucleotides of the invention and their homologues in specific tissues or developmental stages and the phenotypic performance across 27 Barley *Hordeum spontaneum* accessions

| Gene Name | R | P value | Exp. set | Corr. Set ID | Gene Name | R | P value | Exp. set | Corr. Set ID |
|---|---|---|---|---|---|---|---|---|---|
| LYM1010 | 0.76 | 2.54E−05 | 2 | 13 | LYM1018 | 0.80 | 2.95E−06 | 3 | 13 |
| LYM1018 | 0.72 | 8.37E−05 | 3 | 11 | LYM1052 | 0.75 | 3.28E−05 | 2 | 26 |
| LYM1057 | 0.75 | 1.02E−05 | 1 | 8 | LYM1059 | 0.71 | 1.47E−04 | 2 | 16 |
| LYM1059 | 0.74 | 4.89E−05 | 2 | 17 | LYM1061 | 0.87 | 1.66E−06 | 2 | 5 |
| LYM1073 | 0.72 | 1.22E−04 | 2 | 24 | | | | | |

Provided are the correlations (R) and p-values (P) between the expression levels of selected genes of some embodiments of the invention in various tissues or developmental stages (Expression sets) and the phenotypic performance in various yield (seed yield, oil yield, oil content), biomass, growth rate and/or vigor components [Correlation (Corr.) vector (Vec.) Expression (Exp.)] Corr. Vector = correlation vector specified in Table b; Exp. Set = expression set specified in Table 87.

TABLE 106

Correlation between the expression level of the selected polynucleotides of the invention and their homologues in specific tissues or developmental stages and the phenotypic performance across 19 Barley *Hordeum vulgare* accessions

| Gene Name | R | P value | Exp. set | Corr. Set ID | Gene Name | R | P value | Exp. set | Corr. Set ID |
|---|---|---|---|---|---|---|---|---|---|
| LYM1015 | 0.71 | 9.98E−04 | 2 | 12 | LYM1015 | 0.83 | 4.34E−05 | 2 | 15 |
| LYM1015 | 0.80 | 1.16E−04 | 2 | 26 | LYM1016 | 0.71 | 9.48E−04 | 3 | 12 |
| LYM1022 | 0.76 | 2.33E−04 | 1 | 2 | LYM1023 | 0.77 | 2.88E−04 | 3 | 15 |
| LYM1023 | 0.79 | 1.45E−04 | 3 | 26 | LYM1023 | 0.77 | 3.31E−04 | 1 | 26 |
| LYM1024 | 0.73 | 1.25E−03 | 1 | 20 | LYM1025 | 0.79 | 1.47E−04 | 1 | 4 |
| LYM1027 | 0.80 | 7.37E−05 | 2 | 13 | LYM1027 | 0.82 | 2.64E−05 | 2 | 12 |
| LYM1027 | 0.89 | 1.52E−06 | 2 | 15 | LYM1027 | 0.74 | 4.23E−04 | 2 | 3 |
| LYM1027 | 0.82 | 5.61E−05 | 2 | 26 | LYM1027 | 0.73 | 6.33E−04 | 2 | 6 |
| LYM1027 | 0.71 | 1.07E−03 | 2 | 11 | LYM1030 | 0.73 | 8.34E−04 | 1 | 26 |
| LYM1031 | 0.71 | 1.27E−03 | 2 | 15 | LYM1031 | 0.77 | 3.24E−04 | 2 | 26 |
| LYM1033 | 0.77 | 2.69E−04 | 2 | 26 | LYM1034 | 0.70 | 1.15E−03 | 3 | 12 |
| LYM1034 | 0.75 | 5.68E−04 | 3 | 15 | LYM1034 | 0.72 | 1.03E−03 | 3 | 26 |
| LYM1034 | 0.80 | 1.31E−04 | 1 | 15 | LYM1034 | 0.78 | 1.90E−04 | 1 | 26 |
| LYM1035 | 0.70 | 7.39E−03 | 4 | 31 | LYM1037 | 0.74 | 7.64E−04 | 2 | 15 |
| LYM1037 | 0.80 | 1.22E−04 | 2 | 26 | LYM1038 | 0.71 | 1.39E−03 | 2 | 26 |
| LYM1040 | 0.76 | 3.92E−04 | 3 | 15 | LYM1040 | 0.76 | 4.04E−04 | 3 | 26 |
| LYM1041 | 0.71 | 9.67E−04 | 3 | 12 | LYM1041 | 0.74 | 4.67E−04 | 3 | 3 |
| LYM1041 | 0.72 | 1.19E−03 | 3 | 26 | LYM1043 | 0.74 | 7.53E−04 | 4 | 26 |
| LYM1044 | 0.70 | 1.63E−03 | 2 | 26 | LYM1046 | 0.70 | 2.50E−03 | 2 | 20 |
| LYM1048 | 0.74 | 7.03E−04 | 4 | 26 | LYM1048 | 0.74 | 6.03E−04 | 2 | 26 |
| LYM1052 | 0.74 | 3.94E−04 | 3 | 24 | LYM1052 | 0.84 | 1.38E−05 | 3 | 22 |
| LYM1052 | 0.83 | 1.73E−05 | 3 | 13 | LYM1052 | 0.80 | 7.25E−05 | 3 | 6 |
| LYM1052 | 0.76 | 2.73E−04 | 3 | 25 | LYM1052 | 0.79 | 8.36E−05 | 3 | 11 |
| LYM1052 | 0.73 | 6.32E−04 | 4 | 22 | LYM1052 | 0.70 | 1.22E−03 | 2 | 22 |
| LYM1053 | 0.70 | 1.74E−03 | 3 | 15 | LYM1053 | 0.77 | 3.23E−04 | 3 | 26 |
| LYM1054 | 0.74 | 4.34E−04 | 2 | 9 | LYM1054 | 0.77 | 3.41E−04 | 2 | 15 |
| LYM1054 | 0.71 | 8.61E−04 | 2 | 7 | LYM1054 | 0.75 | 5.84E−04 | 2 | 26 |
| LYM1055 | 0.75 | 5.19E−04 | 2 | 26 | LYM1056 | 0.84 | 1.53E−05 | 3 | 24 |
| LYM1056 | 0.82 | 3.16E−05 | 3 | 13 | LYM1056 | 0.84 | 1.27E−05 | 3 | 6 |
| LYM1056 | 0.84 | 1.25E−05 | 3 | 25 | LYM1056 | 0.77 | 2.08E−04 | 3 | 11 |
| LYM1056 | 0.85 | 7.66E−06 | 1 | 24 | LYM1056 | 0.71 | 9.05E−04 | 1 | 22 |
| LYM1056 | 0.85 | 7.13E−06 | 1 | 13 | LYM1056 | 0.86 | 4.42E−06 | 1 | 6 |
| LYM1056 | 0.86 | 4.21E−06 | 1 | 25 | LYM1056 | 0.89 | 1.02E−06 | 1 | 11 |
| LYM1056 | 0.86 | 4.81E−06 | 2 | 13 | LYM1056 | 0.83 | 2.31E−05 | 2 | 6 |
| LYM1056 | 0.70 | 1.17E−03 | 2 | 25 | LYM1056 | 0.85 | 7.76E−06 | 2 | 11 |
| LYM1058 | 0.72 | 1.18E−03 | 2 | 26 | LYM1059 | 0.76 | 4.14E−04 | 4 | 28 |
| LYM1060 | 0.70 | 1.66E−03 | 3 | 15 | LYM1060 | 0.75 | 5.28E−04 | 3 | 26 |
| LYM1061 | 0.70 | 1.75E−03 | 4 | 26 | LYM1062 | 0.73 | 6.58E−04 | 1 | 13 |
| LYM1062 | 0.71 | 1.45E−03 | 1 | 15 | LYM1062 | 0.76 | 2.44E−04 | 1 | 6 |
| LYM1062 | 0.73 | 5.21E−04 | 1 | 11 | LYM1063 | 0.77 | 1.99E−04 | 3 | 14 |
| LYM1063 | 0.74 | 6.54E−04 | 2 | 26 | LYM1064 | 0.71 | 1.04E−03 | 3 | 14 |
| LYM1064 | 0.71 | 9.49E−04 | 2 | 24 | LYM1064 | 0.72 | 8.21E−04 | 2 | 25 |
| LYM1065 | 0.71 | 9.04E−04 | 3 | 2 | LYM1065 | 0.79 | 9.97E−05 | 1 | 27 |
| LYM1066 | 0.75 | 4.82E−04 | 2 | 26 | | | | | |
| LYM1068 | 0.75 | 3.48E−04 | 4 | 2 | LYM1069 | 0.71 | 1.48E−03 | 4 | 26 |
| LYM1069 | 0.73 | 8.31E−04 | 2 | 15 | LYM1069 | 0.81 | 6.87E−05 | 2 | 26 |
| LYM1070 | 0.70 | 1.70E−03 | 1 | 15 | LYM1070 | 0.77 | 2.65E−04 | 1 | 26 |
| LYM1070 | 0.75 | 5.84E−04 | 4 | 26 | LYM1070 | 0.71 | 1.54E−03 | 2 | 15 |

TABLE 106-continued

Correlation between the expression level of the selected polynucleotides of the invention and their homologues in specific tissues or developmental stages and the phenotypic performance across 19 Barley Hordeum vulgare accessions

| Gene Name | R | P value | Exp. set | Corr. Set ID | Gene Name | R | P value | Exp. set | Corr. Set ID |
|---|---|---|---|---|---|---|---|---|---|
| LYM1073 | 0.74 | 9.89E−04 | 1 | 5 | LYM1076 | 0.70 | 1.15E−03 | 1 | 2 |
| LYM1076 | 0.79 | 1.49E−04 | 4 | 15 | LYM1076 | 0.82 | 4.74E−05 | 4 | 26 |
| LYM1234 | 0.74 | 7.27E−04 | 4 | 26 | | | | | |

Provided are the correlations (R) and p-values (P) between the expression levels of selected genes of some embodiments of the invention in various tissues or developmental stages (Expression sets) and the phenotypic performance in various yield (seed yield, oil yield, oil content), biomass, growth rate and/or vigor components [Correlation (Corr.) vector (Vec.) Expression (Exp.)] Corr. Vector = correlation vector specified in Table b; Exp. Set = expression set specified in Table 87.

Example 15

Gene Cloning and Generation of Binary Vectors for Plant Expression

To validate their role in improving yield, selected genes were over-expressed in plants, as follows.

Cloning Strategy

Selected genes from those presented in Examples 1-14 hereinabove were cloned into binary vectors for the generation of transgenic plants. For cloning, the full-length open reading frames (ORFs) were identified. EST clusters and in some cases mRNA sequences were analyzed to identify the entire open reading frame by comparing the results of several translation algorithms to known proteins from other plant species.

In order to clone the full-length cDNAs, reverse transcription (RT) followed by polymerase chain reaction (PCR; RT-PCR) was performed on total RNA extracted from leaves, roots or other plant tissues, growing under normal/limiting or stress conditions. Total RNA extraction, production of cDNA and PCR amplification was performed using standard protocols described elsewhere (Sambrook J., E. F. Fritsch, and T. Maniatis. 1989. Molecular Cloning. A Laboratory Manual, 2nd Ed. Cold Spring Harbor Laboratory Press, New York) which are well known to those skilled in the art. PCR products were purified using PCR purification kit (Qiagen).

Usually, 2 sets of primers were prepared for the amplification of each gene, via nested PCR (if required). Both sets of primers were used for amplification on a cDNA. In case no product was obtained, a nested PCR reaction was performed. Nested PCR was performed by amplification of the gene using external primers and then using the produced PCR product as a template for a second PCR reaction, where the internal set of primers were used. Alternatively, one or two of the internal primers were used for gene amplification, both in the first and the second PCR reactions (meaning only 2-3 primers are designed for a gene). To facilitate further cloning of the cDNAs, an 8-12 base pairs (bp) extension was added to the 5' of each internal primer. The primer extension includes an endonuclease restriction site. The restriction sites were selected using two parameters: (a) the restriction site does not exist in the cDNA sequence; and (b) the restriction sites in the forward and reverse primers were designed such that the digested cDNA was inserted in the sense direction into the binary vector utilized for transformation.

PCR products were digested with the restriction endonucleases (New England BioLabs Inc) according to the sites designed in the primers. Each digested/undigested PCR product was inserted into a high copy vector pUC19 (New England BioLabs Inc], or into plasmids originating from this vector. In some cases the undigested PCR product was inserted into pCR-Blunt II-TOPO (Invitrogen) or into pJET1.2 (CloneJET PCR Cloning Kit, Thermo Scientific) or directly into the binary vector. The digested/undigested products and the linearized plasmid vector were ligated using T4 DNA ligase enzyme (Roche, Switzerland or other manufacturers). In cases where pCR-Blunt II-TOPO is used no T4 ligase is needed.

Sequencing of the inserted genes was performed, using the ABI 377 sequencer (Applied Biosystems). In some cases, after confirming the sequences of the cloned genes, the cloned cDNA was introduced into a modified pGI binary vector containing the At6669 promoter (e.g., pQFNc) and the NOS terminator (SEQ ID NO: 8201) via digestion with appropriate restriction endonucleases.

Figure 9A:
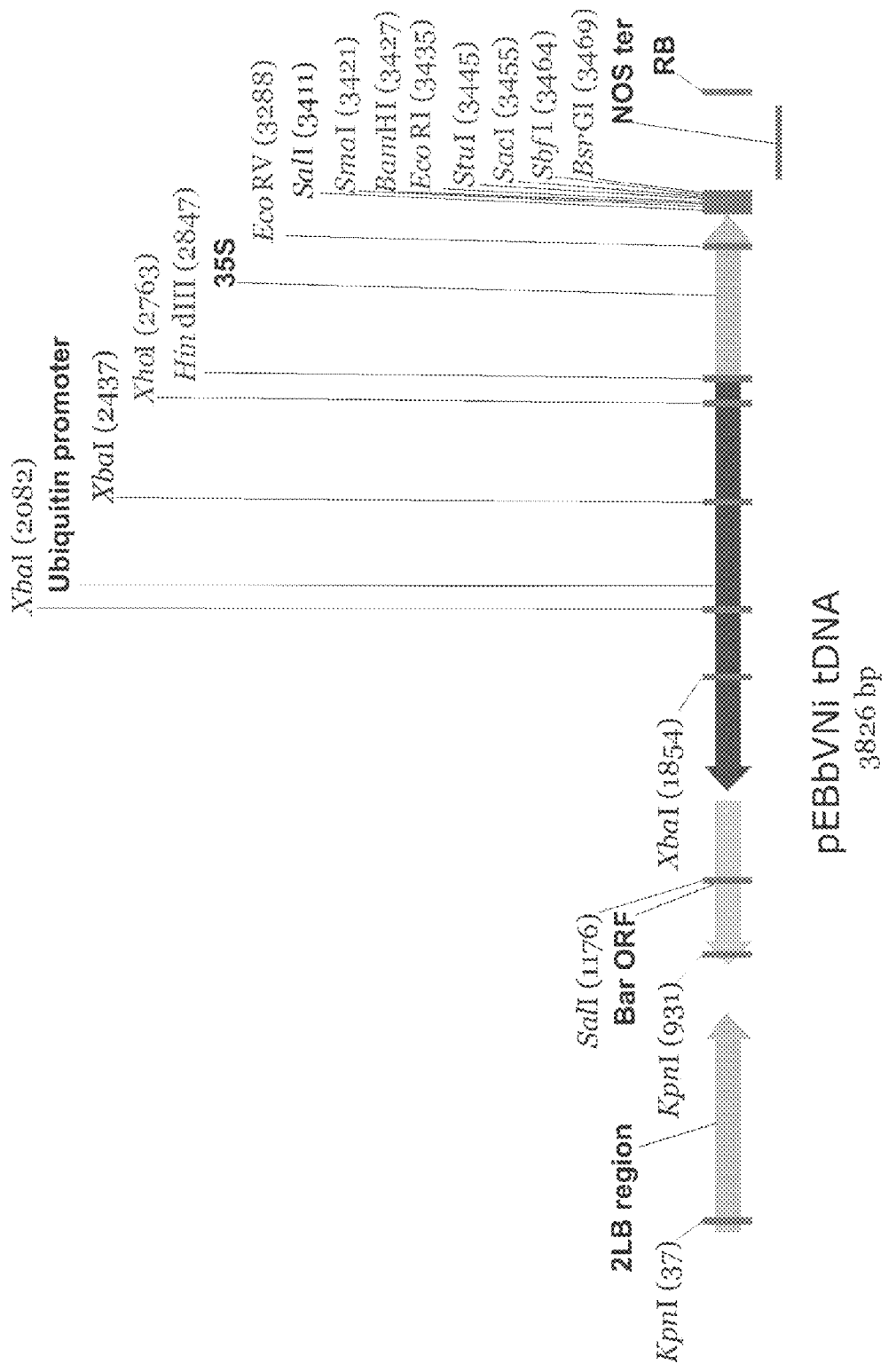

In case of Brachypodium transformation, after confirming the sequences of the cloned genes, the cloned cDNAs were introduced into pEBbVNi (FIG. 9A) containing 35S promoter (SEQ ID NO: 8202) and the NOS terminator (SEQ ID NO:8201) via digestion with appropriate restriction endonucleases. The genes were cloned downstream to the 35S promoter and upstream to the NOS terminator.

Several DNA sequences of the selected genes were synthesized by GeneArt (Life Technologies, Grand Island, N.Y., USA). Synthetic DNA was designed in silico. Suitable restriction enzymes sites were added to the cloned sequences at the 5' end and at the 3' end to enable later cloning into the desired binary vector.

Binary vectors—The pPI plasmid vector was constructed by inserting a synthetic poly-(A) signal sequence, originating from pGL3 basic plasmid vector (Promega, GenBank Accession No. U47295; nucleotides 4658-4811) into the HindIII restriction site of the binary vector pBI101.3 (Clontech, GenBank Accession No. U12640). pGI is similar to pPI, but the original gene in the backbone is GUS-Intron and not GUS.

The modified pGI vector (e.g., pQFN, pQFNc, pQYN_6669, pQNa_RP, pQFYN or pQXNc) is a modified version of the pGI vector in which the cassette is inverted between the left and right borders so the gene and its corresponding promoter are close to the right border and the NPTII gene is close to the left border.

At6669, the new Arabidopsis thaliana promoter sequence (SEQ ID NO:8190) was inserted in the modified pGI binary vector, upstream to the cloned genes, followed by DNA ligation and binary plasmid extraction from positive E. coli colonies, as described above. Colonies were analyzed by PCR using the primers covering the insert which were designed to span the introduced promoter and gene. Positive plasmids were identified, isolated and sequenced.

pEBbVNi (FIG. 9A) is a modified version of pJJ2LB in which the Hygromycin resistance gene was replaced with the BAR gene which confers resistance to the BASTA herbicide [BAR gene coding sequence is provided in GenBank Accession No. JQ293091.1 (SEQ ID NO:8203); further description is provided in Akama K, et al. "Efficient Agrobacterium-mediated transformation of Arabidopsis thaliana using the bar gene as selectable marker", Plant Cell Rep. 1995, 14(7):450-4; Christiansen P, et al. "A rapid and efficient transformation protocol for the grass Brachypodium distachyon", Plant Cell Rep. 2005 March; 23(10-11): 751-8. Epub 2004 Oct. 19; and Păcurar D I, et al. "A high-throughput Agrobacterium-mediated transformation system for the grass model species Brachypodium distachyon L", Transgenic Res. 2008 17(5):965-75; each of which is fully incorporated herein by reference in its entirety]. The pEBbVNi construct contains the 35S promoter (SEQ ID NO:8202). pJJ2LB is a modified version of pCambia0305.2 (Cambia).

In case genomic DNA was cloned, the genes were amplified by direct PCR on genomic DNA extracted from leaf tissue using the DNAeasy kit (Qiagen Cat. No. 69104).

Selected genes cloned by the present inventors are provided in Table 107 below.

TABLE 107

| Gene Name | High copy plasmid | Organism | Primers used SEQ ID NOs: | Polynucleotide SEQ ID NO: | Polypeptide SEQ ID NO: |
|---|---|---|---|---|---|
| LYM1010 | LYM1010_GA | | | 269 | 474 |
| LYM1011 | LYM1011_GA | | | 270 | 475 |
| LYM1012 | LYM1012_GA | | | 271 | 476 |
| LYM1013 | LYM1013 | BARLEY Hordeum vulgare L. | 8204, 8352, 8500, 8576 | 272 | 715 |
| LYM1014 | LYM1014_GA | | | 273 | 478 |
| LYM1015 | LYM1015 | BARLEY Hordeum vulgare L. | 8205, 8353, 8205, 8353 | 274 | 479 |
| LYM1016 | LYM1016 | BARLEY Hordeum vulgare L. | 8206, 8354, 8501, 8577 | 275 | 480 |
| LYM1017 | LYM1017_GA | | | 276 | 481 |
| LYM1018 | LYM1018 | BARLEY Hordeum vulgare L. | 8207, 8355, 8207, 8355 | 277 | 716 |
| LYM1019 | LYM1019 | BARLEY Hordeum vulgare L. | 8208, 8356, 8208, 8356 | 278 | 483 |
| LYM1020 | LYM1020 | BARLEY Hordeum vulgare L. | 8209, 8357, 8502, 8578 | 279 | 717 |
| LYM1021 | LYM1021 | BARLEY Hordeum vulgare L. | 8210, 8358, 8210, 8358 | 280 | 485 |
| LYM1022 | LYM1022 | BARLEY Hordeum vulgare L. | 8211, 8359, 8211, 8359 | 281 | 718 |
| LYM1023 | LYM1023 | BARLEY Hordeum vulgare L. | 8212, 8360, 8212, 8360 | 282 | 719 |
| LYM1024 | LYM1024 | BARLEY Hordeum vulgare L. | 8213, 8361, 8213, 8361 | 283 | 488 |
| LYM1025 | LYM1025 | BARLEY Hordeum vulgare L. | 8214, 8362, 8503, 8579 | 284 | 489 |
| LYM1026 | LYM1026 | BARLEY Hordeum vulgare L. | 8215, 8363, 8504, 8580 | 285 | 490 |
| LYM1027 | LYM1027 | BARLEY Hordeum vulgare L. | 8216, 8364, 8216, 8364 | 286 | 491 |
| LYM1028 | LYM1028_GA | | | 287 | 492 |
| LYM1029 | LYM1029 | BARLEY Hordeum vulgare L. | 8217, 8365, 8505, 8581 | 288 | 493 |
| LYM1030 | LYM1030 | BARLEY Hordeum vulgare L. | 8218, 8366, 8218, 8366 | 289 | 720 |
| LYM1033 | LYM1033 | BARLEY Hordeum vulgare L. | 8220, 8368, 8220, 8368 | 290 | 497 |
| LYM1034 | LYM1034 | BARLEY Hordeum vulgare L. | 8221, 8369, 8506, 8582 | 291 | 721 |
| LYM1035 | LYM1035_GA | | | 292 | 499 |
| LYM1036 | LYM1036_GA | | | 293 | 500 |
| LYM1037 | LYM1037_GA | | | 294 | 501 |
| LYM1038 | LYM1038 | BARLEY Hordeum vulgare L. | 8222, 8370, 8507, 8583 | 295 | 502 |
| LYM1040 | LYM1040 | BARLEY Hordeum vulgare L. | 8223, 8371, 8508, 8584 | 296 | 503 |
| LYM1041 | LYM1041_GA | | | 297 | 504 |
| LYM1042 | LYM1042_GA | | | 298 | 505 |
| LYM1043 | LYM1043 | BARLEY Hordeum vulgare L. | 8224, 8372, 8224, 8372 | 299 | 506 |
| LYM1044 | LYM1044_GA | | | 300 | 507 |
| LYM1046 | LYM1046 | BARLEY Hordeum vulgare L. | 8225, 8373, 8509, 8585 | 301 | 508 |
| LYM1047 | LYM1047 | BARLEY Hordeum vulgare L. | 8226, 8374, 8226, 8374 | 302 | 509 |
| LYM1049 | LYM1049 | BARLEY Hordeum vulgare L. | 8227, 8375, 8227, 8375 | 303 | 511 |
| LYM1051 | LYM1051 | BARLEY Hordeum vulgare L. | 8228, 8376, 8510, 8586 | 304 | 722 |
| LYM1052 | LYM1052 | BARLEY Hordeum vulgare L. | 8229, 8377, 8229, 8377 | 305 | 723 |
| LYM1053 | LYM1053 | BARLEY Hordeum vulgare L. | 8230, 8378, 8511, 8587 | 306 | 724 |
| LYM1054 | LYM1054 | BARLEY Hordeum vulgare L. | 8231, 8379, 8512, 8588 | 307 | 515 |
| LYM1055 | LYM1055_GA | | | 308 | 516 |
| LYM1056 | LYM1056 | BARLEY Hordeum vulgare L. | 8232, 8380, 8232, 8380 | 309 | 517 |
| LYM1057 | LYM1057 | BARLEY Hordeum vulgare L. | 8233, 8381, 8233, 8381 | 310 | 518 |
| LYM1060 | LYM1060 | BARLEY Hordeum vulgare L. | 8234, 8382, 8513, 8589 | 311 | 521 |
| LYM1061 | LYM1061 | BARLEY Hordeum vulgare L. | 8235, 8383, 8514, 8590 | 312 | 522 |
| LYM1062 | LYM1062 | BARLEY Hordeum vulgare L. | 8236, 8384, 8236, 8384 | 313 | 523 |
| LYM1063 | LYM1063_GA | | | 314 | 524 |
| LYM1065 | LYM1065 | BARLEY Hordeum vulgare L. | 8237, 8385, 8515, 8591 | 315 | 526 |
| LYM1066 | LYM1066 | BARLEY Hordeum vulgare L. | 8238, 8386, 8516, 8592 | 316 | 527 |
| LYM1068 | LYM1068_GA | | | 317 | 528 |
| LYM1069 | LYM1069_GA | | | 318 | 529 |
| LYM1070 | LYM1070 | BARLEY Hordeum vulgare L. | 8239, 8387, 8239, 8387 | 319 | 725 |
| LYM1071 | LYM1071 | BARLEY Hordeum vulgare L. | 8240, 8388, 8240, 8388 | 320 | 726 |
| LYM1072 | LYM1072 | BARLEY Hordeum vulgare L. | 8241, 8389, 8241, 8389 | 321 | 532 |
| LYM1073 | LYM1073 | BARLEY Hordeum vulgare L. | | 322 | 533 |
| LYM1074 | LYM1074 | BARLEY Hordeum vulgare L. | 8243, 8391, 8243, 8391 | 323 | 534 |
| LYM1075 | LYM1075 | BARLEY Hordeum vulgare L. | 8244, 8392, 8517, 8593 | 324 | 727 |
| LYM1078 | LYM1078 | BRACHYPODIUM Brachypodiums dis | 8246, 8394, 8246, 8394 | 325 | 728 |

TABLE 107-continued

Cloning Table

| Gene Name | High copy plasmid | Organism | Primers used SEQ ID NOs: | Polynucleotide SEQ ID NO: | Polypeptide SEQ ID NO: |
|---|---|---|---|---|---|
| LYM1079 | LYM1079 | BRACHYPODIUM Brachypodiums dis | 8247, 8395, 8519, 8595 | 326 | 538 |
| LYM1082 | LYM1082 | BRACHYPODIUM Brachypodiums dis | 8248, 8396, 8248, 8396 | 327 | 539 |
| LYM1084 | LYM1084 | BRACHYPODIUM Brachypodiums dis | 8249, 8397, 8520, 8596 | 328 | 540 |
| LYM1085 | LYM1085 | BRACHYPODIUM Brachypodiums dis | 8250, 8398, 8521, 8597 | 329 | 729 |
| LYM1086 | LYM1086 | BRACHYPODIUM Brachypodiums dis | 8251, 8399, 8522, 8598 | 330 | 730 |
| LYM1087 | LYM1087 | BRACHYPODIUM Brachypodiums dis | 8252, 8400, 8252, 8400 | 331 | 543 |
| LYM1088 | LYM1088_GA | | | 332 | 544 |
| LYM1089 | LYM1089_GA | | | 333 | 545 |
| LYM1090 | LYM1090 | BRACHYPODIUM Brachypodiums dis | 8253, 8401, 8523, 8599 | 334 | 731 |
| LYM1092 | LYM1092 | BRACHYPODIUM Brachypodiums dis | 8254, 8402, 8254, 8600 | 335 | 548 |
| LYM1093 | LYM1093 | BRACHYPODIUM Brachypodiums dis | 8255, 8403, 8524, 8601 | 336 | 549 |
| LYM1094 | LYM1094 | BRACHYPODIUM Brachypodiums dis | 8256, 8404, 8525, 8602 | 337 | 732 |
| LYM1095 | LYM1095_GA | | | 338 | 551 |
| LYM1096 | LYM1096_GA | | | 339 | 552 |
| LYM1097 | LYM1097_GA | | | 340 | 553 |
| LYM1099 | LYM1099 | BRACHYPODIUM Brachypodiums dis | 8257, 8405, 8526, 8603 | 341 | 555 |
| LYM1100 | LYM1100 | FOXTAIL Setaria italica | 8258, 8406, 8527, 8604 | 342 | 556 |
| LYM1102 | LYM1102 | FOXTAIL Setaria italica | 8259, 8407, 8528, 8605 | 343 | 558 |
| LYM1103 | LYM1103 | FOXTAIL Setaria italica | 8260, 8408, 8260, 8408 | 344 | 559 |
| LYM1104 | LYM1104_GA | | | 345 | 560 |
| LYM1106 | LYM1106_GA | | | 346 | 562 |
| LYM1107 | LYM1107 | FOXTAIL Setaria italica | 8261, 8409, 8261, 8409 | 347 | 563 |
| LYM1108 | LYM1108 | FOXTAIL Setaria italica | 8262, 8410, 8529, 8606 | 348 | 564 |
| LYM1109 | LYM1109 | FOXTAIL Setaria italica | | 349 | 565 |
| LYM1110 | LYM1110 | FOXTAIL Setaria italica | | 350 | 566 |
| LYM1111 | LYM1111 | FOXTAIL Setaria italica | 8265, 8413, 8265, 8413 | 351 | 733 |
| LYM1112 | LYM1112_GA | | | 352 | 568 |
| LYM1113 | LYM1113 | FOXTAIL Setaria italica | 8266, 8414, 8530, 8607 | 353 | 569 |
| LYM1114 | LYM1114 | FOXTAIL Setaria italica | 8267, 8415, 8267, 8415 | 354 | 570 |
| LYM1115 | LYM1115 | FOXTAIL Setaria italica | 8268, 8416, 8268, 8608 | 355 | 571 |
| LYM1116 | LYM1116 | FOXTAIL Setaria italica | 8269, 8417, 8531, 8609 | 356 | 572 |
| LYM1117 | LYM1117 | FOXTAIL Setaria italica | 8270, 8418, 8532, 8610 | 357 | 573 |
| LYM1118 | LYM1118 | FOXTAIL Setaria italica | 8271, 8419, 8271, 8419 | 358 | 574 |
| LYM1120 | LYM1120_GA | | | 359 | 576 |
| LYM1121 | LYM1121 | FOXTAIL Setaria italica | 8272, 8420, 8533, 8611 | 360 | 577 |
| LYM1122 | LYM1122 | FOXTAIL Setaria italica | 8273, 8421, 8534, 8612 | 361 | 578 |
| LYM1123 | LYM1123 | FOXTAIL Setaria italica | 8274, 8422, 8535, 8613 | 362 | 734 |
| LYM1124 | LYM1124 | FOXTAIL Setaria italica | 8275, 8423, 8536, 8614 | 363 | 580 |
| LYM1125 | LYM1125 | FOXTAIL Setaria italica | 8276, 8424, 8276, 8424 | 364 | 735 |
| LYM1126 | LYM1126 | FOXTAIL Setaria italica | 8277, 8425, 8277, 8425 | 365 | 582 |
| LYM1127 | LYM1127 | FOXTAIL Setaria italica | 8278, 8426, 8537, 8615 | 366 | 736 |
| LYM1128 | LYM1128_GA | | | 367 | 584 |
| LYM1129 | LYM1129 | MAIZE Zea mays L. | 8279, 8427, 8279, 8427 | 368 | 585 |
| LYM1130 | LYM1130 | MAIZE Zea mays L. | 8280, 8428, 8538, 8616 | 369 | 737 |
| LYM1131 | LYM1131 | MAIZE Zea mays L. | 8281, 8429, 8539, 8617 | 370 | 738 |
| LYM1132 | LYM1132_GA | | | 371 | 588 |
| LYM1133 | LYM1133_GA | | | 372 | 589 |
| LYM1134 | LYM1134_GA | | | 373 | 590 |
| LYM1136 | LYM1136_GA | | | 374 | 591 |
| LYM1137 | LYM1137 | MAIZE Zea mays L. | 8282, 8430, 8282, 8430 | 375 | 592 |
| LYM1138 | LYM1138 | MAIZE Zea mays L. | 8283, 8431, 8540, 8618 | 376 | 593 |
| LYM1139 | LYM1139 | MAIZE Zea mays L. | | 377 | 594 |
| LYM1140 | LYM1140_GA | | | 378 | 595 |
| LYM1141 | LYM1141 | MAIZE Zea mays L. | 8285, 8433, 8541, 8619 | 379 | 596 |
| LYM1142 | LYM1142 | MAIZE Zea mays L. | 8286, 8434, 8286, 8434 | 380 | 739 |
| LYM1143 | LYM1143 | MAIZE Zea mays L. | 8287, 8435, 8287, 8435 | 381 | 740 |
| LYM1146 | LYM1146 | MAIZE Zea mays L. | 8288, 8436, 8542, 8620 | 382 | 599 |
| LYM1149 | LYM1149 | MAIZE Zea mays L. | 8289, 8437, 8543, 8621 | 383 | 600 |
| LYM1151 | LYM1151 | MAIZE Zea mays L. | 8290, 8438, 8290, 8438 | 384 | 601 |
| LYM1152 | LYM1152_GA | | | 385 | 602 |
| LYM1153 | LYM1153_GA | | | 386 | 603 |
| LYM1154 | LYM1154 | MAIZE Zea mays L. | 8291, 8439, 8544, 8622 | 387 | 604 |
| LYM1155 | LYM1155 | MAIZE Zea mays L. | 8292, 8440, 8292, 8440 | 388 | 605 |

TABLE 107-continued

Cloning Table

| Gene Name | High copy plasmid | Organism | Primers used SEQ ID NOs: | Polynucleotide SEQ ID NO: | Polypeptide SEQ ID NO: |
|---|---|---|---|---|---|
| LYM1156 | LYM1156 | MAIZE Zea mays L. | 8293, 8441, 8545, 8623 | 389 | 606 |
| LYM1157 | LYM1157_GA | | | 390 | 607 |
| LYM1158 | LYM1158 | MAIZE Zea mays L. | 8294, 8442, 8546, 8624 | 391 | 741 |
| LYM1159 | LYM1159 | MAIZE Zea mays L. | 8295, 8443, 8547, 8625 | 392 | 609 |
| LYM1160 | LYM1160 | MAIZE Zea mays L. | 8296, 8444, 8296, 8444 | 393 | 610 |
| LYM1161 | LYM1161 | MAIZE Zea mays L. | 8297, 8445, 8548, 8626 | 394 | 611 |
| LYM1163 | LYM1163_GA | | | 395 | 613 |
| LYM1165 | LYM1165 | MAIZE Zea mays L. | 8299, 8447, 8299, 8447 | 396 | 615 |
| LYM1167 | LYM1167 | MAIZE Zea mays L. | 8300, 8448, 8549, 8627 | 397 | 742 |
| LYM1168 | LYM1168 | MAIZE Zea mays L. | 8301, 8449, 8301, 8449 | 398 | 743 |
| LYM1169 | LYM1169 | MAIZE Zea mays L. | 8302, 8450, 8550, 8628 | 399 | 618 |
| LYM1170 | LYM1170 | MAIZE Zea mays L. | 8303, 8451, 8551, 8629 | 400 | 619 |
| LYM1171 | LYM1171 | MAIZE Zea mays L. | 8304, 8452, 8552, 8630 | 401 | 744 |
| LYM1172 | LYM1172_GA | | | 402 | 621 |
| LYM1173 | LYM1173 | MAIZE Zea mays L. | 8305, 8453, 8305, 8453 | 403 | 745 |
| LYM1174 | LYM1174 | MAIZE Zea mays L. | 8306, 8454, 8306, 8454 | 404 | 623 |
| LYM1175 | LYM1175_GA | | | 405 | 624 |
| LYM1176 | LYM1176 | MAIZE Zea mays L. | 8307, 8455, 8307, 8455 | 406 | 746 |
| LYM1177 | LYM1177 | MAIZE Zea mays L. | 8308, 8456, 8308, 8456 | 407 | 747 |
| LYM1178 | LYM1178 | MAIZE Zea mays L. | 8309, 8457, 8309, 8457 | 408 | 627 |
| LYM1179 | LYM1179 | MAIZE Zea mays L. | 8310, 8458, 8553, 8631 | 409 | 628 |
| LYM1180 | LYM1180 | MAIZE Zea mays L. | 8311, 8459, 8311, 8459 | 410 | 629 |
| LYM1181 | LYM1181 | MAIZE Zea mays L. | 8312, 8460, 8554, 8632 | 411 | 630 |
| LYM1182 | LYM1182_GA | | | 412 | 631 |
| LYM1183 | LYM1183 | MAIZE Zea mays L. | 8313, 8461, 8313, 8461 | 413 | 632 |
| LYM1184 | LYM1184 | MAIZE Zea mays L. | 8314, 8462, 8555, 8633 | 414 | 748 |
| LYM1185 | LYM1185 | MAIZE Zea mays L. | 8315, 8463, 8556, 8634 | 415 | 749 |
| LYM1186 | LYM1186 | MAIZE Zea mays L. | 8316, 8464, 8557, 8635 | 416 | 750 |
| LYM1187 | LYM1187 | MAIZE Zea mays L. | 8317, 8465, 8317, 8465 | 417 | 751 |
| LYM1188 | LYM1188 | RICE Oryza sativa L. | 8318, 8466, 8558, 8636 | 418 | 637 |
| LYM1189 | LYM1189_GA | | | 419 | 638 |
| LYM1190 | LYM1190 | RICE Oryza sativa L. | 8319, 8467, 8319, 8467 | 420 | 639 |
| LYM1191 | LYM1191 | RICE Oryza sativa L. | 8320, 8468, 8559, 8637 | 421 | 640 |
| LYM1192 | LYM1192 | RICE Oryza sativa L. | 8321, 8469, 8321, 8469 | 422 | 641 |
| LYM1193 | LYM1193_GA | | | 423 | 642 |
| LYM1194 | LYM1194_GA | | | 424 | 643 |
| LYM1195 | LYM1195 | SORGHUM Sorghum bicolor | 8322, 8470, 8322, 8470 | 425 | 644 |
| LYM1201 | LYM1201_GA | | | 426 | 645 |
| LYM1202 | LYM1202_GA | | | 427 | 646 |
| LYM1203 | LYM1203 | SORGHUM Sorghum bicolor | 8324, 8472, 8324, 8472 | 428 | 752 |
| LYM1204 | LYM1204 | SORGHUM Sorghum bicolor | 8325, 8473, 8560, 8638 | 429 | 753 |
| LYM1205 | LYM1205 | SORGHUM Sorghum bicolor | 8326, 8474, 8561, 8639 | 430 | 754 |
| LYM1206 | LYM1206 | SORGHUM Sorghum bicolor | 8327, 8475, 8562, 8640 | 431 | 650 |
| LYM1207 | LYM1207 | SORGHUM Sorghum bicolor | 8328, 8476, 8328, 8476 | 432 | 651 |
| LYM1208 | LYM1208 | SORGHUM Sorghum bicolor | 8329, 8477, 8563, 8641 | 433 | 652 |
| LYM1209 | LYM1209 | SORGHUM Sorghum bicolor | 8330, 8478, 8564, 8642 | 434 | 653 |
| LYM1210 | LYM1210 | SORGHUM Sorghum bicolor | 8331, 8479, 8331, 8479 | 435 | 654 |
| LYM1211 | LYM1211 | SORGHUM Sorghum bicolor | 8332, 8480, 8565, 8643 | 436 | 655 |
| LYM1212 | LYM1212 | SORGHUM Sorghum bicolor | 8333, 8481, 8566, 8644 | 437 | 656 |
| LYM1213 | LYM1213 | SORGHUM Sorghum bicolor | 8334, 8482, 8567, 8645 | 438 | 657 |
| LYM1214 | LYM1214 | SORGHUM Sorghum bicolor | 8335, 8483, 8335, 8483 | 439 | 658 |
| LYM1215 | LYM1215_GA | | | 440 | 659 |
| LYM1216 | LYM1216 | SOYBEAN Glycine max | 8336, 8484, 8568, 8646 | 441 | 660 |
| LYM1217 | LYM1217 | SOYBEAN Glycine max | 8337, 8485, 8337, 8485 | 442 | 661 |
| LYM1218 | LYM1218_GA | | | 443 | 662 |
| LYM1219 | LYM1219 | SOYBEAN Glycine max | 8338, 8486, 8338, 8486 | 444 | 663 |
| LYM1220 | LYM1220 | SOYBEAN Glycine max | 8339, 8487, 8339, 8487 | 445 | 664 |
| LYM1221 | LYM1221 | SOYBEAN Glycine max | | 446 | 665 |
| LYM1223 | LYM1223 | SOYBEAN Glycine max | 8341, 8489, 8569, 8647 | 447 | 667 |
| LYM1224 | LYM1224 | SOYBEAN Glycine max | 8342, 8490, 8570, 8648 | 448 | 668 |
| LYM1225 | LYM1225 | SOYBEAN Glycine max | 8343, 8491, 8571, 8649 | 449 | 669 |
| LYM1226 | LYM1226 | SOYBEAN Glycine max | 8344, 8492, 8572, 8650 | 450 | 670 |
| LYM1227 | LYM1227_GA | | | 451 | 671 |
| LYM1228 | LYM1228_GA | | | 452 | 672 |
| LYM1229 | LYM1229_GA | | | 453 | 673 |
| LYM1230 | LYM1230 | TOMATO Lycopersicum esculentum | 8345, 8493, 8573, 8651 | 454 | 674 |
| LYM1231 | LYM1231 | TOMATO Lycopersicum esculentum | 8346, 8494, 8346, 8494 | 455 | 755 |
| LYM1232 | LYM1232 | TOMATO Lycopersicum esculentum | 8347, 8495, 8347, 8495 | 456 | 676 |
| LYM1233 | LYM1233 | TOMATO Lycopersicum esculentum | 8348, 8496, 8348, 8496 | 457 | 677 |
| LYM1234 | LYM1234_GA | | | 458 | 678 |
| LYM1235 | LYM1235_GA | | | 459 | 679 |

TABLE 107-continued

Cloning Table

| Gene Name | High copy plasmid | Organism | Primers used SEQ ID NOs: | Polynucleotide SEQ ID NO: | Polypeptide SEQ ID NO: |
|---|---|---|---|---|---|
| LYM1236 | LYM1236 | BRACHYPODIUM Brachypodiums dis | 8349, 8497, 8574, 8652 | 460 | 756 |
| LYM1237 | LYM1237 | BRACHYPODIUM Brachypodiums dis | 8350, 8498, 8575, 8653 | 461 | 757 |
| LYM1239 | LYM1239_GA | | | 462 | 682 |
| LYM1240 | LYM1240 | TOMATO Lycopersicum esculentum | 8351, 8499, 8351, 8499 | 463 | 758 |
| LYM1032_H1 | LYM1032_H1 | WHEAT Triticum aestivum L. | 8219, 8367, 8219, 8367 | 464 | 759 |
| LYM1058_H4 | LYM1058_H4_GA | | | 465 | 685 |
| LYM1059_H7 | LYM1059_H7_GA | | | 466 | 686 |
| LYM1064_H5 | LYM1064_H5_GA | | | 467 | 687 |
| LYM1076_H4 | LYM1076_H4 | RICE Oryza sativa L. | 8245, 8393, 8518, 8594 | 468 | 688 |
| LYM1091_H5 | LYM1091_H5_GA | | | 469 | 689 |
| LYM1101_H3 | LYM1101_H3_GA | | | 470 | 690 |
| LYM1105_H2 | LYM1105_H2_GA | | | 471 | 691 |
| LYM1164_H1 | LYM1164_H1 | SORGHUM Sorghum bicolor | 8298, 8446, 8298, 8446 | 472 | 760 |
| LYM1196 | LYM1196 | SORGHUM Sorghum bicolor | 8323, 8471, 8323, 8471 | 473 | |

For cloning of each gene at least 2 primers were used: Forward (Fwd) or Reverse (Rev). In some cases, 4 primers were used: External forward (EF), External reverse (ER), nested forward (NF) or nested reverse (NR). The sequences of the primers used for cloning the genes are provided in the sequence listing. Some genes were synthetically produced by GeneArt (marked as "GA").

Example 16

Transforming *Agrobacterium tumefaciens* Cells with Binary Vectors Harboring Putative Genes The above described binary vectors were used to transform *Agrobacterium* cells. Two additional binary constructs, having only the At6669 or the 35S promoter, or no additional promoter were used as negative controls.

The binary vectors were introduced to *Agrobacterium tumefaciens* GV301 or LB4404 (for *Arabidopsis*) or AGL1 (for Brachypodium) competent cells (about $10^9$ cells/mL) by electroporation. The electroporation was performed using a MicroPulser electroporator (Biorad), 0.2 cm cuvettes (Biorad) and EC-2 electroporation program (Biorad). The treated cells were cultured in LB liquid medium at 28° C. for 3 hours, then plated over LB agar supplemented with gentamycin (for *Arabidopsis*; 50 mg/L; for *Agrobacterium* strains GV301) or streptomycin (for *Agrobacterium*; 300 mg/L; for *Agrobacterium* strain LB4404); or with Carbenicillin (for Brachypodium; 50 mg/L) and kanamycin (for *Arabidopsis* and Brachypodium; 50 mg/L) at 28° C. for 48 hours. *Agrobacterium* colonies, which were developed on the selective media, were further analyzed by PCR using the primers designed to span the inserted sequence in the pPI plasmid. The resulting PCR products were isolated and sequenced to verify that the correct polynucleotide sequences of the invention were properly introduced to the *Agrobacterium* cells.

Example 17

Producing Transgenic *Arabidopsis* Plants Expressing Selected Genes According to Some Embodiments of the Invention Materials and Experimental Methods Plant transformation—The *Arabidopsis thaliana* var Columbia ($T_0$ plants) were transformed according to the Floral Dip procedure [Clough S J, Bent A F. (1998) Floral dip: a simplified method for *Agrobacterium*-mediated transformation of *Arabidopsis thaliana*. Plant J. 16(6): 735-43; and Desfeux C, Clough S J, Bent A F. (2000) Female reproductive tissues were the primary targets of *Agrobacterium*-mediated transformation by the *Arabidopsis* floral-dip method. Plant Physiol. 123(3): 895-904] with minor modifications. Briefly, *Arabidopsis thaliana* Columbia (Col0) $T_0$ plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_0$ plants were ready for transformation six days before anthesis. Single colonies of *Agrobacterium* carrying the binary vectors harboring the yield genes were cultured in LB medium supplemented with kanamycin (50 mg/L) and gentamycin (50 mg/L). The cultures were incubated at 28° C. for 48 hours under vigorous shaking and centrifuged at 4000 rpm for 5 minutes. The pellets comprising *Agrobacterium* cells were resuspended in a transformation medium which contained half-strength (2.15 g/L) Murashige-Skoog (Duchefa); 0.044 µM benzylamino purine (Sigma); 112 µg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an *Agrobacterium* suspension such that the above ground plant tissue was submerged for 3-5 seconds. Each inoculated $T_0$ plant was immediately placed in a plastic tray, then covered with clear plastic dome to maintain humidity and was kept in the dark at room temperature for 18 hours to facilitate infection and transformation. Transformed (transgenic) plants were then uncovered and transferred to a greenhouse for recovery and maturation. The transgenic T₀ plants were grown in the greenhouse for 3-5 weeks until siliques were brown and dry, then seeds were harvested from plants and kept at room temperature until sowing.

For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochlorite and 0.05% triton for 5 minutes. The surface-sterilized seeds were thoroughly washed in sterile distilled water then placed on culture plates containing half-strength Murashig-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital $T_1$ Arabidopsis plants were transferred to a fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 18

Transformation of Brachypodium Distachyon Plants with the Polynucleotides of the Invention Similar to the Arabidopsis model plant, Brachypodium distachyon has several features that recommend it as a model plant for functional genomic studies, especially in the grasses. Traits that make it an ideal model include its small genome (~160 Mbp for a diploid genome and 355 Mbp for a polyploidy genome), small physical stature, a short lifecycle, and few growth requirements. Brachypodium is related to the major cereal grain species but is understood to be more closely related to the Triticeae (wheat, barley) than to the other cereals. Brachypodium, with its polyploidy accessions, can serve as an ideal model for these grains (whose genomics size and complexity is a major barrier to biotechnological improvement).

Brachypodium distachyon embryogenic calli were transformed using the procedure described by Vogel and Hill (2008) [High-efficiency Agrobacterium-mediated transformation of Brachypodium distachyon inbred line Bd21-3. Plant Cell Rep 27:471-478], Vain et al (2008) [Agrobacterium-mediated transformation of the temperate grass Brachypodium distachyon (genotypeBd21) for T-DNA insertional mutagenesis. Plant Biotechnology J 6: 236-245], and Vogel J, et al. (2006) [Agrobacterium mediated transformation and inbred line development in the model grass Brachypodium distachyon. Plant Cell Tiss Org. Cult. 85:199-211], each of which is fully incorporated herein by reference, with some minor modifications, which are briefly summarized hereinbelow.

Callus initiation—Immature spikes (about 2 months after seeding) were harvested at the very beginning of seeds filling. Spikes were then husked and surface sterilized with 3% NaClO containing 0.1% Tween 20, shaked on a gyratory shaker at low speed for 20 minutes. Following three rinses with sterile distilled water, embryos were excised under a dissecting microscope in a laminar flow hood using fine forceps.

Excised embryos (size—0.3 mm, bell shaped) were placed on callus induction medium (CIM) [LS salts (Linsmaier, E. M. & Skoog, F. 1965. Physiol. Plantarum 18, 100) and vitamins plus 3% sucrose, 6 mg/L $CuSO_4$, 2.5 mg/l 2,4-Dichlorophenoxyacetic Acid, pH 5.8 and 0.25% phytagel (Sigma)] scutellar side down, 100 embryos on a plate, and incubated at 28° C. in the dark. Ten days later, the embryonic calli were cleaned from emerging roots, shoots and somatic calli, and was subcultured onto fresh CIM medium. During culture, yellowish embryogenic calli (EC) appeared and were further selected (e.g., picked and transferred) for further incubation in the same conditions for additional 2 weeks. Twenty-five pieces of sub-cultured calli were then separately placed on 90×15 mm petri plates, and incubated as before for three additional weeks.

Transformation—As described in Vogel and Hill (2008, Supra), Agrobacterium was scraped off 2-day-old MGL plates (plates with the MGL medium which contains: Tryptone 5 g/l, Yeast Extract 2.5 g/l, NaCl 5 g/l, D-Mannitol 5 g/l, $MgSO_4*7H_2O$ 0.204 g/l, $K_2HPO_4$ 0.25 g/l, Glutamic Acid 1.2 g/l, Plant Agar 7.5 g/l) and resuspended in liquid MS medium supplemented with 200 µM acetosyringone to an optic density (OD) at 600 nm ($OD_{600}$) of 0.6. Once the desired OD was attained, 1 ml of 10% Synperonic PE/F68 (Sigma) per 100 ml of inoculation medium was added.

To begin inoculation, 300 callus pieces were placed in approximately 12 plates (25 callus pieces in each plate) and covered with the Agrobacterium suspension (8-8.5 ml). The calli were incubated in the Agrobacterium suspension for 15 minutes with occasional gentle rocking. After incubation, the Agrobacterium suspension was aspirated off and the calli were then transferred into co-cultivation plates, prepared by placing a sterile 7-cm diameter filter paper in an empty 90×15 mm petri plate. The calli pieces were then gently distributed on the filter paper. One co-cultivation plate was used for two starting callus plates (50 initial calli pieces). The co-cultivation plates were then sealed with saran wrap and incubated at 24° C. in the dark for 3 days.

The callus pieces were then individually transferred onto CIM medium as described above, which was further supplemented with 200 mg/l Ticarcillin (to kill the Agrobacterium) and Bialaphos (5 mg/L) (for selection of the transformed resistant embryogenic calli sections), and incubated at 28° C. in the dark for 14 days.

The calli pieces were then transferred to shoot induction media (SIM; LS salts and vitamins plus 3% Maltose monohydrate) supplemented with 200 mg/l Ticarcillin, Bialaphos (5 mg/L), Indol-3-acetic acid (IAA) (0.25 mg/L), and 6-Benzylaminopurine (BAP) (1 mg/L), and were sub-cultured in light to the same media after 10 days (total of 20 days). At each sub-culture all the pieces from a single callus were kept together to maintain their independence and were incubated under the following conditions: lighting to a level of 60 lE m-2 s-1, a 16-h light, 8-h dark photoperiod and a constant 24° C. temperature. Plantlets emerged from the transformed calli.

When plantlets were large enough to handle without damage, they were transferred to plates containing the above mentioned shoot induction media (SIM) with Bialaphos. Each plantlet was considered as a different event. The plantlets grew axillary tillers and eventually became bushy. Each bush from the same plant (event ID) was then divided to tissue culture boxes ("Humus") containing "rooting medium" [MS basal salts, 3% sucrose, 3 g/L phytagel, 2 mg/l a-Naphthalene Acetic Acid (NAA) and 1 mg/L IAA and Ticarcillin 200 mg/L, PH 5.8). All plants in a "Humus box" were different plants of the same transformation event. These plants are tested in bulk for expression of bar gene responsible for resistance to glufosinate using strips AgraStrip® LL, Romer Labs.

When plantlets established roots they were transplanted to soil and transferred to a greenhouse. To verify the transgenic status of plants containing the other constructs, T0 plants were subjected to PCR as previously described by Vogel et al. 2006 [*Agrobacterium* mediated transformation and inbred line development in the model grass Brachypodium distachyon. Plant Cell Tiss Org. Cult. 85:199-211].

Example 19

Evaluation of Transgenic *Arabidopsis* for Seed Yield and Plant Growth Rate Under Normal Conditions in Greenhouse Assays (GH—SM Assays)

Assay 1: Seed yield plant biomass and plant growth rate under normal greenhouse conditions—This assay follows seed yield production, the biomass formation and the rosette area growth of plants grown in the greenhouse at non-limiting nitrogen growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing 6 mM inorganic nitrogen in the form of $KNO_3$ with 1 mM $KH_2PO_4$, 1 mM $MgSO_4$, 2 mM $CaCl_2$ and microelements. All plants were grown in the greenhouse until mature seeds. Seeds were harvested, extracted and weighted. The remaining plant biomass (the above ground tissue) was also harvested, and weighted immediately or following drying in oven at 50° C. for 24 hours.

Each construct was validated at its $T_2$ generation. Transgenic plants transformed with a construct conformed by an empty vector carrying the At6669 promoter and the selectable marker were used as control.

The plants were analyzed for their overall size, growth rate, flowering, seed yield, 1,000-seed weight, dry matter and harvest index (HI-seed yield/dry matter). Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at rsbweb(dot)nih(dot)gov/]. Images are captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, and leaf blade area.

Vegetative growth rate: the relative growth rate (RGR) of leaf number (Formula VIII), rosette area (Formula IX), plot coverage (Formula XI) and harvest index (Formula XV) was calculated with the indicated formulas as described above.

Seeds average weight—At the end of the experiment all seeds were collected. The seeds were scattered on a glass tray and a picture is taken. Using the digital analysis, the number of seeds in each sample was calculated.

Dry weight and seed yield—On about day 80 from sowing, the plants were harvested and left to dry at 30° C. in a drying chamber. The biomass and seed weight of each plot were measured and divided by the number of plants in each plot.

Dry weight=total weight of the vegetative portion above ground (excluding roots) after drying at 30° C. in a drying chamber;

Seed yield per plant=total seed weight per plant (gr.).

1000 seed weight (the weight of 1000 seeds) (gr.).

Oil percentage in seeds—At the end of the experiment all seeds from each plot were collected. Seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) was used to create a calibration curve for the Low Resonance NMR. The content of oil of all seed samples was determined using the Low Resonance NMR (MARAN Ultra-Oxford Instrument) and its MultiQuant software package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Statistical analyses—To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Tables 108-112 summarize the observed phenotypes of transgenic plants exogenously expressing the gene constructs using the seed maturation (GH-SM) assays under normal conditions. The evaluation of each gene was performed by testing the performance of different number of events. Event with p-value <0.1 was considered statistically significant.

TABLE 108

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LYM1062 | 81476.3 | — | — | — | 33.5 | L | −6 | — | — | — |
| LYM1019 | 81663.3 | — | — | — | 32.1 | 0.10 | −10 | 25.1 | L | −6 |
| LYM1019 | 81665.1 | — | — | — | — | — | — | 25.2 | L | −5 |
| CONT. | — | — | — | — | 35.7 | — | — | 26.6 | — | — |
| LYM1240 | 80614.1 | — | — | — | 37.0 | 0.15 | −3 | — | — | — |
| LYM1240 | 80614.4 | — | — | — | 37.2 | 0.21 | −3 | — | — | — |
| LYM1236 | 80505.4 | — | — | — | 36.8 | 0.13 | −4 | — | — | — |
| LYM1236 | 80505.5 | — | — | — | 37.6 | 0.26 | −2 | — | — | — |
| LYM1224 | 81497.3 | — | — | — | 35.7 | L | −7 | 27.5 | L | −7 |
| LYM1224 | 81497.4 | — | — | — | 36.2 | 0.02 | −5 | — | — | — |
| LYM1224 | 81498.3 | — | — | — | 37.5 | 0.22 | −2 | — | — | — |
| LYM1224 | 81498.6 | — | — | — | 36.8 | 0.29 | −4 | — | — | — |
| LYM1213 | 81340.3 | — | — | — | 37.4 | 0.21 | −2 | — | — | — |
| LYM1206 | 81222.2 | — | — | — | 37.5 | 0.22 | −2 | — | — | — |
| LYM1188 | 81028.4 | — | — | — | 37.3 | 0.13 | −3 | — | — | — |
| LYM1165 | 80587.2 | — | — | — | 35.1 | 0.09 | −8 | 27.3 | 0.05 | −7 |
| LYM1165 | 80588.3 | — | — | — | 36.5 | 0.02 | −5 | — | — | — |
| LYM1165 | 80590.3 | — | — | — | 37.2 | 0.30 | −3 | — | — | — |
| LYM1165 | 80590.6 | — | — | — | 37.1 | 0.13 | −3 | — | — | — |
| LYM1159 | 80276.5 | 1915.6 | 0.03 | 29 | — | — | — | — | — | — |
| LYM1143 | 80542.2 | — | — | — | 37.3 | 0.13 | −3 | — | — | — |
| LYM1126 | 80935.2 | — | — | — | 37.6 | 0.27 | −2 | — | — | — |
| LYM1089 | 81093.1 | — | — | — | 36.2 | 0.02 | −5 | — | — | — |
| LYM1089 | 81095.1 | 1592.5 | 0.18 | 7 | — | — | — | — | — | — |
| LYM1079 | 81354.5 | — | — | — | 37.0 | 0.15 | −3 | — | — | — |
| LYM1079 | 81355.5 | 1902.2 | 0.12 | 28 | — | — | — | — | — | — |
| LYM1065 | 80968.3 | — | — | — | 37.3 | 0.16 | −2 | — | — | — |
| LYM1062 | 81474.2 | — | — | — | 35.8 | L | −6 | — | — | — |
| LYM1062 | 81476.3 | — | — | — | 36.5 | 0.18 | −5 | — | — | — |
| CONT. | — | 1488.7 | — | — | 38.3 | — | — | 29.4 | — | — |
| LYM1240 | 80615.1 | — | — | — | — | — | — | 26.8 | 0.13 | −2 |
| LYM1240 | 80615.2 | — | — | — | — | — | — | 26.8 | 0.07 | −2 |
| LYM1224 | 81497.4 | — | — | — | — | — | — | 26.8 | 0.13 | −2 |
| LYM1224 | 81497.6 | — | — | — | 35.9 | 0.04 | −5 | 26.4 | 0.19 | −4 |
| LYM1224 | 81498.3 | — | — | — | 34.6 | 0.18 | −9 | 25.5 | L | −7 |
| LYM1224 | 81498.6 | — | — | — | — | — | — | 26.1 | 0.19 | −5 |
| LYM1206 | 81220.5 | — | — | — | 36.7 | 0.11 | −3 | 26.9 | 0.15 | −2 |
| LYM1206 | 81223.3 | — | — | — | — | — | — | 27.0 | 0.20 | −2 |
| LYM1190 | 80378.1 | — | — | — | 36.8 | 0.25 | −3 | 26.7 | 0.04 | −3 |
| LYM1190 | 80378.7 | — | — | — | 37.0 | L | −2 | 26.9 | 0.15 | −2 |
| LYM1190 | 80379.3 | — | — | — | — | — | — | 26.7 | 0.06 | −3 |
| LYM1188 | 81028.4 | — | — | — | — | — | — | 27.0 | 0.20 | −2 |
| LYM1188 | 81030.1 | — | — | — | — | — | — | 26.5 | 0.03 | −3 |
| LYM1181 | 80371.6 | — | — | — | — | — | — | 26.8 | 0.13 | −2 |
| LYM1181 | 80373.1 | — | — | — | — | — | — | 26.3 | 0.09 | −4 |
| LYM1181 | 80373.6 | — | — | — | — | — | — | 26.8 | 0.07 | −2 |
| LYM1181 | 80373.8 | — | — | — | — | — | — | 27.0 | 0.20 | −2 |
| LYM1171 | 80591.4 | — | — | — | — | — | — | 26.9 | 0.15 | −2 |
| LYM1171 | 80594.1 | — | — | — | — | — | — | 27.0 | 0.20 | −2 |
| LYM1171 | 80595.5 | — | — | — | — | — | — | 26.5 | 0.03 | −3 |
| LYM1171 | 80595.7 | — | — | — | — | — | — | 26.7 | 0.17 | −3 |
| LYM1165 | 80587.2 | — | — | — | 34.6 | 0.19 | −8 | 25.7 | 0.03 | −6 |
| LYM1165 | 80588.4 | — | — | — | 36.8 | 0.01 | −3 | 26.9 | 0.15 | −2 |
| LYM1165 | 80590.3 | — | — | — | 37.1 | 0.07 | −2 | 26.9 | 0.15 | −2 |
| LYM1165 | 80590.6 | — | — | — | 36.1 | L | −5 | 26.7 | 0.17 | −3 |
| LYM1159 | 80276.5 | — | — | — | 36.8 | L | −3 | 26.3 | 0.09 | −4 |
| LYM1159 | 80276.6 | — | — | — | — | — | — | 26.9 | 0.15 | −2 |
| LYM1156 | 81017.1 | — | — | — | 37.1 | 0.04 | −2 | 26.9 | 0.15 | −2 |
| LYM1156 | 81019.1 | — | — | — | — | — | — | 27.0 | 0.20 | −2 |
| LYM1143 | 80539.3 | — | — | — | — | — | — | 26.9 | 0.15 | −2 |
| LYM1143 | 80540.1 | — | — | — | — | — | — | 26.5 | 0.27 | −3 |
| LYM1143 | 80542.2 | — | — | — | — | — | — | 27.0 | 0.20 | −2 |
| LYM1138 | 81477.5 | — | — | — | — | — | — | 26.7 | 0.04 | −3 |
| LYM1138 | 81480.3 | — | — | — | — | — | — | 26.9 | 0.15 | −2 |
| LYM1126 | 80934.2 | — | — | — | — | — | — | 26.9 | 0.15 | −2 |
| LYM1126 | 80934.5 | — | — | — | — | — | — | 27.0 | 0.20 | −2 |
| LYM1126 | 80935.2 | — | — | — | — | — | — | 26.8 | 0.13 | −2 |
| LYM1126 | 80935.4 | — | — | — | — | — | — | 27.1 | 0.29 | −1 |
| LYM1099 | 81215.5 | — | — | — | — | — | — | 26.8 | 0.13 | −2 |
| LYM1099 | 81216.3 | — | — | — | — | — | — | 27.0 | 0.20 | −2 |
| LYM1079 | 81354.5 | — | — | — | — | — | — | 27.0 | 0.20 | −2 |

TABLE 108-continued

Genes showing improved plant performance at Normal growth conditions under regulation of At6669 promoter

| Gene Name | Event # | Dry Weight [mg] Ave. | P-Val. | % Incr. | Flowering Ave. | P-Val. | % Incr. | Inflorescence Emergence Ave. | P-Val. | % Incr. |
|---|---|---|---|---|---|---|---|---|---|---|
| LYM1079 | 81355.5 | — | — | — | — | — | — | 27.0 | 0.20 | −2 |
| LYM1079 | 81358.1 | — | — | — | — | — | — | 26.7 | 0.17 | −3 |
| LYM1079 | 81358.2 | — | — | — | 35.9 | L | −5 | 26.4 | 0.01 | −4 |
| LYM1068 | 81084.1 | — | — | — | — | — | — | 27.0 | 0.20 | −2 |
| LYM1068 | 81085.1 | — | — | — | — | — | — | 27.0 | 0.20 | −2 |
| LYM1065 | 80968.3 | — | — | — | — | — | — | 27.0 | 0.20 | −2 |
| LYM1065 | 80970.3 | — | — | — | — | — | — | 26.8 | 0.07 | −2 |
| LYM1065 | 80971.1 | — | — | — | — | — | — | 26.6 | 0.09 | −3 |
| LYM1065 | 80971.3 | — | — | — | — | — | — | 27.0 | 0.20 | −2 |
| LYM1065 | 80971.4 | — | — | — | 37.1 | 0.04 | −2 | 27.0 | 0.20 | −2 |
| CONT. | — | — | — | — | 37.8 | — | — | 27.4 | — | — |
| LYM1171 | 80591.4 | 1804.4 | 0.18 | 23 | — | — | — | — | — | — |
| LYM1171 | 80594.1 | — | — | — | — | — | — | 27.1 | 0.07 | −2 |
| LYM1171 | 80595.3 | — | — | — | — | — | — | 27.2 | 0.12 | −2 |
| LYM1171 | 80595.7 | — | — | — | — | — | — | 27.0 | 0.03 | −3 |
| LYM1167 | 80183.4 | — | — | — | — | — | — | 27.2 | 0.12 | −2 |
| LYM1110 | 81005.2 | — | — | — | 34.7 | 0.04 | −3 | 27.0 | 0.03 | −3 |
| LYM1100 | 80988.5 | — | — | — | — | — | — | 27.2 | 0.12 | −2 |
| LYM1092 | 81365.2 | — | — | — | 34.5 | 0.14 | −3 | 27.0 | 0.03 | −3 |
| LYM1092 | 81366.5 | — | — | — | — | — | — | 27.1 | 0.05 | −2 |
| LYM1092 | 81366.6 | — | — | — | — | — | — | 27.2 | 0.17 | −2 |
| LYM1056 | 80339.1 | — | — | — | — | — | — | 27.2 | 0.12 | −2 |
| LYM1056 | 80339.3 | — | — | — | 35.2 | 0.22 | −1 | 27.1 | 0.07 | −2 |
| LYM1056 | 80340.1 | — | — | — | — | — | — | 27.0 | 0.03 | −3 |
| LYM1055 | 81145.2 | 1600.6 | 0.09 | 9 | — | — | — | — | — | — |
| LYM1055 | 81146.3 | — | — | — | 35.2 | 0.22 | −1 | 27.2 | 0.12 | −2 |
| LYM1049 | 80103.6 | — | — | — | — | — | — | 27.2 | 0.12 | −2 |
| LYM1043 | 81236.1 | — | — | — | — | — | — | 27.2 | 0.12 | −2 |
| LYM1043 | 81237.4 | — | — | — | — | — | — | 27.1 | 0.05 | −2 |
| LYM1043 | 81238.2 | — | — | — | 34.7 | 0.23 | −3 | 27.1 | 0.05 | −2 |
| LYM1041 | 80957.4 | 1693.8 | 0.03 | 15 | — | — | — | — | — | — |
| LYM1041 | 80961.2 | — | — | — | — | — | — | 27.0 | 0.03 | −3 |
| LYM1040 | 80952.5 | — | — | — | — | — | — | 27.0 | 0.03 | −3 |
| LYM1040 | 80956.1 | — | — | — | 35.2 | 0.22 | −1 | — | — | — |
| LYM1034 | 80100.6 | — | — | — | — | — | — | 27.0 | 0.03 | −3 |
| LYM1019 | 81663.2 | — | — | — | — | — | — | 27.0 | 0.03 | −3 |
| LYM1019 | 81665.1 | — | — | — | — | — | — | 27.0 | 0.03 | −3 |
| LYM1019 | 81666.1 | — | — | — | — | — | — | 27.2 | 0.12 | −2 |
| LYM1019 | 81666.2 | — | — | — | 34.6 | 0.17 | −3 | 27.1 | 0.05 | −2 |
| LYM1019 | 81666.3 | — | — | — | — | — | — | 27.2 | 0.12 | −2 |
| LYM1010 | 81063.2 | — | — | — | 34.6 | 0.25 | −3 | 27.1 | 0.05 | −2 |
| LYM1010 | 81064.2 | 1586.9 | 0.18 | 8 | — | — | — | — | — | — |
| CONT. | — | 1469.5 | — | — | 35.6 | — | — | 27.7 | — | — |

"CONT."—Control; "Ave."—Average; "% Incr." = % increment; "p-val."—p-value, L-p < 0.01.

It should be noted that a negative increment (in percentages) when found in flowering or inflorescence emergence indicates drought avoidance of the plant.

TABLE 109

Genes showing improved plant performance at Normal growth conditions under regulation of At6669 promoter

| Gene Name | Event # | Leaf Blade Area [cm$^2$] Ave. | P-Val. | % Incr. | Leaf Number Ave. | P-Val. | % Incr. | Plot Coverage [cm$^2$] Ave. | P-Val. | % Incr. |
|---|---|---|---|---|---|---|---|---|---|---|
| LYM1062 | 81474.2 | — | — | — | 9.19 | 0.08 | 3 | — | — | — |
| LYM1062 | 81476.3 | 0.814 | 0.29 | 8 | — | — | — | 43.4 | 0.05 | 9 |
| LYM1061 | 80111.1 | — | — | — | 9.44 | L | 5 | — | — | — |
| LYM1061 | 80111.3 | — | — | — | 9.12 | 0.12 | 2 | — | — | — |
| LYM1061 | 80112.1 | — | — | — | 9.38 | L | 5 | — | — | — |
| LYM1061 | 80112.4 | 0.824 | 0.30 | 9 | — | — | — | — | — | — |
| LYM1061 | 80115.2 | — | — | — | 9.38 | 0.09 | 5 | — | — | — |
| LYM1056 | 80339.1 | 0.804 | 0.15 | 7 | — | — | — | 41.9 | 0.17 | 6 |

TABLE 109-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYM1056 | 80339.3 | — | — | — | — | — | — | 43.8 | 0.14 | 10 |
| LYM1055 | 81146.3 | — | — | — | 9.31 | 0.26 | 4 | — | — | — |
| LYM1049 | 80104.3 | — | — | — | 10.2 | 0.26 | 14 | — | — | — |
| LYM1049 | 80104.5 | — | — | — | 9.44 | 0.18 | 5 | — | — | — |
| LYM1043 | 81234.1 | — | — | — | 9.44 | L | 5 | — | — | — |
| LYM1043 | 81236.1 | — | — | — | 9.31 | 0.26 | 4 | — | — | — |
| LYM1043 | 81238.2 | — | — | — | 9.56 | L | 7 | — | — | — |
| LYM1041 | 80957.2 | — | — | — | 9.56 | L | 7 | — | — | — |
| LYM1041 | 80960.2 | 0.821 | 0.04 | 9 | — | — | — | 43.0 | 0.05 | 8 |
| LYM1041 | 80961.1 | — | — | — | 9.19 | 0.08 | 3 | — | — | — |
| LYM1038 | 80326.4 | — | — | — | 9.38 | 0.09 | 5 | — | — | — |
| LYM1038 | 80327.2 | — | — | — | 9.25 | 0.02 | 3 | — | — | — |
| LYM1036 | 81078.1 | — | — | — | 9.38 | L | 5 | 44.9 | 0.18 | 13 |
| LYM1036 | 81080.6 | — | — | — | 9.38 | 0.09 | 5 | — | — | — |
| LYM1025 | 80091.4 | 0.788 | 0.22 | 5 | — | — | — | — | — | — |
| LYM1025 | 80094.3 | — | — | — | 9.31 | 0.02 | 4 | — | — | — |
| LYM1025 | 80094.4 | — | — | — | 9.50 | L | 6 | — | — | — |
| LYM1019 | 81663.3 | 0.937 | L | 24 | 9.81 | 0.08 | 10 | 51.9 | 0.02 | 31 |
| LYM1019 | 81665.1 | 0.797 | 0.13 | 6 | — | — | — | 42.6 | 0.08 | 7 |
| LYM1019 | 81666.2 | 0.830 | 0.05 | 10 | — | — | — | 45.0 | 0.01 | 13 |
| CONT. | — | 0.754 | — | — | 8.95 | — | — | 39.7 | — | — |
| LYM1240 | 80615.2 | 0.940 | L | 12 | 10.0 | 0.20 | 7 | 50.0 | 0.22 | 13 |
| LYM1236 | 80505.2 | — | — | — | — | — | — | 46.7 | 0.11 | 6 |
| LYM1236 | 80505.5 | 0.965 | L | 15 | — | — | — | 50.2 | 0.03 | 13 |
| LYM1236 | 80506.5 | — | — | — | — | — | — | 49.0 | L | 11 |
| LYM1224 | 81497.4 | 0.965 | L | 15 | 9.62 | 0.21 | 3 | 53.5 | L | 21 |
| LYM1224 | 81497.6 | 0.982 | L | 17 | 9.81 | 0.19 | 5 | 53.7 | 0.21 | 21 |
| LYM1224 | 81498.3 | 1.03 | L | 22 | 9.62 | 0.21 | 3 | 56.0 | L | 27 |
| LYM1224 | 81498.6 | 1.10 | L | 31 | — | — | — | 62.4 | 0.10 | 41 |
| LYM1213 | 81340.3 | 0.877 | 0.19 | 4 | — | — | — | — | — | — |
| LYM1213 | 81340.4 | 0.941 | 0.09 | 12 | — | — | — | 50.7 | 0.27 | 15 |
| LYM1213 | 81343.3 | — | — | — | 10.1 | 0.24 | 8 | — | — | — |
| LYM1213 | 81343.4 | 1.02 | 0.23 | 21 | — | — | — | 53.9 | 0.27 | 22 |
| LYM1206 | 81220.5 | 0.921 | 0.02 | 10 | — | — | — | 49.4 | 0.07 | 12 |
| LYM1188 | 81028.3 | — | — | — | 10.1 | 0.02 | 8 | — | — | — |
| LYM1179 | 80243.1 | 0.933 | L | 11 | 9.94 | L | 6 | 51.1 | 0.01 | 16 |
| LYM1179 | 80243.4 | — | — | — | 10.4 | 0.20 | 11 | — | — | — |
| LYM1179 | 80243.6 | 0.990 | L | 18 | — | — | — | 51.3 | 0.13 | 16 |
| LYM1179 | 80245.1 | 0.981 | 0.15 | 17 | — | — | — | 52.1 | 0.13 | 18 |
| LYM1179 | 80245.3 | 0.891 | 0.10 | 6 | — | — | — | 46.2 | 0.21 | 4 |
| LYM1165 | 80587.2 | 0.997 | 0.04 | 19 | 10.1 | 0.10 | 8 | 55.3 | L | 25 |
| LYM1165 | 80588.3 | 1.04 | 0.01 | 24 | 10.1 | 0.16 | 8 | 58.7 | 0.05 | 33 |
| LYM1165 | 80588.4 | — | — | — | 10.1 | 0.24 | 8 | 51.5 | 0.16 | 16 |
| LYM1165 | 80590.3 | — | — | — | 9.94 | L | 6 | 50.7 | 0.05 | 15 |
| LYM1165 | 80590.6 | 0.951 | 0.16 | 13 | — | — | — | 51.8 | 0.20 | 17 |
| LYM1159 | 80276.5 | 1.01 | 0.19 | 20 | — | — | — | 57.6 | 0.24 | 30 |
| LYM1159 | 80279.2 | — | — | — | 9.69 | 0.29 | 4 | — | — | — |
| LYM1143 | 80539.1 | 0.956 | L | 14 | — | — | — | 50.6 | L | 14 |
| LYM1143 | 80540.1 | 0.876 | 0.20 | 4 | — | — | — | — | — | — |
| LYM1143 | 80541.3 | 0.919 | 0.04 | 9 | — | — | — | 51.4 | L | 16 |
| LYM1143 | 80542.1 | 0.880 | 0.26 | 5 | 9.56 | 0.14 | 2 | 46.7 | 0.14 | 6 |
| LYM1126 | 80934.2 | — | — | — | 9.56 | 0.14 | 2 | — | — | — |
| LYM1126 | 80935.3 | — | — | — | 9.50 | 0.22 | 2 | — | — | — |
| LYM1126 | 80935.5 | — | — | — | 9.75 | L | 4 | — | — | — |
| LYM1099 | 81215.3 | 0.911 | 0.06 | 8 | — | — | — | 48.6 | 0.01 | 10 |
| LYM1099 | 81217.3 | — | — | — | 9.50 | 0.22 | 2 | — | — | — |
| LYM1089 | 81093.1 | 0.909 | 0.05 | 8 | — | — | — | — | — | — |
| LYM1089 | 81095.1 | 1.06 | 0.04 | 25 | — | — | — | 58.5 | L | 32 |
| LYM1079 | 81355.5 | 1.01 | 0.02 | 20 | 9.88 | L | 6 | 55.6 | L | 26 |
| LYM1079 | 81358.2 | — | — | — | — | — | — | 48.3 | 0.28 | 9 |
| LYM1065 | 80968.3 | 0.926 | 0.04 | 10 | — | — | — | 50.2 | L | 14 |
| LYM1065 | 80970.3 | 0.911 | 0.11 | 8 | — | — | — | — | — | — |
| LYM1065 | 80971.3 | 0.908 | 0.03 | 8 | — | — | — | 50.2 | 0.16 | 14 |
| LYM1062 | 81474.2 | 1.13 | 0.01 | 34 | 10.7 | 0.04 | 14 | 66.2 | 0.10 | 50 |
| LYM1062 | 81474.5 | 1.01 | L | 20 | — | — | — | 55.3 | 0.10 | 25 |
| LYM1062 | 81476.2 | — | — | — | — | — | — | 48.5 | 0.07 | 10 |
| LYM1062 | 81476.3 | 1.07 | 0.05 | 27 | 10.4 | 0.30 | 12 | 59.7 | 0.13 | 35 |
| CONT. | — | 0.841 | — | — | 9.36 | — | — | 44.2 | — | — |
| LYM1240 | 80614.4 | 1.21 | 0.02 | 12 | 10.9 | L | 14 | 70.8 | 0.02 | 19 |
| LYM1240 | 80615.1 | 1.29 | 0.30 | 19 | 10.9 | 0.13 | 15 | — | — | — |
| LYM1224 | 81497.3 | — | — | — | 10.1 | 0.08 | 6 | — | — | — |

TABLE 109-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYM1224 | 81497.4 | 1.19 | 0.03 | 10 | — | — | — | 67.8 | 0.06 | 14 |
| LYM1224 | 81497.6 | 1.29 | 0.05 | 19 | — | — | — | 75.4 | 0.26 | 27 |
| LYM1224 | 81498.3 | 1.33 | L | 23 | 10.6 | L | 11 | 79.7 | L | 34 |
| LYM1224 | 81498.6 | 1.31 | 0.06 | 21 | — | — | — | 77.4 | 0.05 | 31 |
| LYM1206 | 81220.5 | 1.19 | 0.05 | 9 | 10.4 | 0.02 | 9 | 68.5 | 0.03 | 16 |
| LYM1190 | 80378.1 | 1.33 | L | 23 | 11.6 | L | 22 | 82.0 | L | 38 |
| LYM1190 | 80378.7 | 1.21 | 0.04 | 11 | — | — | — | 69.2 | 0.17 | 17 |
| LYM1181 | 80371.6 | 1.32 | L | 22 | 10.4 | 0.02 | 9 | 75.8 | L | 28 |
| LYM1181 | 80373.1 | 1.13 | 0.28 | 4 | 10.5 | 0.01 | 10 | 66.7 | 0.06 | 12 |
| LYM1171 | 80591.4 | — | — | — | 10.2 | 0.04 | 7 | — | — | — |
| LYM1171 | 80594.1 | 1.14 | 0.25 | 5 | 10.2 | 0.09 | 7 | 64.6 | 0.22 | 9 |
| LYM1171 | 80595.7 | — | — | — | 10.3 | 0.28 | 8 | — | — | — |
| LYM1165 | 80587.2 | 1.20 | 0.06 | 11 | 9.94 | 0.26 | 4 | 68.5 | 0.02 | 15 |
| LYM1165 | 80588.4 | 1.27 | 0.06 | 17 | 10.0 | 0.14 | 5 | 73.9 | 0.13 | 25 |
| LYM1165 | 80590.6 | 1.26 | L | 16 | 10.2 | 0.09 | 7 | 71.7 | 0.01 | 21 |
| LYM1159 | 80276.5 | 1.38 | L | 27 | 10.8 | 0.22 | 13 | 84.5 | L | 43 |
| LYM1159 | 80276.6 | — | — | — | 10.1 | 0.15 | 6 | — | — | — |
| LYM1159 | 80279.2 | — | — | — | 10.4 | 0.02 | 9 | — | — | — |
| LYM1156 | 81017.1 | 1.27 | L | 17 | 9.94 | 0.26 | 4 | 70.2 | 0.03 | 18 |
| LYM1156 | 81017.4 | 1.15 | 0.28 | 6 | 10.1 | 0.08 | 6 | 65.2 | 0.13 | 10 |
| LYM1143 | 80539.3 | — | — | — | 10.1 | 0.07 | 6 | 69.1 | 0.26 | 16 |
| LYM1143 | 80540.1 | 1.21 | 0.07 | 11 | 10.2 | 0.09 | 7 | 71.1 | L | 20 |
| LYM1138 | 81477.5 | 1.19 | 0.12 | 10 | 10.4 | 0.03 | 9 | 72.8 | L | 23 |
| LYM1138 | 81480.1 | 1.44 | 0.15 | 33 | 10.7 | 0.08 | 12 | 86.7 | 0.09 | 46 |
| LYM1126 | 80935.2 | — | — | — | 10.0 | 0.11 | 5 | — | — | — |
| LYM1099 | 81215.3 | — | — | — | 9.88 | 0.27 | 4 | — | — | — |
| LYM1099 | 81215.5 | — | — | — | 10.2 | 0.22 | 7 | — | — | — |
| LYM1079 | 81354.5 | 1.15 | 0.23 | 6 | — | — | — | 65.3 | 0.09 | 10 |
| LYM1079 | 81358.2 | 1.17 | 0.10 | 8 | 10.0 | 0.14 | 5 | — | — | — |
| LYM1065 | 80970.3 | — | — | — | 10.0 | 0.14 | 5 | 66.6 | 0.19 | 12 |
| LYM1065 | 80971.1 | — | — | — | — | — | — | 64.6 | 0.15 | 9 |
| LYM1065 | 80971.3 | — | — | — | 10.2 | 0.22 | 7 | 63.8 | 0.25 | 8 |
| CONT. | — | 1.08 | — | — | 9.54 | — | — | 59.3 | — | — |
| LYM1171 | 80591.4 | 1.20 | 0.21 | 9 | — | — | — | 71.4 | 0.16 | 17 |
| LYM1167 | 80183.2 | — | — | — | 10.4 | 0.19 | 2 | — | — | — |
| LYM1061 | 80114.2 | — | — | — | 10.8 | 0.03 | 6 | 67.0 | 0.18 | 9 |
| LYM1056 | 80339.3 | — | — | — | — | — | — | 67.9 | 0.28 | 11 |
| LYM1043 | 81236.1 | 1.23 | 0.04 | 12 | — | — | — | 74.0 | 0.01 | 21 |
| LYM1043 | 81238.2 | 1.32 | 0.03 | 21 | — | — | — | 75.6 | 0.05 | 23 |
| LYM1040 | 80952.5 | 1.20 | 0.14 | 9 | — | — | — | 70.1 | 0.05 | 14 |
| LYM1036 | 81078.1 | 1.30 | 0.03 | 18 | — | — | — | 70.1 | 0.25 | 14 |
| LYM1019 | 81663.2 | — | — | — | 10.8 | 0.23 | 7 | 70.1 | 0.07 | 14 |
| LYM1019 | 81665.1 | — | — | — | 10.8 | L | 6 | 71.0 | 0.08 | 16 |
| LYM1019 | 81666.3 | 1.19 | 0.13 | 9 | — | — | — | 67.9 | 0.10 | 11 |
| LYM1010 | 81063.4 | 1.20 | 0.11 | 9 | 10.9 | L | 8 | 68.9 | 0.06 | 12 |
| CONT. | — | 1.10 | — | — | 10.1 | — | — | 61.3 | — | — |

"CONT."—Control; "Ave."—Average; "% Incr." = % increment; "p-val."—p-value, L-p < 0.01.

TABLE 110

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM1062 | 81475.2 | 0.649 | 0.21 | 18 | — | — | — | — | — | — |
| LYM1061 | 80111.1 | — | — | — | — | — | — | 0.354 | 0.25 | 9 |
| LYM1061 | 80112.4 | — | — | — | — | — | — | 0.358 | 0.18 | 10 |
| LYM1056 | 80339.3 | — | — | — | — | — | — | 0.368 | 0.09 | 13 |
| LYM1055 | 81146.3 | 0.617 | 0.29 | 12 | — | — | — | — | — | — |
| LYM1049 | 80104.3 | 0.720 | 0.03 | 31 | — | — | — | — | — | — |
| LYM1049 | 80104.5 | 0.643 | 0.18 | 17 | — | — | — | — | — | — |
| LYM1043 | 81238.2 | 0.628 | 0.21 | 14 | — | — | — | 0.353 | 0.27 | 8 |
| LYM1041 | 80957.2 | 0.666 | 0.10 | 21 | — | — | — | — | — | — |

TABLE 110-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM1038 | 80328.2 | 0.639 | 0.22 | 16 | — | — | — | — | — | — |
| LYM1025 | 80094.3 | 0.624 | 0.28 | 14 | — | — | — | — | — | — |
| LYM1025 | 80094.5 | 0.621 | 0.24 | 13 | — | — | — | — | — | — |
| LYM1019 | 81663.3 | 0.638 | 0.18 | 16 | 6.49 | 0.06 | 29 | — | — | — |
| LYM1019 | 81665.1 | 0.652 | 0.16 | 19 | — | — | — | — | — | — |
| LYM1019 | 81666.2 | — | — | — | — | — | — | 0.357 | 0.18 | 10 |
| CONT. | — | 0.549 | — | — | 5.02 | — | — | 0.326 | — | — |
| LYM1240 | 80615.2 | 0.663 | 0.21 | 23 | 5.92 | 0.28 | 14 | — | — | — |
| LYM1236 | 80505.4 | 0.661 | 0.19 | 23 | — | — | — | — | — | — |
| LYM1236 | 80505.5 | — | — | — | 6.02 | 0.21 | 15 | 0.317 | 0.19 | 12 |
| LYM1224 | 81497.4 | — | — | — | 6.19 | 0.13 | 19 | — | — | — |
| LYM1224 | 81497.6 | — | — | — | 6.34 | 0.09 | 22 | 0.311 | 0.27 | 10 |
| LYM1224 | 81498.3 | — | — | — | 6.65 | 0.03 | 28 | 0.324 | 0.10 | 14 |
| LYM1224 | 81498.6 | — | — | — | 7.50 | L | 44 | 0.344 | 0.02 | 21 |
| LYM1213 | 81340.4 | — | — | — | 6.08 | 0.18 | 17 | — | — | — |
| LYM1213 | 81343.4 | — | — | — | 6.30 | 0.09 | 21 | 0.313 | 0.24 | 10 |
| LYM1188 | 81028.3 | 0.654 | 0.21 | 22 | — | — | — | — | — | — |
| LYM1179 | 80243.1 | — | — | — | 6.05 | 0.18 | 16 | — | — | — |
| LYM1179 | 80243.4 | 0.688 | 0.14 | 28 | — | — | — | — | — | — |
| LYM1179 | 80243.6 | — | — | — | 6.06 | 0.20 | 16 | 0.318 | 0.16 | 12 |
| LYM1179 | 80245.1 | — | — | — | 6.16 | 0.14 | 18 | — | — | — |
| LYM1165 | 80587.2 | 0.652 | 0.22 | 21 | 6.62 | 0.03 | 27 | 0.334 | 0.05 | 18 |
| LYM1165 | 80588.3 | 0.652 | 0.22 | 21 | 6.99 | L | 34 | 0.326 | 0.08 | 15 |
| LYM1165 | 80588.4 | — | — | — | 6.07 | 0.20 | 16 | — | — | — |
| LYM1165 | 80590.3 | — | — | — | 5.98 | 0.23 | 15 | — | — | — |
| LYM1165 | 80590.6 | — | — | — | 6.11 | 0.16 | 17 | 0.311 | 0.27 | 10 |
| LYM1159 | 80276.5 | 0.711 | 0.08 | 32 | 6.76 | 0.03 | 30 | — | — | — |
| LYM1143 | 80539.1 | — | — | — | 6.06 | 0.18 | 16 | 0.310 | 0.27 | 9 |
| LYM1143 | 80541.3 | — | — | — | 6.03 | 0.20 | 16 | — | — | — |
| LYM1089 | 81095.1 | — | — | — | 6.93 | 0.01 | 33 | 0.319 | 0.14 | 13 |
| LYM1079 | 81355.5 | — | — | — | 6.60 | 0.04 | 27 | 0.318 | 0.16 | 12 |
| LYM1065 | 80968.3 | — | — | — | 5.91 | 0.27 | 14 | — | — | — |
| LYM1065 | 80970.3 | — | — | — | 6.04 | 0.21 | 16 | 0.309 | 0.29 | 9 |
| LYM1065 | 80971.3 | — | — | — | 5.88 | 0.28 | 13 | — | — | — |
| LYM1062 | 81474.2 | 0.671 | 0.15 | 25 | 7.80 | L | 50 | 0.372 | L | 31 |
| LYM1062 | 81474.5 | — | — | — | 6.51 | 0.05 | 25 | 0.325 | 0.09 | 15 |
| LYM1062 | 81476.3 | 0.692 | 0.11 | 29 | 7.09 | L | 36 | 0.346 | 0.02 | 22 |
| CONT. | — | 0.538 | — | — | 5.21 | — | — | 0.283 | — | — |
| LYM1240 | 80614.1 | 0.620 | 0.16 | 14 | — | — | — | — | — | — |
| LYM1240 | 80614.4 | 0.667 | 0.02 | 23 | 7.09 | 0.19 | 20 | 0.400 | 0.18 | 11 |
| LYM1240 | 80615.1 | 0.660 | 0.05 | 22 | 7.34 | 0.13 | 25 | 0.404 | 0.17 | 12 |
| LYM1224 | 81497.4 | — | — | — | 6.81 | 0.30 | 16 | — | — | — |
| LYM1224 | 81497.6 | 0.614 | 0.22 | 13 | 7.45 | 0.11 | 27 | — | — | — |
| LYM1224 | 81498.3 | — | — | — | 7.88 | 0.04 | 34 | 0.414 | 0.08 | 15 |
| LYM1224 | 81498.6 | 0.643 | 0.08 | 19 | 7.64 | 0.07 | 30 | — | — | — |
| LYM1206 | 81220.5 | 0.614 | 0.17 | 13 | — | — | — | — | — | — |
| LYM1190 | 80378.1 | 0.709 | L | 31 | 8.11 | 0.02 | 38 | 0.412 | 0.09 | 15 |
| LYM1190 | 80378.7 | — | — | — | 6.86 | 0.28 | 17 | — | — | — |
| LYM1188 | 81030.1 | 0.633 | 0.13 | 17 | — | — | — | — | — | — |
| LYM1181 | 80371.6 | 0.611 | 0.19 | 13 | 7.48 | 0.09 | 27 | 0.401 | 0.19 | 12 |
| LYM1181 | 80373.1 | 0.653 | 0.04 | 21 | — | — | — | 0.403 | 0.16 | 12 |
| LYM1165 | 80587.2 | 0.608 | 0.24 | 12 | 6.88 | 0.26 | 17 | 0.392 | 0.28 | 9 |
| LYM1165 | 80588.4 | — | — | — | 7.33 | 0.12 | 24 | 0.394 | 0.28 | 10 |
| LYM1165 | 80590.3 | 0.619 | 0.15 | 14 | — | — | — | — | — | — |
| LYM1165 | 80590.6 | — | — | — | 7.09 | 0.19 | 20 | 0.393 | 0.26 | 9 |
| LYM1159 | 80276.5 | 0.625 | 0.16 | 15 | 8.42 | 0.01 | 43 | 0.445 | L | 24 |
| LYM1159 | 80279.2 | 0.606 | 0.22 | 12 | — | — | — | — | — | — |
| LYM1156 | 81017.1 | — | — | — | 7.03 | 0.20 | 19 | 0.406 | 0.14 | 13 |
| LYM1143 | 80539.3 | — | — | — | 6.93 | 0.25 | 18 | 0.396 | 0.23 | 10 |
| LYM1143 | 80540.1 | — | — | — | 7.09 | 0.18 | 20 | — | — | — |
| LYM1138 | 81477.5 | 0.610 | 0.19 | 12 | 7.23 | 0.15 | 23 | 0.398 | 0.21 | 11 |
| LYM1138 | 81480.1 | 0.624 | 0.14 | 15 | 8.69 | L | 47 | 0.433 | 0.02 | 21 |
| LYM1065 | 80971.3 | 0.616 | 0.18 | 14 | — | — | — | — | — | — |
| CONT. | — | 0.542 | — | — | 5.89 | — | — | 0.359 | — | — |
| LYM1171 | 80591.4 | — | — | — | 8.48 | 0.27 | 17 | 0.368 | 0.22 | 13 |
| LYM1171 | 80595.3 | 0.765 | 0.17 | 15 | — | — | — | — | — | — |
| LYM1167 | 80182.1 | — | — | — | — | — | — | 0.370 | 0.18 | 14 |
| LYM1110 | 81005.2 | 0.750 | 0.22 | 13 | — | — | — | — | — | — |
| LYM1056 | 80339.3 | 0.777 | 0.13 | 17 | — | — | — | 0.365 | 0.24 | 12 |
| LYM1055 | 81146.3 | 0.765 | 0.18 | 15 | — | — | — | — | — | — |
| LYM1043 | 81236.1 | — | — | — | 8.88 | 0.14 | 22 | 0.370 | 0.17 | 14 |

TABLE 110-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM1043 | 81238.2 | — | — | — | 9.04 | 0.11 | 25 | 0.386 | 0.09 | 19 |
| LYM1036 | 81078.1 | — | — | — | 8.42 | 0.29 | 16 | 0.378 | 0.11 | 16 |
| LYM1034 | 80100.2 | 0.747 | 0.28 | 12 | — | — | — | — | — | — |
| LYM1019 | 81663.2 | — | — | — | — | — | — | 0.377 | 0.12 | 16 |
| LYM1019 | 81665.1 | — | — | — | 8.46 | 0.27 | 17 | 0.373 | 0.15 | 14 |
| LYM1019 | 81666.3 | — | — | — | — | — | — | 0.368 | 0.20 | 13 |
| CONT. | — | 0.667 | — | — | 7.25 | — | — | 0.325 | — | — |

"CONT."—Control; "Ave."—Average; "% Incr." = % increment; "p-val."—p-value, L-p < 0.01.
RGR = relative growth rate.

TABLE 111

Genes showing improved plant performance at Normal growth conditions under regulation of At6669 promoter

| Gene Name | Event # | Harvest Index | | | Rosette Area [cm$^2$] | | | Rosette Diameter [cm$^2$] | | |
|---|---|---|---|---|---|---|---|---|---|---|
| | | Ave. | P-Val. | % Incr. | Ave. | P-Val. | % Incr. | Ave. | P-Val. | % Incr. |
| LYM1062 | 81476.3 | — | — | — | 5.43 | 0.05 | 9 | 3.94 | 0.03 | 6 |
| LYM1061 | 80112.4 | — | — | — | — | — | — | 4.02 | 0.14 | 8 |
| LYM1056 | 80339.1 | — | — | — | 5.24 | 0.17 | 6 | 3.91 | 0.07 | 5 |
| LYM1056 | 80339.3 | — | — | — | 5.48 | 0.14 | 10 | 4.07 | 0.05 | 9 |
| LYM1041 | 80960.2 | — | — | — | 5.37 | 0.05 | 8 | 3.89 | 0.10 | 5 |
| LYM1038 | 80330.4 | — | — | — | — | — | — | 3.92 | 0.20 | 5 |
| LYM1036 | 81078.1 | — | — | — | 5.62 | 0.18 | 13 | 3.93 | 0.16 | 6 |
| LYM1036 | 81080.6 | — | — | — | — | — | — | 3.85 | 0.19 | 3 |
| LYM1019 | 81663.3 | — | — | — | 6.49 | 0.02 | 31 | 4.18 | L | 12 |
| LYM1019 | 81665.1 | — | — | — | 5.32 | 0.08 | 7 | 3.93 | 0.05 | 5 |
| LYM1019 | 81666.2 | — | — | — | 5.62 | 0.01 | 13 | 4.07 | L | 9 |
| LYM1019 | 81666.3 | — | — | — | — | — | — | 3.93 | 0.15 | 5 |
| CONT. | — | — | — | — | 4.97 | — | — | 3.72 | — | — |
| LYM1240 | 80614.4 | 0.188 | 0.23 | 32 | — | — | — | — | — | — |
| LYM1240 | 80615.2 | — | — | — | 6.25 | 0.22 | 13 | 4.16 | 0.26 | 6 |
| LYM1236 | 80505.2 | — | — | — | 5.84 | 0.11 | 6 | 4.04 | 0.28 | 3 |
| LYM1236 | 80505.5 | 0.171 | 0.02 | 20 | 6.27 | 0.03 | 13 | 4.27 | L | 9 |
| LYM1236 | 80506.5 | 0.158 | 0.15 | 10 | 6.13 | L | 11 | 4.17 | L | 6 |
| LYM1224 | 81497.3 | 0.210 | 0.09 | 47 | — | — | — | — | — | — |
| LYM1224 | 81497.4 | 0.194 | 0.26 | 36 | 6.69 | L | 21 | 4.29 | 0.06 | 9 |
| LYM1224 | 81497.6 | 0.179 | 0.07 | 26 | 6.71 | 0.21 | 21 | 4.36 | 0.07 | 11 |
| LYM1224 | 81498.3 | 0.173 | 0.28 | 21 | 7.00 | L | 27 | 4.45 | L | 13 |
| LYM1224 | 81498.6 | — | — | — | 7.80 | 0.10 | 41 | 4.67 | 0.09 | 19 |
| LYM1213 | 81340.4 | 0.167 | 0.04 | 17 | 6.34 | 0.27 | 15 | 4.23 | 0.12 | 8 |
| LYM1213 | 81343.4 | — | — | — | 6.73 | 0.27 | 22 | 4.42 | 0.21 | 12 |
| LYM1206 | 81220.5 | — | — | — | 6.18 | 0.07 | 12 | 4.11 | 0.07 | 5 |
| LYM1179 | 80243.1 | — | — | — | 6.39 | 0.01 | 16 | 4.14 | 0.03 | 5 |
| LYM1179 | 80243.6 | — | — | — | 6.41 | 0.13 | 16 | 4.35 | L | 11 |
| LYM1179 | 80245.1 | — | — | — | 6.52 | 0.13 | 18 | 4.19 | 0.01 | 7 |
| LYM1179 | 80245.3 | — | — | — | 5.78 | 0.21 | 4 | — | — | — |
| LYM1165 | 80587.2 | 0.196 | 0.25 | 37 | 6.91 | L | 25 | 4.43 | 0.07 | 13 |
| LYM1165 | 80588.3 | 0.207 | L | 45 | 7.34 | 0.05 | 33 | 4.46 | L | 14 |
| LYM1165 | 80588.4 | — | — | — | 6.44 | 0.16 | 16 | — | — | — |
| LYM1165 | 80590.3 | — | — | — | 6.34 | 0.05 | 15 | 4.21 | 0.29 | 7 |
| LYM1165 | 80590.6 | — | — | — | 6.48 | 0.20 | 17 | 4.20 | 0.21 | 7 |
| LYM1159 | 80276.5 | — | — | — | 7.21 | 0.24 | 30 | 4.45 | 0.19 | 13 |
| LYM1143 | 80539.1 | — | — | — | 6.32 | L | 14 | 4.24 | L | 8 |
| LYM1143 | 80541.3 | — | — | — | 6.42 | L | 16 | 4.18 | L | 7 |
| LYM1143 | 80542.1 | 0.158 | 0.24 | 11 | 5.84 | 0.14 | 6 | 4.11 | 0.12 | 5 |
| LYM1126 | 80934.2 | 0.157 | 0.17 | 10 | — | — | — | — | — | — |
| LYM1099 | 81215.3 | — | — | — | 6.07 | 0.01 | 10 | 4.11 | 0.02 | 5 |
| LYM1089 | 81093.1 | 0.195 | L | 37 | — | — | — | 4.10 | 0.15 | 5 |
| LYM1089 | 81095.1 | — | — | — | 7.31 | L | 32 | 4.46 | 0.04 | 14 |
| LYM1079 | 81354.5 | 0.199 | 0.13 | 39 | — | — | — | — | — | — |
| LYM1079 | 81355.5 | — | — | — | 6.95 | L | 26 | 4.35 | 0.02 | 11 |
| LYM1079 | 81358.2 | — | — | — | 6.03 | 0.28 | 9 | 4.13 | 0.23 | 5 |
| LYM1065 | 80968.3 | 0.154 | 0.24 | 8 | 6.28 | L | 14 | 4.11 | 0.19 | 5 |

TABLE 111-continued

Genes showing improved plant performance at Normal growth conditions under regulation of At6669 promoter

| Gene Name | Event # | Harvest Index | | | Rosette Area [cm²] | | | Rosette Diameter [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYM1065 | 80970.5 | 0.164 | 0.13 | 15 | — | — | — | — | — | — |
| LYM1065 | 80971.3 | — | — | — | 6.28 | 0.16 | 14 | 4.13 | 0.10 | 5 |
| LYM1062 | 81474.2 | 0.209 | 0.04 | 47 | 8.27 | 0.10 | 50 | 4.88 | 0.02 | 24 |
| LYM1062 | 81474.5 | — | — | — | 6.91 | 0.10 | 25 | 4.45 | L | 13 |
| LYM1062 | 81476.2 | 0.178 | 0.06 | 25 | 6.06 | 0.07 | 10 | 4.11 | 0.09 | 5 |
| LYM1062 | 81476.3 | 0.200 | 0.04 | 40 | 7.46 | 0.13 | 35 | 4.62 | 0.04 | 18 |
| CONT. | — | 0.143 | — | — | 5.53 | — | — | 3.93 | — | — |
| LYM1240 | 80614.1 | — | — | — | — | — | — | 4.80 | 0.28 | 4 |
| LYM1240 | 80614.4 | — | — | — | 8.85 | 0.02 | 19 | 5.05 | 0.04 | 9 |
| LYM1240 | 80615.1 | — | — | — | — | — | — | 5.20 | 0.27 | 12 |
| LYM1224 | 81497.4 | — | — | — | 8.47 | 0.06 | 14 | 5.02 | 0.02 | 8 |
| LYM1224 | 81497.6 | — | — | — | 9.42 | 0.26 | 27 | — | — | — |
| LYM1224 | 81498.3 | — | — | — | 9.97 | L | 34 | 5.42 | L | 17 |
| LYM1224 | 81498.6 | — | — | — | 9.68 | 0.05 | 31 | 5.18 | L | 12 |
| LYM1206 | 81220.5 | — | — | — | 8.57 | 0.03 | 16 | 4.77 | 0.22 | 3 |
| LYM1190 | 80378.1 | — | — | — | 10.3 | L | 38 | 5.45 | L | 18 |
| LYM1190 | 80378.7 | — | — | — | 8.65 | 0.17 | 17 | 5.04 | 0.19 | 9 |
| LYM1181 | 80371.6 | — | — | — | 9.48 | L | 28 | 5.27 | L | 14 |
| LYM1181 | 80373.1 | — | — | — | 8.34 | 0.06 | 12 | 5.05 | 0.09 | 9 |
| LYM1171 | 80594.1 | — | — | — | 8.08 | 0.22 | 9 | — | — | — |
| LYM1165 | 80587.2 | — | — | — | 8.56 | 0.02 | 15 | 5.11 | L | 10 |
| LYM1165 | 80588.4 | — | — | — | 9.24 | 0.13 | 25 | 5.17 | L | 12 |
| LYM1165 | 80590.6 | — | — | — | 8.97 | 0.01 | 21 | 5.08 | 0.01 | 10 |
| LYM1159 | 80276.5 | — | — | — | 10.6 | L | 43 | 5.67 | L | 23 |
| LYM1156 | 81017.1 | — | — | — | 8.78 | 0.03 | 18 | 5.19 | L | 12 |
| LYM1156 | 81017.4 | — | — | — | 8.15 | 0.13 | 10 | 4.83 | 0.09 | 4 |
| LYM1143 | 80539.3 | — | — | — | 8.63 | 0.26 | 16 | 5.06 | 0.21 | 9 |
| LYM1143 | 80540.1 | — | — | — | 8.89 | L | 20 | 4.98 | 0.01 | 8 |
| LYM1138 | 81477.5 | — | — | — | 9.10 | L | 23 | 5.12 | L | 11 |
| LYM1138 | 81480.1 | — | — | — | 10.8 | 0.09 | 46 | 5.57 | 0.14 | 20 |
| LYM1079 | 81354.5 | — | — | — | 8.16 | 0.09 | 10 | 4.82 | 0.10 | 4 |
| LYM1079 | 81358.2 | — | — | — | — | — | — | 4.95 | 0.18 | 7 |
| LYM1065 | 80970.3 | — | — | — | 8.32 | 0.19 | 12 | 4.89 | 0.17 | 6 |
| LYM1065 | 80971.1 | — | — | — | 8.08 | 0.15 | 9 | — | — | — |
| LYM1065 | 80971.3 | — | — | — | 7.97 | 0.25 | 8 | 4.81 | 0.15 | 4 |
| CONT. | — | — | — | — | 7.41 | — | — | 4.63 | — | — |
| LYM1171 | 80591.4 | — | — | — | 8.93 | 0.16 | 17 | 4.87 | 0.20 | 9 |
| LYM1171 | 80594.1 | — | — | — | — | — | — | 4.66 | 0.13 | 4 |
| LYM1171 | 80595.8 | 0.353 | 0.20 | 11 | — | — | — | — | — | — |
| LYM1110 | 81003.1 | 0.363 | 0.11 | 15 | — | — | — | — | — | — |
| LYM1110 | 81004.2 | 0.460 | 0.17 | 45 | — | — | — | — | — | — |
| LYM1110 | 81006.2 | 0.422 | 0.19 | 33 | — | — | — | — | — | — |
| LYM1092 | 81367.1 | 0.499 | L | 58 | — | — | — | — | — | — |
| LYM1061 | 80114.2 | — | — | — | 8.37 | 0.18 | 9 | 4.75 | 0.04 | 6 |
| LYM1056 | 80339.3 | — | — | — | 8.49 | 0.28 | 11 | 4.77 | 0.09 | 7 |
| LYM1056 | 80340.1 | 0.368 | 0.09 | 16 | — | — | — | — | — | — |
| LYM1043 | 81236.1 | — | — | — | 9.25 | 0.01 | 21 | 4.83 | 0.02 | 8 |
| LYM1043 | 81238.2 | — | — | — | 9.45 | 0.05 | 23 | 5.15 | 0.16 | 15 |
| LYM1041 | 80957.2 | — | — | — | — | — | — | 4.65 | 0.27 | 4 |
| LYM1040 | 80952.5 | — | — | — | 8.76 | 0.05 | 14 | 4.75 | 0.14 | 6 |
| LYM1040 | 80955.2 | 0.494 | 0.14 | 56 | — | — | — | — | — | — |
| LYM1036 | 81078.1 | — | — | — | 8.77 | 0.25 | 14 | 4.98 | 0.03 | 12 |
| LYM1036 | 81078.2 | — | — | — | — | — | — | 4.63 | 0.15 | 4 |
| LYM1019 | 81663.2 | — | — | — | 8.76 | 0.07 | 14 | 4.84 | 0.02 | 8 |
| LYM1019 | 81665.1 | — | — | — | 8.88 | 0.08 | 16 | 4.94 | L | 11 |
| LYM1019 | 81666.3 | — | — | — | 8.49 | 0.10 | 11 | 4.86 | 0.04 | 9 |
| LYM1010 | 81063.4 | — | — | — | 8.61 | 0.06 | 12 | 4.88 | L | 9 |
| CONT. | — | 0.317 | — | — | 7.66 | — | — | 4.46 | — | — |

"CONT."—Control; "Ave."—Average; "% Incr." = % increment; "p-val."—p-value, L-p < 0.01.

TABLE 112

Genes showing improved plant performance at Normal growth conditions under regulation of At6669 promoter

| Gene Name | Event # | Seed Yield [mg] | | | 1000 Seed Weight [mg] | | |
|---|---|---|---|---|---|---|---|
| | | Ave. | P-Val. | % Incr. | Ave. | P-Val. | % Incr. |
| LYM1224 | 81497.3 | 308.5 | 0.07 | 44 | — | — | — |
| LYM1224 | 81497.4 | 237.3 | 0.23 | 11 | — | — | — |
| LYM1224 | 81497.6 | 237.7 | 0.29 | 11 | — | — | — |
| LYM1213 | 81340.4 | 241.2 | 0.24 | 13 | — | — | — |
| LYM1165 | 80587.2 | 292.7 | 0.09 | 37 | — | — | — |
| LYM1165 | 80588.3 | 247.7 | 0.11 | 16 | — | — | — |
| LYM1099 | 81215.2 | 287.0 | 0.20 | 34 | — | — | — |
| LYM1089 | 81093.1 | 236.7 | 0.25 | 11 | — | — | — |
| LYM1079 | 81354.5 | 242.0 | 0.16 | 13 | — | — | — |
| LYM1062 | 81474.2 | 286.8 | 0.02 | 34 | — | — | — |
| LYM1062 | 81476.2 | 260.3 | 0.15 | 22 | — | — | — |
| LYM1062 | 81476.3 | 251.3 | 0.21 | 17 | — | — | — |
| CONT. | — | 214.0 | — | — | — | — | — |
| LYM1171 | 80591.4 | — | — | — | 27.7 | 0.02 | 20 |
| LYM1171 | 80594.1 | — | — | — | 24.8 | 0.12 | 7 |
| LYM1171 | 80595.8 | — | — | — | 24.0 | 0.04 | 4 |
| LYM1167 | 80182.1 | — | — | — | 25.9 | 0.18 | 12 |
| LYM1110 | 81005.2 | — | — | — | 24.9 | 0.08 | 8 |
| LYM1110 | 81006.2 | 522.2 | 0.16 | 14 | — | — | — |
| LYM1056 | 80338.5 | — | — | — | 27.8 | L | 20 |
| LYM1055 | 81146.3 | — | — | — | 24.2 | 0.12 | 5 |
| LYM1040 | 80952.5 | — | — | — | 26.8 | 0.05 | 16 |
| LYM1025 | 80091.1 | — | — | — | 24.2 | 0.03 | 5 |
| LYM1010 | 81062.1 | 521.9 | 0.16 | 14 | — | — | — |
| LYM1010 | 81063.4 | — | — | — | 25.9 | L | 12 |
| CONT. | — | 457.9 | — | — | 23.1 | — | — |

"CONT."—Control; "Ave."—Average; "% Incr." = % increment; "p-val."—p-value, L-p < 0.01.

Example 20

Evaluation of Transgenic *Arabidopsis* for Seed Yield and Plant Growth Rate Under Normal Conditions in Greenhouse Assays Until Bolting (GH-SB Assays)

Assay 2: Plant performance improvement measured until bolting stage: plant biomass and plant growth rate under normal greenhouse conditions (GH-SB Assays)—This assay follows the plant biomass formation and the rosette area growth of plants grown in the greenhouse under normal growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing of 6 mM inorganic nitrogen in the form of $KNO_3$ with 1 mM $KH_2PO_4$, 1 mM $MgSO_4$, 2 mM $CaCl_2$ and microelements. All plants were grown in the greenhouse until bolting. Plant biomass (the above ground tissue) was weighted in directly after harvesting the rosette (plant fresh weight [FW]). Following plants were dried in an oven at 50° C. for 48 hours and weighted (plant dry weight [DW]).

Each construct was validated at its $T_2$ generation. Transgenic plants transformed with a construct conformed by an empty vector carrying the At6669 promoter.

The plants were analyzed for their overall size, growth rate, fresh weight and dry matter. Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at rsbweb(dot)nih(dot)gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, and leaf blade area.

Vegetative growth rate: the relative growth rate (RGR) of leaf number (Formula VIII), rosette area (Formula IX) and plot coverage (Formula XI) were calculated using the indicated formulas as described above.

Plant Fresh and Dry weight—On about day 80 from sowing, the plants were harvested and directly weighted for the determination of the plant fresh weight (FW) and left to dry at 50° C. in a drying chamber for about 48 hours before weighting to determine plant dry weight (DW).

Statistical analyses—To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Experimental Results:

Tables 113-115 summarize the observed phenotypes of transgenic plants expressing the genes constructs using the GH-SB Assays.

The genes listed in Tables 113-115 improved plant performance when grown at normal conditions. These genes produced larger plants with a larger photosynthetic area (increased photosynthetic capacity), biomass (fresh weight, dry weight, rosette diameter, rosette area and plot coverage), relative growth rate, blade relative area and petiole relative area. The genes were cloned under the regulation of a constitutive At6669 promoter (SEQ ID NO: 8190). The evaluation of each gene was performed by testing the performance of different number of events. Event with p-value <0.1 was considered statistically significant.

TABLE 113

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM1239 | 82025.4 | — | — | — | — | — | — | 9.94 | 0.09 | 9 |
| LYM1239 | 82026.4 | — | — | — | 1962.5 | 0.01 | 21 | — | — | — |
| LYM1153 | 83267.4 | 175.0 | 0.22 | 5 | 1900.0 | 0.20 | 17 | 9.25 | 0.25 | 1 |
| LYM1153 | 83267.5 | — | — | — | — | — | — | 9.31 | 0.16 | 2 |
| LYM1153 | 83269.5 | 190.6 | 0.15 | 14 | 2037.5 | L | 25 | — | — | — |
| LYM1127 | 81669.2 | — | — | — | — | — | — | 9.81 | 0.25 | 8 |
| LYM1127 | 81671.6 | 178.1 | 0.23 | 7 | 1768.8 | 0.11 | 9 | — | — | — |
| LYM1125 | 83041.5 | — | — | — | — | — | — | 9.38 | 0.23 | 3 |
| LYM1125 | 83042.1 | — | — | — | 1856.2 | 0.03 | 14 | 9.25 | 0.25 | 1 |
| LYM1087 | 81361.5 | — | — | — | 1743.8 | 0.18 | 7 | — | — | — |
| LYM1075 | 83047.2 | 176.2 | 0.11 | 6 | 1823.2 | 0.06 | 12 | — | — | — |
| LYM1075 | 83047.8 | 183.8 | 0.21 | 10 | 1875.0 | 0.03 | 15 | — | — | — |
| LYM1070 | 82533.4 | 199.0 | 0.07 | 19 | 1977.1 | L | 21 | — | — | — |
| LYM1044 | 82612.2 | — | — | — | 1711.6 | 0.24 | 5 | — | — | — |
| LYM1035 | 83262.1 | — | — | — | — | — | — | 9.44 | 0.04 | 3 |
| CONT. | — | 166.8 | — | — | 1628.6 | — | — | 9.12 | — | — |
| LYM1229 | 81574.1 | 331.2 | L | 25 | 4062.5 | L | 23 | — | — | — |
| LYM1229 | 81575.3 | 333.8 | 0.02 | 26 | 3993.8 | 0.01 | 21 | — | — | — |
| LYM1229 | 81576.5 | — | — | — | — | — | — | 9.94 | 0.04 | 9 |
| LYM1221 | 81714.1 | — | — | — | 3612.5 | 0.27 | 9 | — | — | — |
| LYM1221 | 81714.5 | — | — | — | 3793.8 | 0.24 | 15 | — | — | — |
| LYM1221 | 81716.1 | — | — | — | 3712.5 | 0.19 | 12 | — | — | — |
| LYM1217 | 80263.4 | — | — | — | 3518.8 | 0.26 | 6 | — | — | — |
| LYM1217 | 80264.2 | 312.4 | 0.09 | 18 | 3545.5 | 0.21 | 7 | — | — | — |
| LYM1212 | 80778.2 | 303.1 | 0.04 | 14 | — | — | — | — | — | — |
| LYM1212 | 80779.2 | 297.3 | 0.10 | 12 | 3863.4 | 0.02 | 17 | — | — | — |
| LYM1212 | 80779.5 | — | — | — | 3670.5 | 0.17 | 11 | — | — | — |
| LYM1195 | 81917.3 | 350.8 | L | 32 | 4141.7 | 0.02 | 25 | — | — | — |
| LYM1195 | 81918.1 | 325.0 | L | 22 | 3887.5 | 0.02 | 17 | — | — | — |
| LYM1195 | 81919.3 | 298.8 | 0.12 | 13 | 3825.0 | 0.17 | 15 | — | — | — |
| LYM1194 | 81623.1 | 303.1 | 0.02 | 14 | 3762.5 | 0.03 | 14 | — | — | — |
| LYM1194 | 81624.2 | 300.0 | 0.05 | 13 | 3643.8 | 0.29 | 10 | — | — | — |
| LYM1194 | 81624.6 | 287.6 | 0.20 | 8 | — | — | — | — | — | — |
| LYM1146 | 81487.4 | 299.9 | 0.26 | 13 | — | — | — | — | — | — |
| LYM1146 | 81488.2 | 323.8 | L | 22 | 4078.6 | L | 23 | — | — | — |
| LYM1146 | 81491.5 | 319.4 | L | 20 | 3868.8 | 0.03 | 17 | — | — | — |
| LYM1138 | 81477.5 | 300.0 | 0.21 | 13 | 3681.2 | 0.13 | 11 | — | — | — |
| LYM1138 | 81480.3 | 302.5 | 0.26 | 14 | — | — | — | — | — | — |
| LYM1138 | 81480.4 | 303.1 | 0.04 | 14 | 3843.8 | 0.02 | 16 | — | — | — |
| LYM1129 | 81504.2 | 320.6 | 0.23 | 21 | 4062.5 | 0.21 | 23 | — | — | — |
| LYM1129 | 81505.2 | 286.9 | 0.13 | 8 | 3762.5 | 0.10 | 14 | — | — | — |
| LYM1124 | 82008.2 | 287.5 | 0.26 | 8 | — | — | — | — | — | — |
| LYM1124 | 82009.3 | 303.8 | 0.16 | 14 | 3875.0 | 0.23 | 17 | 9.62 | 0.05 | 5 |
| LYM1124 | 82009.5 | — | — | — | 3750.0 | 0.04 | 13 | — | — | — |
| LYM1124 | 82010.2 | 288.8 | 0.15 | 9 | — | — | — | 9.50 | 0.16 | 4 |
| LYM1111 | 81369.5 | 296.9 | 0.04 | 12 | 3643.8 | 0.14 | 10 | 9.44 | 0.18 | 3 |
| LYM1111 | 81373.2 | 311.4 | 0.02 | 17 | — | — | — | — | — | — |
| LYM1111 | 81373.4 | 285.3 | 0.25 | 7 | 3590.2 | 0.15 | 8 | — | — | — |
| LYM1111 | 81373.5 | 302.5 | 0.05 | 14 | 3893.8 | 0.01 | 18 | — | — | — |
| LYM1087 | 81363.2 | — | — | — | 3606.2 | 0.12 | 9 | — | — | — |
| LYM1087 | 81363.4 | 290.0 | 0.09 | 9 | 3793.8 | 0.03 | 15 | — | — | — |
| LYM1072 | 80972.1 | 288.8 | 0.14 | 9 | 3537.5 | 0.23 | 7 | — | — | — |
| LYM1072 | 80973.2 | 320.0 | 0.03 | 21 | 3956.2 | 0.06 | 19 | — | — | — |

TABLE 113-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM1072 | 80973.3 | 283.1 | 0.21 | 7 | 3568.8 | 0.17 | 8 | — | — | — |
| LYM1072 | 80975.2 | 296.2 | 0.14 | 12 | 3718.8 | 0.05 | 12 | — | — | — |
| LYM1053 | 80771.4 | — | — | — | 3693.8 | 0.10 | 12 | — | — | — |
| LYM1053 | 80772.3 | — | — | — | — | — | — | 9.94 | L | 9 |
| LYM1053 | 80772.5 | 286.3 | 0.16 | 8 | 3775.9 | 0.03 | 14 | — | — | — |
| LYM1053 | 80774.3 | 303.1 | 0.03 | 14 | 3843.8 | 0.02 | 16 | — | — | — |
| LYM1042 | 82001.2 | 285.7 | 0.16 | 8 | — | — | — | — | — | — |
| LYM1022 | 82057.2 | 303.8 | 0.03 | 14 | 3731.2 | 0.06 | 13 | — | — | — |
| LYM1022 | 82057.4 | 310.0 | 0.29 | 17 | 3831.2 | 0.14 | 16 | — | — | — |
| LYM1022 | 82061.3 | 289.4 | 0.27 | 9 | 3612.5 | 0.27 | 9 | — | — | — |
| LYM1017 | 81072.2 | 300.5 | 0.03 | 13 | 3728.6 | 0.05 | 13 | — | — | — |
| LYM1017 | 81072.3 | 303.2 | 0.02 | 14 | 3708.0 | 0.11 | 12 | — | — | — |
| LYM1017 | 81074.1 | 311.2 | L | 17 | 3743.8 | 0.05 | 13 | — | — | — |
| CONT. | — | 265.4 | — | — | 3312.2 | — | — | 9.12 | — | — |
| LYM1204 | 81052.2 | — | — | — | 3721.4 | 0.26 | 3 | — | — | — |
| LYM1151 | 80392.4 | — | — | — | 3712.5 | 0.25 | 3 | — | — | — |
| LYM1151 | 80392.6 | — | — | — | 3787.5 | 0.14 | 5 | — | — | — |
| LYM1151 | 80394.1 | 301.9 | 0.22 | 6 | 3775.0 | 0.07 | 4 | — | — | — |
| LYM1151 | 80394.2 | 300.0 | 0.23 | 5 | 3975.0 | L | 10 | — | — | — |
| LYM1151 | 80394.9 | — | — | — | 3950.0 | L | 9 | 10.6 | L | 11 |
| LYM1149 | 80387.5 | 310.0 | 0.08 | 9 | 3850.0 | 0.01 | 7 | — | — | — |
| LYM1149 | 80388.3 | 306.9 | L | 8 | 3818.8 | 0.05 | 6 | — | — | — |
| LYM1149 | 80388.5 | — | — | — | 3700.0 | 0.26 | 2 | — | — | — |
| LYM1141 | 80271.2 | — | — | — | 3946.4 | 0.09 | 9 | — | — | — |
| LYM1141 | 80271.3 | — | — | — | 3756.2 | 0.23 | 4 | 10.0 | 0.09 | 5 |
| LYM1141 | 80271.5 | 299.4 | 0.05 | 5 | 3856.2 | 0.01 | 7 | 9.94 | 0.10 | 5 |
| LYM1141 | 80272.4 | 298.8 | 0.05 | 5 | 3993.8 | 0.04 | 11 | — | — | — |
| LYM1139 | 80171.3 | — | — | — | — | — | — | 10.2 | 0.24 | 8 |
| LYM1139 | 80171.6 | — | — | — | 3712.5 | 0.21 | 3 | — | — | — |
| LYM1139 | 80172.3 | — | — | — | 3833.9 | 0.23 | 6 | — | — | — |
| LYM1137 | 80169.1 | 309.4 | 0.08 | 9 | 3987.5 | L | 10 | — | — | — |
| LYM1133 | 81008.1 | — | — | — | 3737.5 | 0.14 | 3 | — | — | — |
| LYM1131 | 80191.2 | 305.4 | 0.01 | 7 | 3869.6 | 0.04 | 7 | — | — | — |
| LYM1131 | 80191.3 | 310.6 | 0.07 | 9 | 4106.2 | L | 14 | — | — | — |
| LYM1131 | 80193.3 | 303.1 | 0.03 | 6 | 3950.0 | L | 9 | — | — | — |
| LYM1117 | 80266.7 | — | — | — | 3800.0 | 0.16 | 5 | — | — | — |
| LYM1117 | 80268.6 | — | — | — | 3800.0 | 0.12 | 5 | — | — | — |
| LYM1103 | 80999.1 | — | — | — | 3937.5 | 0.17 | 9 | — | — | — |
| LYM1103 | 81001.1 | 305.8 | 0.12 | 7 | 3893.8 | 0.16 | 8 | — | — | — |
| LYM1089 | 81093.1 | — | — | — | 3737.5 | 0.20 | 3 | — | — | — |
| LYM1089 | 81096.4 | 305.6 | 0.01 | 7 | 3812.5 | 0.10 | 6 | — | — | — |
| LYM1089 | 81096.6 | — | — | — | 3743.8 | 0.26 | 4 | — | — | — |
| LYM1069 | 81087.1 | 294.4 | 0.16 | 3 | 3850.0 | 0.02 | 7 | — | — | — |
| LYM1069 | 81091.2 | — | — | — | 3768.8 | 0.15 | 4 | — | — | — |
| LYM1047 | 81177.2 | — | — | — | 3750.0 | 0.10 | 4 | — | — | — |
| LYM1014 | 81067.1 | — | — | — | — | — | — | 10.2 | 0.11 | 8 |
| LYM1014 | 81068.1 | — | — | — | 3871.4 | 0.01 | 7 | — | — | — |
| LYM1014 | 81069.4 | 292.5 | 0.23 | 3 | 3843.8 | 0.29 | 6 | 10.1 | 0.27 | 6 |
| LYM1013 | 80311.1 | — | — | — | 3756.2 | 0.10 | 4 | — | — | — |
| LYM1013 | 80311.2 | — | — | — | 3950.0 | 0.30 | 9 | — | — | — |
| LYM1013 | 80313.1 | 296.9 | 0.11 | 4 | 3743.8 | 0.11 | 4 | — | — | — |
| LYM1013 | 80315.3 | — | — | — | 3793.8 | 0.15 | 5 | — | — | — |
| LYM1011 | 80942.2 | — | — | — | — | — | — | 10.4 | 0.20 | 9 |
| LYM1011 | 80945.2 | — | — | — | — | — | — | 10.2 | 0.21 | 7 |
| CONT. | — | 284.6 | — | — | 3612.5 | — | — | 9.50 | — | — |
| LYM1236 | 80505.2 | — | — | — | — | — | — | 10.2 | 0.23 | 4 |
| LYM1236 | 80505.5 | — | — | — | 3787.5 | 0.03 | 20 | — | — | — |
| LYM1236 | 80506.5 | 279.4 | 0.11 | 11 | — | — | — | 10.4 | 0.02 | 7 |
| LYM1227 | 81179.2 | 278.1 | 0.07 | 11 | 3862.5 | L | 23 | — | — | — |
| LYM1227 | 81179.7 | 305.6 | 0.16 | 22 | 4168.8 | 0.02 | 33 | — | — | — |
| LYM1213 | 81340.4 | 306.9 | 0.02 | 22 | 4243.8 | 0.07 | 35 | — | — | — |
| LYM1213 | 81343.3 | — | — | — | — | — | — | 10.6 | 0.09 | 9 |
| LYM1213 | 81343.4 | 333.8 | L | 33 | 4431.2 | L | 41 | 10.1 | 0.26 | 3 |
| LYM1213 | 81343.6 | — | — | — | — | — | — | 10.3 | 0.05 | 5 |
| LYM1203 | 81750.1 | 283.8 | 0.02 | 13 | 3725.0 | L | 18 | 10.8 | 0.11 | 10 |
| LYM1203 | 81751.2 | — | — | — | — | — | — | 10.1 | 0.16 | 3 |
| LYM1203 | 81751.5 | — | — | — | 3318.8 | 0.18 | 6 | 10.2 | 0.23 | 4 |
| LYM1203 | 81752.6 | — | — | — | — | — | — | 10.9 | L | 12 |
| LYM1196 | 80558.4 | 281.2 | 0.04 | 12 | 3475.0 | 0.15 | 11 | 10.4 | 0.08 | 7 |
| LYM1196 | 80561.4 | — | — | — | 3306.2 | 0.25 | 5 | — | — | — |
| LYM1183 | 81225.1 | — | — | — | 3350.0 | 0.28 | 7 | — | — | — |
| LYM1183 | 81226.1 | 301.9 | L | 20 | 4175.0 | L | 33 | — | — | — |

TABLE 113-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM1182 | 81492.1 | — | — | — | 3375.0 | 0.10 | 7 | — | — | — |
| LYM1182 | 81493.2 | 307.5 | L | 23 | 4050.0 | 0.12 | 29 | — | — | — |
| LYM1182 | 81494.2 | 271.7 | 0.11 | 8 | 3423.2 | 0.06 | 9 | 10.2 | 0.23 | 4 |
| LYM1156 | 81017.1 | 273.8 | 0.19 | 9 | 3781.2 | 0.18 | 20 | — | — | — |
| LYM1156 | 81017.4 | 273.1 | 0.15 | 9 | — | — | — | 10.1 | 0.16 | 3 |
| LYM1132 | 82013.2 | — | — | — | 3287.5 | 0.27 | 5 | — | — | — |
| LYM1127 | 81669.2 | 275.0 | 0.05 | 10 | — | — | — | — | — | — |
| LYM1127 | 81669.4 | — | — | — | 3331.2 | 0.27 | 6 | — | — | — |
| LYM1127 | 81671.6 | 308.1 | L | 23 | 4150.0 | L | 32 | — | — | — |
| LYM1094 | 81744.3 | — | — | — | — | — | — | 10.4 | 0.08 | 7 |
| LYM1094 | 81746.3 | 321.2 | L | 28 | 4150.0 | L | 32 | — | — | — |
| LYM1094 | 81747.2 | 280.6 | 0.03 | 12 | 3556.2 | 0.01 | 13 | — | — | — |
| LYM1093 | 81711.4 | — | — | — | 3287.5 | 0.26 | 5 | — | — | — |
| LYM1093 | 81711.6 | — | — | — | 3412.5 | 0.12 | 9 | — | — | — |
| LYM1093 | 81713.4 | 289.4 | 0.18 | 15 | 3393.8 | 0.25 | 8 | — | — | — |
| LYM1060 | 80965.3 | 267.5 | 0.15 | 7 | 3412.5 | 0.08 | 9 | — | — | — |
| LYM1060 | 80965.6 | — | — | — | — | — | — | 10.2 | 0.11 | 5 |
| LYM1060 | 80966.1 | — | — | — | — | — | — | 10.8 | 0.11 | 10 |
| LYM1057 | 81989.1 | 264.4 | 0.23 | 5 | 3306.2 | 0.25 | 5 | — | — | — |
| LYM1051 | 80331.1 | 276.9 | 0.20 | 10 | — | — | — | — | — | — |
| LYM1051 | 80331.2 | 271.2 | 0.09 | 8 | 3437.5 | 0.05 | 9 | — | — | — |
| LYM1026 | 80322.5 | — | — | — | 3312.5 | 0.21 | 5 | — | — | — |
| LYM1026 | 80323.2 | 263.8 | 0.27 | 5 | 3362.5 | 0.11 | 7 | — | — | — |
| LYM1020 | 81482.3 | — | — | — | — | — | — | 10.3 | 0.14 | 5 |
| LYM1020 | 81483.1 | 295.0 | 0.26 | 18 | 4037.5 | 0.10 | 28 | 10.1 | 0.22 | 3 |
| LYM1020 | 81484.3 | 312.5 | L | 25 | 3743.8 | 0.01 | 19 | 10.2 | 0.07 | 5 |
| LYM1015 | 80090.5 | 296.9 | L | 18 | 3906.2 | L | 24 | — | — | — |
| CONT. | — | 251.0 | — | — | 3144.4 | — | — | 9.79 | — | — |
| LYM1218 | 81116.6 | — | — | — | — | — | — | 9.69 | 0.17 | 3 |
| LYM1218 | 81116.7 | — | — | — | — | — | — | 9.69 | 0.17 | 3 |
| LYM1218 | 81116.8 | — | — | — | — | — | — | 10.1 | 0.26 | 7 |
| LYM1216 | 80260.2 | 438.8 | 0.01 | 19 | 5556.2 | L | 17 | — | — | — |
| LYM1210 | 80618.1 | — | — | — | 4925.0 | 0.09 | 4 | — | — | — |
| LYM1209 | 80480.1 | — | — | — | — | — | — | 9.75 | 0.18 | 3 |
| LYM1207 | 80247.5 | — | — | — | 4987.5 | 0.05 | 5 | — | — | — |
| LYM1207 | 80249.2 | 412.5 | L | 12 | 5137.5 | L | 8 | — | — | — |
| LYM1207 | 80250.1 | — | — | — | 4937.5 | 0.08 | 4 | 9.62 | 0.26 | 2 |
| LYM1201 | 81104.1 | 388.1 | 0.19 | 5 | 5187.5 | L | 9 | — | — | — |
| LYM1192 | 81128.3 | 385.0 | 0.19 | 4 | 5087.5 | 0.02 | 7 | — | — | — |
| LYM1191 | 80380.1 | 381.9 | 0.29 | 3 | 5143.8 | L | 8 | — | — | — |
| LYM1191 | 80383.1 | — | — | — | 5100.0 | L | 7 | — | — | — |
| LYM1189 | 81099.1 | 386.9 | 0.15 | 5 | 5043.8 | 0.13 | 6 | — | — | — |
| LYM1176 | 80810.3 | — | — | — | 5087.5 | 0.04 | 7 | — | — | — |
| LYM1176 | 80811.3 | — | — | — | 5016.1 | 0.05 | 6 | — | — | — |
| LYM1173 | 80465.1 | — | — | — | 5081.2 | 0.14 | 7 | — | — | — |
| LYM1170 | 80187.4 | — | — | — | — | — | — | 9.69 | 0.17 | 3 |
| LYM1170 | 80188.3 | 420.6 | L | 14 | 5606.2 | L | 18 | 9.81 | 0.05 | 4 |
| LYM1169 | 80606.2 | — | — | — | 4875.0 | 0.20 | 3 | — | — | — |
| LYM1169 | 80610.3 | — | — | — | — | — | — | 9.94 | 0.02 | 5 |
| LYM1169 | 80610.4 | — | — | — | 4914.3 | 0.13 | 4 | — | — | — |
| LYM1161 | 80178.4 | — | — | — | 4906.2 | 0.21 | 3 | — | — | — |
| LYM1158 | 80461.3 | — | — | — | 5031.2 | 0.14 | 6 | — | — | — |
| LYM1115 | 80134.2 | — | — | — | 5118.8 | 0.06 | 8 | — | — | — |
| LYM1115 | 80135.2 | — | — | — | 5218.8 | L | 10 | — | — | — |
| LYM1073 | 80981.1 | — | — | — | 4943.8 | 0.07 | 4 | — | — | — |
| LYM1054 | 80109.1 | — | — | — | — | — | — | 9.81 | 0.05 | 4 |
| LYM1054 | 80110.4 | 423.1 | L | 15 | 5412.5 | L | 14 | — | — | — |
| CONT. | — | 369.5 | — | — | 4746.4 | — | — | 9.45 | — | — |
| LYM1223 | 81211.3 | 359.7 | 0.08 | 4 | 5335.7 | 0.02 | 16 | — | — | — |
| LYM1223 | 81212.3 | — | — | — | — | — | — | 9.75 | 0.11 | 4 |
| LYM1220 | 80484.2 | 374.6 | L | 8 | 4892.9 | 0.14 | 6 | — | — | — |
| LYM1220 | 80484.5 | 376.2 | 0.07 | 9 | — | — | — | 9.56 | 0.25 | 2 |
| LYM1220 | 80484.6 | — | — | — | — | — | — | 9.62 | 0.25 | 3 |
| LYM1220 | 80486.1 | — | — | — | — | — | — | 9.75 | 0.11 | 4 |
| LYM1211 | 80254.3 | — | — | — | 4787.5 | 0.27 | 4 | — | — | — |
| LYM1211 | 80255.2 | 355.6 | 0.18 | 3 | — | — | — | — | — | — |
| LYM1202 | 81107.2 | — | — | — | — | — | — | 10.0 | 0.03 | 7 |
| LYM1202 | 81107.3 | — | — | — | 5175.0 | L | 13 | — | — | — |
| LYM1111 | 81369.4 | — | — | — | 4954.2 | 0.14 | 8 | 9.62 | 0.12 | 3 |
| LYM1111 | 81369.5 | — | — | — | 5042.0 | 0.15 | 10 | — | — | — |
| LYM1111 | 81373.2 | 357.5 | 0.03 | 4 | 5093.8 | 0.01 | 11 | — | — | — |
| LYM1111 | 81373.4 | 368.1 | L | 7 | 5187.5 | 0.02 | 13 | — | — | — |

TABLE 113-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM1111 | 81373.6 | 365.6 | 0.10 | 6 | — | — | — | — | — | — |
| LYM1108 | 80120.3 | 352.5 | 0.15 | 2 | — | — | — | — | — | — |
| LYM1072 | 80975.5 | — | — | — | — | — | — | 9.69 | 0.30 | 3 |
| LYM1063 | 81348.4 | — | — | — | 5050.0 | 0.02 | 10 | — | — | — |
| LYM1053 | 80771.4 | — | — | — | — | — | — | 9.81 | 0.02 | 5 |
| LYM1053 | 80774.3 | — | — | — | 5012.5 | 0.03 | 9 | — | — | — |
| LYM1051 | 80331.3 | — | — | — | — | — | — | 9.94 | 0.12 | 6 |
| LYM1029 | 81353.6 | — | — | — | — | — | — | 9.56 | 0.25 | 2 |
| LYM1026 | 80323.2 | 356.9 | 0.01 | 3 | — | — | — | — | — | — |
| LYM1021 | 81204.4 | 387.4 | 0.14 | 12 | 4930.4 | 0.07 | 7 | 9.69 | 0.30 | 3 |
| LYM1017 | 81072.2 | — | — | — | — | — | — | 10.2 | 0.11 | 9 |
| LYM1017 | 81072.3 | 375.6 | L | 9 | 5450.0 | L | 19 | — | — | — |
| LYM1017 | 81072.4 | 357.5 | 0.26 | 4 | 4912.5 | 0.25 | 7 | — | — | — |
| LYM1016 | 80947.2 | — | — | — | 4891.1 | 0.28 | 6 | — | — | — |
| LYM1016 | 80948.2 | 368.8 | L | 7 | 4818.8 | 0.27 | 5 | — | — | — |
| LYM1016 | 80950.3 | 360.6 | L | 4 | 5075.0 | 0.28 | 10 | — | — | — |
| LYM1015 | 80088.6 | 361.1 | 0.18 | 5 | — | — | — | — | — | — |
| LYM1015 | 80089.5 | 370.0 | 0.14 | 7 | — | — | — | — | — | — |
| CONT. | — | 345.4 | — | — | 4599.0 | — | — | 9.38 | — | — |
| LYM1187 | 82688.7 | 175.6 | 0.29 | 23 | — | — | — | — | — | — |
| LYM1187 | 82689.5 | — | — | — | 1568.8 | 0.30 | 13 | — | — | — |
| LYM1184 | 82873.5 | — | — | — | 1706.2 | 0.17 | 23 | — | — | — |
| LYM1154 | 82551.2 | 173.8 | 0.25 | 22 | — | — | — | 9.62 | 0.23 | 5 |
| LYM1154 | 82553.6 | — | — | — | 1681.2 | 0.06 | 22 | — | — | — |
| LYM1154 | 82553.9 | 177.5 | 0.03 | 24 | 2056.2 | 0.04 | 49 | 10.1 | 0.24 | 10 |
| LYM1142 | 83549.1 | 162.5 | 0.16 | 14 | 1575.0 | 0.27 | 14 | — | — | — |
| LYM1123 | 82866.2 | 167.5 | 0.12 | 17 | — | — | — | — | — | — |
| LYM1121 | 82541.3 | 164.4 | 0.13 | 15 | 1793.8 | 0.10 | 30 | — | — | — |
| LYM1114 | 82487.11 | — | — | — | 1725.0 | 0.04 | 25 | — | — | — |
| LYM1106 | 82625.4 | — | — | — | 1680.4 | 0.06 | 21 | — | — | — |
| LYM1105_H2 | 82620.2 | 161.9 | 0.22 | 13 | 1831.2 | 0.02 | 32 | — | — | — |
| LYM1105_H2 | 82621.1 | — | — | — | 1568.8 | 0.20 | 13 | — | — | — |
| LYM1101_H3 | 82615.10 | 158.1 | 0.29 | 11 | — | — | — | — | — | — |
| LYM1086 | 82371.8 | 169.4 | 0.08 | 19 | 1775.0 | 0.02 | 28 | — | — | — |
| LYM1086 | 82373.3 | 183.4 | 0.22 | 28 | 1782.1 | 0.03 | 29 | — | — | — |
| LYM1078 | 82657.5 | 182.5 | 0.02 | 28 | 1918.8 | 0.04 | 39 | — | — | — |
| LYM1078 | 82659.5 | 167.0 | 0.11 | 17 | — | — | — | — | — | — |
| LYM1074 | 82571.4 | 161.2 | 0.19 | 13 | 1600.0 | 0.18 | 16 | — | — | — |
| LYM1074 | 82572.2 | — | — | — | 1662.5 | 0.08 | 20 | — | — | — |
| LYM1058_H4 | 83372.5 | 173.4 | 0.13 | 21 | 1817.0 | 0.12 | 31 | — | — | — |
| LYM1058_H4 | 83372.6 | 184.4 | 0.06 | 29 | 1837.5 | 0.01 | 33 | — | — | — |
| LYM1058_H4 | 83374.1 | 158.9 | 0.28 | 11 | — | — | — | — | — | — |
| LYM1037 | 82524.2 | — | — | — | 1642.0 | 0.24 | 19 | — | — | — |
| LYM1037 | 82524.3 | — | — | — | 1725.0 | 0.24 | 25 | — | — | — |
| LYM1033 | 82883.4 | 163.1 | 0.25 | 14 | 1812.5 | 0.03 | 31 | — | — | — |
| LYM1033 | 82885.5 | — | — | — | 1749.1 | 0.04 | 26 | 9.56 | 0.06 | 5 |
| LYM1023 | 82516.1 | 178.1 | 0.06 | 25 | 1856.2 | 0.01 | 34 | — | — | — |
| CONT. | — | 142.8 | — | — | 1383.2 | — | — | 9.12 | — | — |
| LYM1235 | 81117.1 | — | — | — | 4106.2 | 0.10 | 7 | — | — | — |
| LYM1235 | 81121.1 | 308.8 | 0.29 | 5 | — | — | — | — | — | — |
| LYM1235 | 81121.3 | — | — | — | 3987.5 | 0.17 | 4 | — | — | — |
| LYM1233 | 80500.2 | 310.0 | 0.02 | 6 | — | — | — | — | — | — |
| LYM1233 | 80500.3 | 310.6 | 0.06 | 6 | 4200.0 | 0.01 | 9 | — | — | — |
| LYM1233 | 80501.2 | 333.1 | 0.03 | 14 | 4437.5 | L | 15 | — | — | — |
| LYM1233 | 80503.4 | — | — | — | 4125.0 | 0.20 | 7 | — | — | — |
| LYM1231 | 80494.2 | 351.2 | 0.15 | 20 | 4400.0 | 0.06 | 14 | — | — | — |
| LYM1231 | 80496.6 | 323.1 | 0.01 | 10 | 4068.7 | 0.22 | 6 | — | — | — |
| LYM1230 | 80490.1 | 315.0 | 0.27 | 7 | 4100.0 | 0.03 | 7 | — | — | — |
| LYM1230 | 80490.2 | — | — | — | 4000.0 | 0.25 | 4 | — | — | — |
| LYM1230 | 80493.5 | — | — | — | — | — | — | 9.75 | 0.10 | 3 |
| LYM1223 | 81210.3 | 306.2 | 0.06 | 4 | — | — | — | — | — | — |
| LYM1223 | 81211.3 | 314.4 | 0.03 | 7 | 4031.2 | 0.16 | 5 | — | — | — |
| LYM1223 | 81212.3 | 322.5 | 0.05 | 10 | 4150.0 | 0.02 | 8 | — | — | — |
| LYM1220 | 80484.2 | 324.4 | 0.19 | 11 | 4100.0 | 0.23 | 7 | — | — | — |
| LYM1220 | 80484.3 | — | — | — | 4181.2 | 0.05 | 9 | — | — | — |
| LYM1220 | 80484.5 | 333.1 | L | 14 | 4125.0 | 0.02 | 7 | — | — | — |
| LYM1220 | 80486.1 | 338.8 | L | 15 | 4243.8 | L | 10 | — | — | — |
| LYM1219 | 80510.2 | 325.6 | L | 11 | 4200.0 | L | 9 | — | — | — |
| LYM1219 | 80510.3 | 320.0 | L | 9 | 4250.0 | L | 10 | — | — | — |
| LYM1219 | 80513.1 | 308.2 | 0.05 | 5 | 4075.0 | 0.26 | 6 | — | — | — |
| LYM1219 | 80513.3 | — | — | — | 4031.2 | 0.16 | 5 | — | — | — |
| LYM1211 | 80254.3 | 308.8 | 0.23 | 5 | — | — | — | — | — | — |

TABLE 113-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM1211 | 80255.2 | 304.4 | 0.24 | 4 | 4081.2 | 0.07 | 6 | — | — | — |
| LYM1202 | 81107.2 | 303.1 | 0.21 | 3 | — | — | — | — | — | — |
| LYM1202 | 81108.1 | 330.0 | L | 12 | 4131.2 | 0.02 | 7 | — | — | — |
| LYM1202 | 81109.2 | 310.0 | 0.26 | 6 | 3993.8 | 0.21 | 4 | — | — | — |
| LYM1202 | 81109.3 | — | — | — | — | — | — | 9.62 | 0.30 | 2 |
| LYM1109 | 80123.1 | 315.6 | L | 8 | 4231.2 | L | 10 | — | — | — |
| LYM1109 | 80123.2 | 300.6 | 0.27 | 2 | 3968.8 | 0.26 | 3 | — | — | — |
| LYM1109 | 80125.2 | 309.4 | 0.03 | 5 | 4050.0 | 0.06 | 5 | — | — | — |
| LYM1108 | 80116.1 | — | — | — | 4175.0 | 0.07 | 9 | — | — | — |
| LYM1108 | 80119.3 | 301.9 | 0.20 | 3 | — | — | — | — | — | — |
| LYM1102 | 80994.1 | 325.6 | L | 11 | 4137.5 | 0.04 | 8 | — | — | — |
| LYM1097 | 80983.1 | — | — | — | 4125.0 | 0.20 | 7 | — | — | — |
| LYM1063 | 81347.1 | 328.1 | 0.22 | 12 | 4287.5 | 0.21 | 11 | — | — | — |
| LYM1063 | 81348.2 | — | — | — | 4112.5 | 0.02 | 7 | — | — | — |
| LYM1021 | 81204.4 | 309.4 | 0.02 | 5 | 4037.5 | 0.17 | 5 | — | — | — |
| LYM1021 | 81208.2 | 314.4 | 0.01 | 7 | 3993.8 | 0.15 | 4 | — | — | — |
| LYM1016 | 80948.2 | — | — | — | — | — | — | 9.88 | 0.29 | 5 |
| LYM1016 | 80950.2 | 315.0 | L | 7 | 4037.5 | 0.21 | 5 | — | — | — |
| LYM1010 | 81062.1 | 313.1 | 0.02 | 7 | 4081.2 | 0.07 | 6 | — | — | — |
| LYM1010 | 81062.2 | — | — | — | 4000.0 | 0.14 | 4 | — | — | — |
| LYM1010 | 81063.4 | 326.9 | 0.02 | 11 | 4068.7 | 0.08 | 6 | — | — | — |
| LYM1010 | 81064.1 | 305.0 | 0.19 | 4 | — | — | — | — | — | — |
| CONT. | — | 293.4 | — | — | 3846.4 | — | — | 9.45 | — | — |
| LYM1107 | 82649.3 | — | — | — | 1692.9 | 0.39 | 4 | — | — | — |
| CONT. | — | — | — | — | 1628.6 | — | — | — | — | — |

"CONT."—Control; "Ave."—Average; "% Incr." = % increment; "p-val."—p-value, L-p < 0.01.

TABLE 114

Genes showing improved plant performance at Normal growth conditions under regulation of At6669 promoter

| Gene Name | Event # | Plot Coverage [cm$^2$] | | | Rosette Area [cm$^2$] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM1239 | 82026.4 | 53.3 | 0.21 | 21 | 6.67 | 0.21 | 21 | 4.46 | 0.10 | 8 |
| LYM1153 | 83265.5 | 48.0 | 0.04 | 9 | 5.99 | 0.04 | 9 | — | — | — |
| LYM1153 | 83269.5 | 55.4 | L | 26 | 6.92 | L | 26 | 4.49 | L | 9 |
| LYM1129 | 81505.5 | 46.7 | 0.11 | 6 | 5.84 | 0.11 | 6 | — | — | — |
| LYM1127 | 81671.6 | 45.9 | 0.23 | 5 | 5.74 | 0.23 | 5 | — | — | — |
| LYM1125 | 83042.1 | 47.6 | 0.05 | 8 | 5.95 | 0.05 | 8 | 4.27 | 0.28 | 3 |
| LYM1125 | 83042.3 | 47.6 | 0.06 | 8 | 5.95 | 0.06 | 8 | 4.30 | 0.23 | 4 |
| LYM1125 | 83042.5 | 49.5 | L | 13 | 6.18 | L | 13 | 4.36 | 0.02 | 5 |
| LYM1097 | 80984.1 | — | — | — | — | — | — | 4.25 | 0.15 | 3 |
| LYM1093 | 81711.2 | — | — | — | — | — | — | 4.32 | 0.23 | 4 |
| LYM1093 | 81713.4 | 48.5 | 0.13 | 10 | 6.06 | 0.13 | 10 | — | — | — |
| LYM1088 | 83558.5 | 45.9 | 0.26 | 5 | 5.74 | 0.26 | 5 | — | — | — |
| LYM1085 | 82683.2 | — | — | — | — | — | — | 4.24 | 0.18 | 3 |
| LYM1075 | 83047.8 | 47.7 | 0.17 | 9 | 5.96 | 0.17 | 9 | — | — | — |
| LYM1075 | 83049.1 | 45.9 | 0.24 | 5 | 5.74 | 0.24 | 5 | 4.26 | 0.13 | 3 |
| LYM1070 | 82533.4 | 48.5 | 0.02 | 11 | 6.07 | 0.02 | 11 | 4.26 | 0.13 | 3 |
| LYM1035 | 83264.6 | 47.1 | 0.10 | 7 | 5.88 | 0.10 | 7 | — | — | — |
| CONT. | — | 43.9 | — | — | 5.49 | — | — | 4.13 | — | — |
| LYM1229 | 81574.1 | 60.3 | 0.04 | 28 | 7.54 | 0.04 | 28 | 4.59 | 0.04 | 13 |
| LYM1229 | 81575.3 | 63.4 | 0.03 | 34 | 7.92 | 0.03 | 34 | 4.72 | 0.02 | 16 |
| LYM1229 | 81576.5 | 59.4 | 0.03 | 26 | 7.43 | 0.03 | 26 | 4.69 | 0.02 | 15 |
| LYM1221 | 81714.4 | 54.9 | 0.14 | 16 | 6.86 | 0.14 | 16 | 4.59 | 0.04 | 13 |
| LYM1221 | 81716.1 | 52.9 | 0.25 | 12 | 6.61 | 0.25 | 12 | 4.36 | 0.19 | 7 |
| LYM1221 | 81718.1 | — | — | — | — | — | — | 4.30 | 0.29 | 6 |
| LYM1212 | 80778.2 | — | — | — | — | — | — | 4.34 | 0.22 | 7 |
| LYM1195 | 81918.1 | 62.1 | 0.02 | 32 | 7.76 | 0.02 | 32 | 4.68 | 0.02 | 15 |
| LYM1195 | 81919.3 | 53.8 | 0.19 | 14 | 6.73 | 0.19 | 14 | 4.57 | 0.05 | 12 |
| LYM1195 | 81919.6 | — | — | — | — | — | — | 4.39 | 0.15 | 8 |
| LYM1194 | 81623.1 | 55.6 | 0.21 | 18 | 6.95 | 0.21 | 18 | 4.52 | 0.22 | 11 |
| LYM1194 | 81624.2 | 53.0 | 0.24 | 12 | 6.63 | 0.24 | 12 | 4.52 | 0.06 | 11 |
| LYM1194 | 81624.4 | — | — | — | — | — | — | 4.31 | 0.30 | 6 |

TABLE 114-continued

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM1175 | 82018.2 | 53.3 | 0.22 | 13 | 6.67 | 0.22 | 13 | 4.35 | 0.21 | 7 |
| LYM1146 | 81488.2 | 54.6 | 0.15 | 16 | 6.83 | 0.15 | 16 | 4.59 | 0.04 | 13 |
| LYM1138 | 81477.5 | — | — | — | — | — | — | 4.48 | 0.11 | 10 |
| LYM1138 | 81480.1 | — | — | — | — | — | — | 4.56 | 0.23 | 12 |
| LYM1129 | 81504.2 | 59.3 | 0.21 | 26 | 7.41 | 0.21 | 26 | 4.80 | 0.01 | 18 |
| LYM1124 | 82008.2 | 56.5 | 0.23 | 20 | 7.06 | 0.23 | 20 | 4.54 | 0.14 | 11 |
| LYM1124 | 82009.3 | 60.9 | 0.02 | 29 | 7.62 | 0.02 | 29 | 4.76 | 0.01 | 17 |
| LYM1124 | 82009.5 | 53.4 | 0.23 | 13 | 6.68 | 0.23 | 13 | 4.40 | 0.15 | 8 |
| LYM1124 | 82010.2 | 58.4 | 0.05 | 24 | 7.30 | 0.05 | 24 | 4.62 | 0.04 | 14 |
| LYM1111 | 81369.5 | — | — | — | — | — | — | 4.44 | 0.27 | 9 |
| LYM1111 | 81373.5 | 55.1 | 0.18 | 17 | 6.89 | 0.18 | 17 | 4.44 | 0.12 | 9 |
| LYM1072 | 80973.2 | — | — | — | — | — | — | 4.38 | 0.16 | 8 |
| LYM1053 | 80772.3 | 57.4 | 0.06 | 22 | 7.18 | 0.06 | 22 | 4.55 | 0.05 | 12 |
| LYM1053 | 80772.5 | — | — | — | — | — | — | 4.40 | 0.18 | 8 |
| LYM1042 | 82001.2 | — | — | — | — | — | — | 4.49 | 0.22 | 10 |
| LYM1022 | 82057.2 | — | — | — | — | — | — | 4.42 | 0.13 | 9 |
| LYM1022 | 82057.4 | 58.6 | 0.05 | 24 | 7.32 | 0.05 | 24 | 4.64 | 0.03 | 14 |
| LYM1022 | 82061.3 | 58.7 | 0.17 | 24 | 7.34 | 0.17 | 24 | 4.65 | 0.18 | 14 |
| LYM1017 | 81072.3 | 53.6 | 0.20 | 14 | 6.70 | 0.20 | 14 | 4.48 | 0.08 | 10 |
| CONT. | — | 47.2 | — | — | 5.90 | — | — | 4.07 | — | — |
| LYM1204 | 81054.3 | — | — | — | — | — | — | 4.56 | 0.23 | 3 |
| LYM1151 | 80394.1 | 53.4 | 0.14 | 8 | 6.67 | 0.14 | 8 | 4.58 | 0.14 | 4 |
| LYM1151 | 80394.9 | — | — | — | — | — | — | 4.55 | 0.23 | 3 |
| LYM1141 | 80271.3 | 54.1 | 0.14 | 10 | 6.76 | 0.14 | 10 | 4.60 | 0.24 | 4 |
| LYM1141 | 80271.5 | 60.9 | 0.08 | 24 | 7.61 | 0.08 | 24 | 4.81 | 0.17 | 9 |
| LYM1139 | 80171.3 | 64.3 | L | 31 | 8.04 | L | 31 | 5.12 | L | 16 |
| LYM1117 | 80266.7 | 53.0 | 0.12 | 8 | 6.62 | 0.12 | 8 | 4.65 | 0.11 | 6 |
| LYM1069 | 81087.1 | 57.2 | L | 16 | 7.14 | L | 16 | 4.83 | 0.19 | 10 |
| LYM1011 | 80942.2 | 57.9 | L | 18 | 7.24 | L | 18 | 4.77 | 0.02 | 8 |
| LYM1011 | 80945.2 | 53.9 | 0.28 | 9 | 6.74 | 0.28 | 9 | — | — | — |
| CONT. | — | 49.3 | — | — | 6.16 | — | — | 4.40 | — | — |
| LYM1236 | 80506.5 | 75.4 | 0.06 | 22 | 9.43 | 0.06 | 22 | 5.13 | 0.24 | 10 |
| LYM1227 | 81179.5 | 72.4 | 0.11 | 17 | 9.04 | 0.11 | 17 | 5.19 | 0.04 | 11 |
| LYM1213 | 81343.4 | 73.3 | 0.08 | 18 | 9.16 | 0.08 | 18 | 5.14 | 0.07 | 10 |
| LYM1213 | 81343.6 | 71.9 | 0.24 | 16 | 8.99 | 0.24 | 16 | 5.06 | 0.18 | 8 |
| LYM1203 | 81750.1 | 76.0 | 0.04 | 23 | 9.50 | 0.04 | 23 | 5.11 | 0.08 | 9 |
| LYM1203 | 81751.2 | 71.2 | 0.25 | 15 | 8.90 | 0.25 | 15 | — | — | — |
| LYM1203 | 81751.5 | 78.5 | 0.02 | 27 | 9.81 | 0.02 | 27 | 5.26 | 0.03 | 12 |
| LYM1203 | 81752.6 | 71.0 | 0.15 | 15 | 8.88 | 0.15 | 15 | 5.05 | 0.14 | 8 |
| LYM1196 | 80558.4 | 79.8 | 0.02 | 29 | 9.98 | 0.02 | 29 | 5.33 | 0.02 | 14 |
| LYM1196 | 80558.5 | 68.2 | 0.29 | 10 | 8.52 | 0.29 | 10 | 4.96 | 0.23 | 6 |
| LYM1182 | 81494.2 | 71.3 | 0.13 | 15 | 8.92 | 0.13 | 15 | 5.08 | 0.09 | 8 |
| LYM1156 | 81017.4 | 70.6 | 0.24 | 14 | 8.82 | 0.24 | 14 | 5.00 | 0.17 | 7 |
| LYM1127 | 81669.2 | 74.5 | 0.06 | 20 | 9.32 | 0.06 | 20 | 5.22 | 0.03 | 11 |
| LYM1094 | 81744.3 | 72.1 | 0.11 | 16 | 9.01 | 0.11 | 16 | 5.02 | 0.13 | 7 |
| LYM1094 | 81746.3 | 68.2 | 0.30 | 10 | 8.53 | 0.30 | 10 | 4.96 | 0.22 | 6 |
| LYM1093 | 81713.4 | 70.4 | 0.25 | 14 | 8.80 | 0.25 | 14 | — | — | — |
| LYM1060 | 80965.3 | 70.7 | 0.16 | 14 | 8.84 | 0.16 | 14 | 5.00 | 0.16 | 7 |
| LYM1060 | 80965.4 | 79.2 | 0.08 | 28 | 9.90 | 0.08 | 28 | 5.30 | 0.11 | 13 |
| LYM1060 | 80965.6 | 74.2 | 0.06 | 20 | 9.27 | 0.06 | 20 | 5.12 | 0.07 | 9 |
| LYM1057 | 81989.1 | — | — | — | — | — | — | 4.98 | 0.18 | 6 |
| LYM1051 | 80331.2 | 68.9 | 0.24 | 11 | 8.61 | 0.24 | 11 | — | — | — |
| LYM1026 | 80325.3 | 73.7 | 0.15 | 19 | 9.21 | 0.15 | 19 | 5.04 | 0.15 | 8 |
| LYM1020 | 81482.3 | 73.2 | 0.11 | 18 | 9.15 | 0.11 | 18 | 5.11 | 0.08 | 9 |
| LYM1020 | 81483.1 | — | — | — | — | — | — | 4.93 | 0.27 | 5 |
| LYM1020 | 81484.3 | 74.0 | 0.07 | 19 | 9.25 | 0.07 | 19 | 5.26 | 0.03 | 12 |
| LYM1015 | 80089.4 | 72.8 | 0.17 | 17 | 9.09 | 0.17 | 17 | — | — | — |
| CONT. | — | 62.0 | — | — | 7.75 | — | — | 4.68 | — | — |
| LYM1218 | 81116.6 | 37.9 | 0.02 | 14 | 4.74 | 0.021 | 4 | 3.98 | 0.02 | 9 |
| LYM1207 | 80247.4 | 35.1 | 0.17 | 6 | 4.39 | 0.17 | 6 | 3.83 | 0.07 | 5 |
| LYM1207 | 80249.2 | 44.2 | 0.19 | 33 | 5.52 | 0.19 | 33 | 4.33 | 0.17 | 18 |
| LYM1201 | 81104.1 | 39.7 | L | 20 | 4.96 | L | 20 | 3.99 | 0.15 | 9 |
| LYM1201 | 81104.4 | 36.8 | 0.13 | 11 | 4.60 | 0.13 | 11 | 3.90 | 0.02 | 7 |
| LYM1191 | 80380.1 | 35.3 | 0.20 | 6 | 4.41 | 0.20 | 6 | 3.83 | 0.08 | 5 |
| LYM1191 | 80381.4 | 39.5 | L | 19 | 4.93 | L | 19 | 3.91 | 0.06 | 7 |
| LYM1189 | 81099.2 | 40.6 | 0.08 | 22 | 5.08 | 0.08 | 22 | 4.08 | L | 12 |
| LYM1176 | 80810.3 | 37.5 | 0.03 | 13 | 4.69 | 0.03 | 13 | 3.91 | 0.06 | 7 |
| LYM1176 | 80811.3 | 34.7 | 0.27 | 4 | 4.33 | 0.27 | 4 | — | — | — |
| LYM1173 | 80465.1 | 36.1 | 0.06 | 9 | 4.52 | 0.06 | 9 | 3.87 | 0.04 | 6 |
| LYM1170 | 80188.3 | 37.4 | 0.20 | 13 | 4.68 | 0.20 | 13 | 3.93 | 0.04 | 7 |
| LYM1161 | 80179.1 | 47.9 | 0.04 | 44 | 5.99 | 0.04 | 44 | 4.34 | 0.03 | 19 |

TABLE 114-continued

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM1158 | 80461.5 | 36.2 | 0.04 | 9 | 4.53 | 0.04 | 9 | 3.94 | 0.13 | 8 |
| LYM1115 | 80135.2 | — | — | — | — | — | — | 3.85 | 0.12 | 5 |
| LYM1054 | 80110.4 | 43.3 | 0.01 | 31 | 5.41 | 0.01 | 31 | 4.26 | L | 16 |
| CONT. | — | 33.2 | — | — | 4.15 | — | — | 3.66 | — | — |
| LYM1220 | 80484.2 | 45.6 | 0.30 | 15 | 5.71 | 0.30 | 15 | 4.39 | 0.13 | 8 |
| LYM1220 | 80484.3 | 48.4 | 0.12 | 22 | 6.05 | 0.12 | 22 | 4.51 | 0.15 | 11 |
| LYM1220 | 80484.5 | 50.6 | 0.09 | 27 | 6.32 | 0.09 | 27 | 4.56 | 0.21 | 12 |
| LYM1220 | 80486.1 | 55.1 | 0.28 | 39 | 6.89 | 0.28 | 39 | — | — | — |
| LYM1211 | 80255.2 | 43.9 | 0.21 | 10 | 5.49 | 0.21 | 10 | 4.32 | 0.15 | 6 |
| LYM1202 | 81107.3 | 43.1 | 0.30 | 8 | 5.39 | 0.30 | 8 | 4.22 | 0.22 | 4 |
| LYM1111 | 81373.4 | 44.2 | 0.08 | 11 | 5.53 | 0.08 | 11 | 4.35 | L | 7 |
| LYM1111 | 81373.6 | 48.9 | 0.19 | 23 | 6.12 | 0.19 | 23 | 4.56 | 0.22 | 12 |
| LYM1108 | 80120.3 | 43.6 | 0.27 | 10 | 5.45 | 0.27 | 10 | 4.32 | 0.06 | 6 |
| LYM1053 | 80772.5 | 41.8 | 0.16 | 5 | 5.22 | 0.16 | 5 | — | — | — |
| LYM1051 | 80331.1 | 43.3 | 0.09 | 9 | 5.42 | 0.09 | 9 | 4.40 | L | 8 |
| LYM1021 | 81204.4 | 42.0 | 0.22 | 6 | 5.25 | 0.22 | 6 | 4.25 | 0.03 | 5 |
| LYM1017 | 81072.2 | 51.4 | L | 29 | 6.43 | L | 29 | 4.62 | L | 14 |
| LYM1017 | 81072.3 | 49.4 | L | 24 | 6.18 | L | 24 | 4.71 | L | 16 |
| LYM1017 | 81076.2 | — | — | — | — | — | — | 4.35 | 0.24 | 7 |
| LYM1016 | 80947.2 | 41.8 | 0.07 | 5 | 5.22 | 0.07 | 5 | 4.22 | 0.05 | 4 |
| LYM1016 | 80948.2 | 46.0 | L | 16 | 5.76 | L | 16 | 4.36 | 0.15 | 7 |
| LYM1016 | 80948.3 | 43.4 | 0.26 | 9 | 5.42 | 0.26 | 9 | 4.21 | 0.26 | 3 |
| LYM1016 | 80950.3 | 45.1 | 0.14 | 13 | 5.63 | 0.14 | 13 | 4.35 | L | 7 |
| LYM1015 | 80089.5 | 46.4 | 0.13 | 17 | 5.80 | 0.13 | 17 | 4.36 | 0.02 | 7 |
| CONT. | — | 39.8 | — | — | 4.97 | — | — | 4.07 | — | — |
| LYM1187 | 82688.7 | 47.8 | 0.12 | 17 | 5.98 | 0.13 | 14 | 4.20 | 0.10 | 8 |
| LYM1187 | 82688.9 | — | — | — | — | — | — | 4.45 | 0.22 | 14 |
| LYM1184 | 82873.5 | — | — | — | — | — | — | 4.29 | 0.12 | 10 |
| LYM1154 | 82551.2 | 57.7 | 0.01 | 41 | 7.21 | 0.02 | 37 | 4.61 | L | 19 |
| LYM1154 | 82553.9 | 62.9 | 0.06 | 54 | 7.87 | 0.08 | 50 | 4.78 | 0.04 | 23 |
| LYM1142 | 83549.1 | 47.2 | 0.14 | 16 | 5.90 | 0.15 | 12 | 4.09 | 0.23 | 5 |
| LYM1121 | 82541.3 | 55.0 | 0.09 | 35 | 6.88 | 0.12 | 31 | 4.55 | 0.08 | 17 |
| LYM1114 | 82487.11 | 48.3 | 0.13 | 18 | 6.03 | 0.14 | 15 | 4.38 | 0.04 | 13 |
| LYM1106 | 82625.4 | 47.5 | 0.13 | 16 | 5.94 | 0.12 | 13 | 4.22 | 0.07 | 9 |
| LYM1105_H2 | 82620.2 | 53.5 | 0.01 | 31 | 6.69 | L | 27 | 4.44 | L | 14 |
| LYM1086 | 82371.8 | 51.6 | 0.03 | 26 | 6.45 | 0.02 | 23 | 4.44 | 0.01 | 14 |
| LYM1086 | 82373.3 | 51.0 | 0.08 | 25 | 6.37 | 0.09 | 21 | 4.26 | 0.18 | 10 |
| LYM1078 | 82657.5 | 56.5 | 0.06 | 38 | 7.06 | 0.08 | 34 | 4.51 | 0.12 | 16 |
| LYM1078 | 82659.2 | 46.0 | 0.22 | 13 | 5.75 | 0.24 | 9 | — | — | — |
| LYM1074 | 82570.1 | 46.0 | 0.26 | 13 | — | — | — | 4.12 | 0.20 | 6 |
| LYM1074 | 82570.2 | 46.7 | 0.17 | 14 | 5.83 | 0.19 | 11 | 4.07 | 0.27 | 5 |
| LYM1074 | 82571.4 | — | — | — | — | — | — | 4.15 | 0.26 | 7 |
| LYM1074 | 82572.2 | 49.2 | 0.07 | 20 | 6.15 | 0.07 | 17 | 4.34 | 0.02 | 11 |
| LYM1058_H4 | 83372.6 | 52.3 | 0.02 | 28 | 6.53 | 0.02 | 24 | 4.42 | L | 14 |
| LYM1037 | 82524.3 | 47.3 | 0.27 | 16 | — | — | — | — | — | — |
| LYM1033 | 82883.4 | 54.7 | 0.03 | 34 | 6.84 | 0.04 | 30 | 4.56 | 0.05 | 17 |
| LYM1023 | 82516.1 | 56.7 | L | 39 | 7.09 | L | 35 | 4.57 | L | 17 |
| CONT. | — | 40.8 | — | — | 5.26 | — | — | 3.89 | — | — |
| LYM1235 | 81121.1 | 30.3 | 0.20 | 14 | 3.79 | 0.20 | 14 | — | — | — |
| LYM1235 | 81121.3 | 27.8 | 0.28 | 5 | 3.47 | 0.28 | 5 | — | — | — |
| LYM1233 | 80500.2 | 31.0 | 0.03 | 17 | 3.88 | 0.03 | 17 | 3.70 | L | 12 |
| LYM1233 | 80501.2 | 29.5 | 0.03 | 11 | 3.69 | 0.03 | 11 | 3.43 | 0.04 | 4 |
| LYM1233 | 80502.5 | 28.8 | 0.17 | 9 | 3.60 | 0.17 | 9 | — | — | — |
| LYM1233 | 80503.4 | 35.3 | 0.16 | 33 | 4.41 | 0.16 | 33 | 3.79 | 0.14 | 15 |
| LYM1231 | 80494.2 | 31.9 | L | 20 | 3.99 | L | 20 | 3.67 | L | 11 |
| LYM1231 | 80496.2 | 33.4 | L | 26 | 4.17 | L | 26 | 3.77 | 0.19 | 14 |
| LYM1231 | 80496.6 | 31.1 | L | 17 | 3.88 | L | 17 | 3.55 | 0.05 | 8 |
| LYM1230 | 80493.5 | 30.1 | 0.18 | 14 | 3.76 | 0.18 | 14 | 3.62 | 0.09 | 10 |
| LYM1220 | 80484.2 | 28.9 | 0.07 | 9 | 3.62 | 0.07 | 9 | — | — | — |
| LYM1220 | 80484.3 | 30.4 | 0.08 | 15 | 3.80 | 0.08 | 15 | 3.48 | 0.25 | 5 |
| LYM1220 | 80484.5 | 30.6 | 0.06 | 16 | 3.83 | 0.06 | 16 | 3.53 | L | 7 |
| LYM1220 | 80484.6 | — | — | — | — | — | — | 3.42 | 0.04 | 4 |
| LYM1220 | 80486.1 | 39.4 | 0.25 | 49 | 4.93 | 0.25 | 49 | 4.00 | 0.23 | 21 |
| LYM1211 | 80255.2 | — | — | — | — | — | — | 3.40 | 0.13 | 3 |
| LYM1202 | 81107.2 | 30.5 | 0.13 | 15 | 3.81 | 0.13 | 15 | 3.50 | 0.05 | 6 |
| LYM1202 | 81108.1 | 32.9 | 0.01 | 24 | 4.11 | 0.01 | 24 | 3.67 | L | 11 |
| LYM1202 | 81109.2 | 29.8 | 0.02 | 13 | 3.73 | 0.02 | 13 | 3.55 | L | 8 |
| LYM1202 | 81109.3 | 28.4 | 0.15 | 7 | 3.55 | 0.15 | 7 | 3.38 | 0.15 | 2 |
| LYM1109 | 80123.1 | 33.7 | L | 27 | 4.21 | L | 27 | 3.80 | 0.09 | 15 |
| LYM1108 | 80120.1 | — | — | — | — | — | — | 3.38 | 0.28 | 2 |
| LYM1108 | 80120.3 | 28.9 | 0.27 | 9 | 3.62 | 0.27 | 9 | 3.54 | 0.25 | 7 |

TABLE 114-continued

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM1063 | 81347.1 | 30.2 | 0.23 | 14 | 3.77 | 0.23 | 14 | — | — | — |
| LYM1021 | 81204.4 | 28.6 | 0.10 | 8 | 3.58 | 0.10 | 8 | 3.47 | L | 5 |
| LYM1016 | 80948.2 | 29.2 | 0.05 | 10 | 3.65 | 0.05 | 10 | 3.44 | 0.03 | 4 |
| LYM1016 | 80950.3 | 28.3 | 0.15 | 7 | 3.54 | 0.15 | 7 | 3.43 | 0.10 | 4 |
| LYM1010 | 81062.1 | 30.5 | 0.02 | 15 | 3.82 | 0.02 | 15 | 3.43 | 0.04 | 4 |
| CONT. | — | 26.5 | — | — | 3.31 | — | — | 3.30 | — | — |

"CONT."—Control; "Ave."—Average; "% Incr." = % increment; "p-val."—p-value, L-p < 0.01.

TABLE 115

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM1239 | 82025.4 | 0.627 | 0.21 | 27 | — | — | — | — | — | — |
| LYM1239 | 82026.4 | — | — | — | 6.74 | 0.17 | 24 | 0.391 | 0.28 | 11 |
| LYM1153 | 83267.2 | — | — | — | 6.69 | 0.20 | 23 | — | — | — |
| LYM1153 | 83267.4 | — | — | — | 6.63 | 0.21 | 22 | — | — | — |
| LYM1153 | 83267.5 | 0.619 | 0.21 | 25 | — | — | — | — | — | — |
| LYM1153 | 83269.5 | — | — | — | 6.93 | 0.12 | 27 | — | — | — |
| LYM1127 | 81669.4 | — | — | — | 6.51 | 0.27 | 19 | — | — | — |
| CONT. | — | 0.495 | — | — | 5.46 | — | — | 0.353 | — | — |
| LYM1229 | 81574.1 | — | — | — | 7.55 | 0.20 | 26 | — | — | — |
| LYM1229 | 81575.3 | — | — | — | 7.90 | 0.12 | 32 | — | — | — |
| LYM1229 | 81576.5 | — | — | — | 7.41 | 0.23 | 24 | — | — | — |
| LYM1195 | 81918.1 | — | — | — | 7.81 | 0.14 | 31 | — | — | — |
| LYM1129 | 81504.2 | — | — | — | 7.48 | 0.22 | 25 | — | — | — |
| LYM1124 | 82009.3 | — | — | — | 7.72 | 0.16 | 29 | 0.417 | 0.25 | 18 |
| LYM1124 | 82010.2 | — | — | — | 7.34 | 0.26 | 23 | — | — | — |
| LYM1022 | 82057.4 | — | — | — | 7.43 | 0.23 | 24 | — | — | — |
| LYM1022 | 82061.3 | — | — | — | 7.36 | 0.26 | 23 | — | — | — |
| CONT. | — | — | — | — | 5.98 | — | — | 0.353 | — | — |
| LYM1151 | 80394.9 | 0.650 | 0.07 | 22 | — | — | — | — | — | — |
| LYM1141 | 80271.5 | — | — | — | 5.99 | 0.12 | 21 | — | — | — |
| LYM1139 | 80171.3 | — | — | — | 6.39 | 0.03 | 30 | 0.394 | 0.03 | 16 |
| LYM1069 | 81087.1 | — | — | — | 5.73 | 0.21 | 16 | 0.375 | 0.16 | 10 |
| LYM1011 | 80942.2 | — | — | — | 5.84 | 0.16 | 18 | 0.371 | 0.22 | 9 |
| CONT. | — | 0.535 | — | — | 4.93 | — | — | 0.340 | — | — |
| LYM1236 | 80506.5 | — | — | — | 9.65 | 0.27 | 21 | — | — | — |
| LYM1203 | 81750.1 | — | — | — | 9.64 | 0.27 | 21 | — | — | — |
| LYM1203 | 81751.5 | — | — | — | 10.0 | 0.18 | 26 | — | — | — |
| LYM1196 | 80558.4 | — | — | — | 10.2 | 0.14 | 29 | — | — | — |
| LYM1127 | 81670.2 | 0.767 | 0.25 | 20 | — | — | — | — | — | — |
| LYM1060 | 80965.3 | 0.752 | 0.30 | 18 | — | — | — | — | — | — |
| LYM1060 | 80965.4 | — | — | — | 10.3 | 0.14 | 29 | — | — | — |
| CONT. | — | 0.638 | — | — | 7.96 | — | — | — | — | — |
| LYM1218 | 81116.6 | — | — | — | 4.77 | 0.27 | 14 | — | — | — |
| LYM1216 | 80260.2 | — | — | — | 4.83 | 0.27 | 16 | — | — | — |
| LYM1209 | 80480.1 | 0.678 | 0.30 | 17 | — | — | — | — | — | — |
| LYM1207 | 80247.4 | — | — | — | — | — | — | 0.348 | 0.27 | 9 |
| LYM1207 | 80249.2 | — | — | — | 5.53 | 0.02 | 32 | 0.372 | 0.06 | 16 |
| LYM1201 | 81104.1 | — | — | — | 5.00 | 0.14 | 20 | — | — | — |
| LYM1191 | 80381.4 | — | — | — | 4.93 | 0.17 | 18 | — | — | — |
| LYM1189 | 81099.1 | — | — | — | 5.08 | 0.10 | 22 | — | — | — |
| LYM1170 | 80188.3 | — | — | — | — | — | — | 0.346 | 0.28 | 8 |
| LYM1169 | 80610.3 | 0.701 | 0.20 | 21 | — | — | — | — | — | — |
| LYM1161 | 80179.1 | — | — | — | 6.00 | L | 44 | 0.362 | 0.09 | 13 |
| LYM1054 | 80110.4 | — | — | — | 5.41 | 0.03 | 30 | 0.362 | 0.10 | 13 |
| CONT. | — | 0.579 | — | — | 4.17 | — | — | 0.320 | — | — |
| LYM1220 | 80484.2 | — | — | — | 5.77 | 0.19 | 16 | 0.390 | 0.09 | 12 |
| LYM1220 | 80484.3 | — | — | — | 6.05 | 0.07 | 22 | 0.384 | 0.15 | 10 |
| LYM1220 | 80484.5 | — | — | — | 6.39 | 0.03 | 29 | 0.404 | 0.03 | 16 |
| LYM1220 | 80486.1 | — | — | — | 6.84 | L | 38 | 0.388 | 0.23 | 12 |

TABLE 115-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM1111 | 81369.4 | 0.630 | 0.24 | 17 | — | — | — | — | — | — |
| LYM1111 | 81373.6 | — | — | — | 6.14 | 0.06 | 23 | 0.401 | 0.05 | 15 |
| LYM1108 | 80120.3 | — | — | — | — | — | — | 0.385 | 0.14 | 11 |
| LYM1102 | 80993.4 | 0.636 | 0.27 | 18 | — | — | — | — | — | — |
| LYM1053 | 80771.4 | 0.642 | 0.21 | 19 | — | — | — | — | — | — |
| LYM1053 | 80774.3 | — | — | — | — | — | — | 0.378 | 0.24 | 9 |
| LYM1051 | 80331.1 | — | — | — | — | — | — | 0.375 | 0.28 | 8 |
| LYM1021 | 81207.3 | 0.638 | 0.25 | 19 | — | — | — | — | — | — |
| LYM1017 | 81072.2 | — | — | — | 6.50 | 0.01 | 31 | 0.398 | 0.04 | 14 |
| LYM1017 | 81072.3 | — | — | — | 6.17 | 0.05 | 24 | 0.410 | 0.01 | 18 |
| LYM1017 | 81076.2 | — | — | — | 5.70 | 0.24 | 15 | 0.382 | 0.17 | 10 |
| LYM1016 | 80948.2 | — | — | — | 5.75 | 0.19 | 16 | — | — | — |
| LYM1016 | 80950.3 | — | — | — | 5.68 | 0.23 | 14 | 0.376 | 0.25 | 8 |
| LYM1015 | 80089.4 | — | — | — | 5.77 | 0.19 | 16 | 0.380 | 0.24 | 9 |
| LYM1015 | 80089.5 | — | — | — | 5.85 | 0.15 | 18 | 0.397 | 0.05 | 14 |
| CONT. | — | 0.537 | — | — | 4.97 | — | — | 0.348 | — | — |
| LYM1187 | 82688.9 | — | — | — | 6.26 | 0.28 | 24 | 0.397 | 0.07 | 28 |
| LYM1184 | 82873.5 | — | — | — | 6.29 | 0.26 | 24 | 0.388 | 0.09 | 25 |
| LYM1154 | 82551.2 | — | — | — | 7.32 | 0.05 | 45 | 0.400 | 0.05 | 29 |
| LYM1154 | 82553.9 | 0.625 | 0.27 | 23 | 7.91 | 0.02 | 57 | 0.412 | 0.03 | 33 |
| LYM1123 | 82866.2 | — | — | — | 6.75 | 0.14 | 34 | — | — | — |
| LYM1121 | 82541.3 | — | — | — | 6.94 | 0.09 | 37 | 0.394 | 0.08 | 27 |
| LYM1118 | 82534.7 | — | — | — | 6.94 | 0.10 | 37 | 0.379 | 0.15 | 22 |
| LYM1114 | 82487.11 | — | — | — | — | — | — | 0.383 | 0.12 | 23 |
| LYM1106 | 82625.4 | — | — | — | — | — | — | 0.380 | 0.12 | 22 |
| LYM1105_H2 | 82620.2 | — | — | — | 6.79 | 0.12 | 34 | 0.395 | 0.07 | 27 |
| LYM1101_H3 | 82615.10 | — | — | — | — | — | — | 0.376 | 0.17 | 21 |
| LYM1101_H3 | 82615.6 | — | — | — | — | — | — | 0.371 | 0.19 | 19 |
| LYM1086 | 82371.6 | — | — | — | — | — | — | 0.372 | 0.19 | 20 |
| LYM1086 | 82371.8 | — | — | — | 6.49 | 0.19 | 28 | 0.384 | 0.10 | 24 |
| LYM1086 | 82373.3 | — | — | — | 6.27 | 0.26 | 24 | — | — | — |
| LYM1078 | 82657.5 | — | — | — | 7.09 | 0.07 | 40 | 0.375 | 0.15 | 21 |
| LYM1078 | 82657.9 | 0.634 | 0.27 | 25 | — | — | — | — | — | — |
| LYM1074 | 82571.4 | — | — | — | — | — | — | 0.360 | 0.27 | 16 |
| LYM1074 | 82572.2 | — | — | — | 6.31 | 0.24 | 25 | 0.396 | 0.06 | 27 |
| LYM1058_H4 | 83372.5 | — | — | — | 6.32 | 0.28 | 25 | — | — | — |
| LYM1058_H4 | 83372.6 | — | — | — | 6.50 | 0.18 | 29 | 0.367 | 0.21 | 18 |
| LYM1037 | 82524.3 | — | — | — | — | — | — | 0.363 | 0.26 | 17 |
| LYM1033 | 82883.4 | — | — | — | 6.92 | 0.10 | 37 | 0.393 | 0.07 | 27 |
| LYM1033 | 82885.5 | — | — | — | — | — | — | 0.363 | 0.26 | 17 |
| LYM1023 | 82516.1 | — | — | — | 7.11 | 0.07 | 41 | 0.388 | 0.09 | 25 |
| CONT. | — | 0.507 | — | — | 5.05 | — | — | 0.311 | — | — |
| LYM1235 | 81121.1 | — | — | — | 3.79 | 0.20 | 17 | — | — | — |
| LYM1233 | 80500.2 | — | — | — | 3.82 | 0.19 | 18 | 0.314 | 0.05 | 11 |
| LYM1233 | 80501.2 | — | — | — | — | — | — | 0.308 | 0.12 | 9 |
| LYM1233 | 80503.4 | — | — | — | 4.34 | 0.02 | 34 | 0.326 | 0.02 | 15 |
| LYM1231 | 80494.2 | — | — | — | 3.94 | 0.10 | 22 | 0.309 | 0.08 | 9 |
| LYM1231 | 80496.2 | — | — | — | 4.12 | 0.04 | 27 | 0.312 | 0.10 | 10 |
| LYM1231 | 80496.6 | — | — | — | 3.81 | 0.19 | 17 | 0.303 | 0.22 | 7 |
| LYM1230 | 80493.5 | — | — | — | — | — | — | 0.300 | 0.30 | 6 |
| LYM1223 | 81211.4 | — | — | — | — | — | — | 0.301 | 0.27 | 6 |
| LYM1220 | 80484.3 | — | — | — | 3.69 | 0.29 | 14 | — | — | — |
| LYM1220 | 80484.5 | — | — | — | 3.80 | 0.19 | 17 | 0.313 | 0.05 | 11 |
| LYM1220 | 80486.1 | — | — | — | 4.82 | L | 49 | 0.326 | 0.04 | 15 |
| LYM1202 | 81107.2 | — | — | — | 3.72 | 0.26 | 15 | — | — | — |
| LYM1202 | 81108.1 | — | — | — | 4.07 | 0.06 | 26 | 0.317 | 0.04 | 12 |
| LYM1202 | 81109.2 | — | — | — | 3.70 | 0.29 | 14 | 0.313 | 0.07 | 10 |
| LYM1109 | 80123.1 | — | — | — | 4.11 | 0.05 | 27 | 0.322 | 0.02 | 14 |
| LYM1109 | 80125.7 | — | — | — | — | — | — | 0.301 | 0.28 | 6 |
| LYM1108 | 80120.3 | — | — | — | — | — | — | 0.302 | 0.23 | 7 |
| LYM1063 | 81347.1 | — | — | — | 3.71 | 0.28 | 14 | — | — | — |
| LYM1021 | 81204.4 | — | — | — | — | — | — | 0.309 | 0.10 | 9 |
| LYM1016 | 80950.3 | — | — | — | — | — | — | 0.299 | 0.30 | 5 |

TABLE 115-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM1010 | 81062.1 | — | — | — | 3.79 | 0.20 | 17 | — | — | — |
| LYM1010 | 81063.4 | — | — | — | 4.05 | 0.09 | 25 | 0.316 | 0.08 | 11 |
| CONT. | — | — | — | — | 3.24 | — | — | 0.284 | — | — |

"CONT."-Control;
"Ave."-Average
"% Incr." = % increment;
"p-val."-p-value,
L-p < 0.01.

Example 21

Evaluating Transgenic *Arabidopsis* Under Normal Conditions Using Seedling Analysis [TC-T2 and TC-T1 Assays]

Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing ½ MS media (15 mM N). For experiments performed in $T_2$ lines, each plate contained 5 seedlings of the same transgenic event, and 3-4 different plates (replicates) for each event. For each polynucleotide of the invention at least four-five independent transformation events were analyzed from each construct. For experiments performed in $T_1$ lines, each plate contained 5 seedlings of 5 independent transgenic events and 3-4 different plates (replicates) were planted. In total, for $T_1$ lines, 20 independent events were evaluated. Plants expressing the polynucleotides of the invention were compared to the average measurement of the control plants (empty vector or GUS reporter gene under the same promoter) used in the same experiment.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) and located in a darkroom, was used for capturing images of plantlets sawn in agar plates.

The image capturing process was repeated every 3-4 days starting at day 1 till day 10 (see for example the images in FIGS. 3A-F). An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at rsbweb(dot)nih(dot)gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling analysis—Using the digital analysis seedling data was calculated, including leaf area, root coverage and root length.

The relative growth rate for the various seedling parameters was calculated according to the following formulas XIII (RGR leaf area), XXVIII (RGR root coverage) and VI (RGR root length) as described above.

At the end of the experiment, plantlets were removed from the media and weighed for the determination of plant fresh weight. Plantlets were then dried for 24 hours at 60° C., and weighed again to measure plant dry weight for later statistical analysis. The fresh and dry weights were provided for each *Arabidopsis* plant. Growth rate was determined by comparing the leaf area coverage, root coverage and root length, between each couple of sequential photographs, and results were used to resolve the effect of the gene introduced on plant vigor under optimal conditions. Similarly, the effect of the gene introduced on biomass accumulation, under optimal conditions, was determined by comparing the plants' fresh and dry weight to that of control plants (containing an empty vector or the GUS reporter gene under the same promoter). From every construct created, 3-5 independent transformation events were examined in replicates.

Statistical analyses—To identify genes conferring significantly improved plant vigor or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value was calculated. Results were considered significant if p<0.1. The JMP statistics software package is used (Version 5.2.1, SAS Institute Inc., Cary, N.C., USA).

Experimental Results:

Tables 116-118 summarize the observed phenotypes of transgenic plants expressing the gene constructs using the TC -T2 Assays.

The genes presented in Table 116 showed a significant improvement as they produced larger plant biomass (plant fresh and dry weight) in T2 generation when grown under normal growth conditions, compared to control plants. The genes were cloned under the regulation of a constitutive promoter (At6669, SEQ ID NO: 8190). The evaluation of each gene was carried out by testing the performance of different number of events. Some of the genes were evaluated in more than one tissue culture assay. The results obtained in these second experiments were significantly positive as well.

TABLE 116

Genes showing improved plant performance at Normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LYM1185 | 81024.4 | — | — | — | 136.8 | 0.28 | 19 |
| LYM1155 | 82890.4 | — | — | — | 136.5 | 0.24 | 19 |
| CONT. | — | — | — | — | 114.7 | — | — |
| LYM1237 | 83878.2 | 4.65 | 0.06 | 70 | 100.3 | 0.09 | 46 |
| LYM1237 | 83880.3 | 3.55 | 0.16 | 30 | 78.4 | 0.08 | 14 |
| LYM1237 | 83880.5 | — | — | — | 78.2 | 0.16 | 14 |
| LYM1237 | 83882.1 | 5.95 | L | 117 | 114.1 | 0.03 | 66 |
| LYM1237 | 83882.2 | 5.30 | 0.01 | 94 | 107.7 | 0.01 | 57 |
| LYM1230 | 80489.3 | 4.35 | 0.14 | 59 | 92.5 | 0.16 | 35 |
| LYM1230 | 80490.1 | 4.95 | L | 81 | 108.6 | 0.05 | 58 |
| LYM1230 | 80490.2 | 5.15 | L | 88 | 98.4 | L | 43 |
| LYM1230 | 80493.5 | 3.58 | 0.07 | 31 | 81.1 | 0.03 | 18 |
| LYM1230 | 80493.7 | 3.58 | 0.11 | 31 | 77.0 | 0.23 | 12 |
| LYM1225 | 82566.1 | 4.33 | 0.15 | 58 | 98.2 | 0.02 | 43 |
| LYM1225 | 82566.2 | 3.75 | 0.24 | 37 | 86.7 | 0.05 | 26 |
| LYM1225 | 82566.6 | 4.57 | 0.02 | 67 | 102.2 | 0.04 | 49 |
| LYM1225 | 82566.8 | 3.73 | 0.06 | 36 | — | — | — |
| LYM1186 | 83933.1 | 5.23 | L | 91 | 121.6 | 0.05 | 77 |
| LYM1186 | 83933.2 | 3.65 | 0.11 | 33 | 83.1 | 0.19 | 21 |
| LYM1186 | 83933.3 | 5.85 | L | 114 | 109.2 | L | 59 |
| LYM1186 | 83933.4 | 4.53 | 0.02 | 65 | 87.7 | 0.15 | 28 |
| LYM1186 | 83937.1 | 5.25 | 0.03 | 92 | 97.5 | 0.10 | 42 |
| LYM1185 | 81023.4 | 4.75 | 0.09 | 74 | 91.6 | 0.09 | 33 |
| LYM1185 | 81024.3 | 5.20 | L | 90 | 94.4 | L | 37 |
| LYM1185 | 81025.2 | 3.75 | 0.06 | 37 | 86.8 | 0.16 | 26 |
| LYM1185 | 81025.3 | 3.92 | 0.04 | 43 | 78.9 | 0.07 | 15 |
| LYM1172 | 82555.3 | 5.25 | L | 92 | 94.6 | 0.06 | 38 |
| LYM1172 | 82555.5 | 4.28 | 0.18 | 56 | 93.7 | 0.19 | 37 |
| LYM1172 | 82555.6 | 4.28 | 0.06 | 56 | 95.0 | 0.03 | 39 |
| LYM1172 | 82558.10 | 5.22 | 0.02 | 91 | 94.2 | 0.05 | 37 |
| LYM1172 | 82558.3 | 4.38 | 0.06 | 60 | 91.2 | 0.02 | 33 |
| LYM1091_H5 | 83925.6 | 5.12 | L | 87 | 101.0 | L | 47 |
| LYM1091_H5 | 83927.3 | 3.70 | 0.13 | 35 | 75.0 | 0.28 | 9 |
| LYM1091_H5 | 83927.4 | 4.60 | L | 68 | 105.5 | L | 54 |
| LYM1091_H5 | 83927.5 | 4.53 | 0.04 | 65 | 114.6 | 0.05 | 67 |
| LYM1091_H5 | 83927.6 | 4.45 | 0.07 | 63 | 99.3 | 0.02 | 45 |
| LYM1024 | 82475.4 | 4.17 | 0.04 | 53 | 93.2 | 0.11 | 36 |
| LYM1024 | 82477.2 | — | — | — | 76.4 | 0.19 | 11 |
| LYM1024 | 82479.3 | 4.50 | 0.03 | 64 | 88.1 | 0.08 | 28 |
| CONT. | — | 2.74 | — | — | 68.6 | — | — |
| LYM1186 | 83933.1 | 2.77 | 0.25 | 12 | 53.4 | 0.18 | 15 |
| LYM1186 | 83933.2 | 4.55 | L | 84 | 79.1 | 0.02 | 70 |
| LYM1186 | 83933.3 | 3.67 | 0.02 | 48 | 80.2 | 0.02 | 72 |
| LYM1186 | 83933.4 | 3.17 | 0.02 | 28 | 56.3 | 0.08 | 21 |
| LYM1186 | 83937.1 | 4.60 | 0.02 | 86 | 100.2 | 0.03 | 115 |
| LYM1076_H4 | 83975.2 | 3.28 | L | 32 | 58.3 | 0.18 | 25 |
| LYM1076_H4 | 83976.1 | 3.25 | 0.07 | 31 | 72.9 | L | 57 |
| LYM1076_H4 | 83976.3 | 2.73 | 0.09 | 10 | 59.4 | 0.03 | 28 |
| LYM1076_H4 | 83977.3 | 3.73 | 0.04 | 51 | 74.3 | 0.05 | 60 |
| LYM1076_H4 | 83977.5 | 4.85 | 0.14 | 96 | 95.1 | 0.12 | 104 |
| CONT. | — | 2.48 | — | — | 46.5 | — | — |
| LYM1161 | 80178.3 | — | — | — | 78.3 | 0.20 | 14 |
| LYM1161 | 80178.4 | 4.98 | 0.29 | 32 | 101.8 | 0.09 | 48 |
| LYM1161 | 80179.1 | 5.83 | 0.25 | 55 | 115.6 | 0.14 | 68 |
| LYM1157 | 82231.2 | — | — | — | 74.5 | 0.27 | 9 |
| LYM1157 | 82231.4 | 6.95 | L | 85 | 132.0 | L | 92 |
| LYM1157 | 82232.2 | 5.62 | 0.04 | 50 | 109.3 | 0.05 | 59 |
| LYM1132 | 82013.1 | — | — | — | 89.8 | 0.02 | 31 |
| LYM1132 | 82013.4 | — | — | — | 81.5 | 0.13 | 19 |
| LYM1132 | 82017.6 | 4.68 | 0.22 | 24 | 89.0 | 0.04 | 30 |
| LYM1124 | 82008.4 | — | — | — | 95.7 | 0.07 | 39 |
| LYM1115 | 80133.1 | 4.20 | 0.25 | 12 | 80.8 | 0.13 | 18 |
| LYM1115 | 80134.2 | 4.33 | 0.14 | 15 | 89.4 | L | 30 |
| LYM1115 | 80135.2 | 6.58 | 0.20 | 75 | 129.1 | 0.13 | 88 |
| LYM1085 | 82683.2 | 6.98 | 0.24 | 85 | 134.6 | 0.21 | 96 |
| LYM1085 | 82683.3 | 4.70 | 0.20 | 25 | 91.7 | 0.13 | 34 |
| LYM1085 | 82685.1 | 4.70 | 0.10 | 25 | 89.9 | L | 31 |
| LYM1085 | 82685.12 | 4.55 | 0.28 | 21 | 95.0 | L | 38 |
| LYM1082 | 82481.2 | — | — | — | 80.4 | 0.24 | 17 |
| LYM1082 | 82481.4 | — | — | — | 80.4 | 0.22 | 17 |
| LYM1082 | 82482.5 | — | — | — | 76.0 | 0.17 | 11 |
| LYM1073 | 80978.3 | 5.38 | L | 43 | 93.3 | 0.05 | 36 |
| LYM1073 | 80978.4 | 5.03 | 0.03 | 34 | 101.6 | 0.02 | 48 |

TABLE 116-continued

Genes showing improved plant performance at Normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LYM1073 | 80980.3 | — | — | — | 91.2 | 0.15 | 33 |
| LYM1073 | 80981.1 | 4.55 | 0.22 | 21 | 90.0 | 0.17 | 31 |
| LYM1054 | 80106.2 | — | — | — | 76.1 | 0.21 | 11 |
| LYM1054 | 80108.2 | 5.60 | 0.01 | 49 | — | — | — |
| LYM1054 | 80110.4 | 5.65 | 0.20 | 50 | 120.4 | 0.09 | 75 |
| LYM1044 | 82612.2 | 5.70 | 0.07 | 51 | 115.7 | 0.16 | 69 |
| LYM1044 | 82613.2 | — | — | — | 82.1 | 0.07 | 20 |
| LYM1044 | 82613.4 | 4.80 | 0.06 | 28 | 88.4 | 0.03 | 29 |
| LYM1044 | 82614.1 | — | — | — | 79.3 | 0.25 | 15 |
| LYM1042 | 82000.2 | — | — | — | 88.5 | 0.10 | 29 |
| LYM1042 | 82001.2 | — | — | — | 85.5 | 0.10 | 25 |
| LYM1029 | 81349.4 | — | — | — | 86.2 | 0.04 | 26 |
| LYM1029 | 81351.4 | 4.90 | 0.13 | 30 | 98.2 | 0.03 | 43 |
| LYM1029 | 81353.1 | — | — | — | 84.4 | 0.04 | 23 |
| LYM1029 | 81353.3 | — | — | — | 97.9 | 0.10 | 43 |
| CONT. | — | 3.76 | — | — | 68.6 | — | — |
| LYM1229 | 81574.1 | 5.30 | L | 75 | 107.4 | L | 95 |
| LYM1229 | 81574.2 | 4.00 | 0.18 | 32 | 80.3 | 0.07 | 46 |
| LYM1229 | 81575.1 | 4.47 | 0.01 | 48 | 116.8 | 0.23 | 112 |
| LYM1229 | 81575.3 | 5.50 | L | 82 | 112.5 | L | 104 |
| LYM1229 | 81576.5 | — | — | — | 79.4 | 0.23 | 44 |
| LYM1227 | 81179.1 | 4.28 | 0.02 | 41 | 76.6 | L | 39 |
| LYM1227 | 81179.2 | 4.40 | 0.18 | 45 | 106.6 | 0.02 | 94 |
| LYM1227 | 81179.7 | 4.68 | 0.13 | 55 | 97.9 | 0.09 | 78 |
| LYM1227 | 81180.2 | 5.95 | L | 97 | 155.0 | 0.02 | 181 |
| LYM1219 | 80509.2 | 5.77 | L | 91 | 100.3 | 0.04 | 82 |
| LYM1219 | 80510.3 | 4.12 | L | 36 | 80.7 | L | 46 |
| LYM1219 | 80510.4 | 5.80 | 0.06 | 92 | 154.2 | 0.24 | 180 |
| LYM1219 | 80513.2 | 5.03 | 0.01 | 66 | 102.3 | L | 86 |
| LYM1218 | 81114.1 | 4.22 | L | 40 | 75.6 | 0.03 | 37 |
| LYM1218 | 81114.2 | 7.30 | L | 141 | 176.2 | L | 220 |
| LYM1218 | 81116.6 | 3.73 | 0.06 | 23 | — | — | — |
| LYM1218 | 81116.7 | 6.58 | 0.13 | 117 | 168.7 | 0.12 | 206 |
| LYM1218 | 81116.8 | 6.10 | L | 102 | 176.9 | 0.06 | 221 |
| LYM1216 | 80256.7 | 6.00 | L | 98 | 115.0 | L | 109 |
| LYM1216 | 80259.1 | 4.72 | 0.03 | 56 | 125.7 | 0.16 | 128 |
| LYM1216 | 80259.2 | 4.47 | L | 48 | 78.5 | 0.02 | 43 |
| LYM1216 | 80260.1 | 6.58 | L | 117 | 116.0 | L | 111 |
| LYM1212 | 80777.1 | 3.47 | 0.29 | 15 | 96.9 | 0.14 | 76 |
| LYM1212 | 80779.1 | 5.30 | L | 75 | 94.7 | L | 72 |
| LYM1210 | 80617.1 | — | — | — | 80.2 | 0.29 | 46 |
| LYM1210 | 80618.2 | 4.15 | 0.02 | 37 | 80.5 | 0.07 | 46 |
| LYM1210 | 80618.3 | 5.70 | 0.03 | 88 | 119.5 | 0.01 | 117 |
| LYM1210 | 80620.2 | 5.62 | 0.02 | 86 | 134.2 | L | 144 |
| LYM1210 | 80620.5 | 4.72 | 0.06 | 56 | 105.0 | L | 91 |
| LYM1209 | 80479.1 | 5.95 | L | 97 | 144.4 | 0.10 | 162 |
| LYM1209 | 80480.1 | 7.17 | L | 137 | 136.7 | L | 148 |
| LYM1209 | 80482.3 | 3.75 | 0.05 | 24 | 72.3 | 0.01 | 31 |
| LYM1209 | 80482.4 | 4.80 | 0.02 | 59 | 100.2 | 0.06 | 82 |
| LYM1209 | 80482.6 | 4.98 | 0.02 | 64 | 139.5 | 0.09 | 153 |
| LYM1201 | 81102.1 | 4.42 | 0.05 | 46 | 81.4 | 0.06 | 48 |
| LYM1201 | 81102.3 | 3.73 | 0.08 | 23 | — | — | — |
| LYM1201 | 81103.1 | 3.78 | 0.02 | 25 | 80.1 | L | 45 |
| LYM1201 | 81104.4 | 6.12 | 0.03 | 102 | 164.4 | 0.15 | 199 |
| LYM1201 | 81105.2 | 5.30 | 0.06 | 75 | 98.8 | 0.01 | 79 |
| LYM1195 | 81918.3 | 5.75 | 0.04 | 90 | 115.2 | 0.02 | 109 |
| LYM1195 | 81919.3 | 5.45 | 0.05 | 80 | 127.2 | 0.19 | 131 |
| LYM1195 | 81919.4 | 5.50 | L | 82 | 108.5 | 0.02 | 97 |
| LYM1195 | 81919.6 | 5.05 | 0.01 | 67 | 113.4 | 0.07 | 106 |
| LYM1189 | 81099.1 | 4.72 | 0.02 | 56 | 97.2 | L | 76 |
| LYM1189 | 81099.2 | 4.60 | 0.04 | 52 | 85.9 | L | 56 |
| LYM1189 | 81100.2 | 3.92 | 0.16 | 30 | 70.8 | 0.12 | 29 |
| LYM1189 | 81101.4 | — | — | — | 66.8 | 0.09 | 21 |
| LYM1182 | 81492.1 | 5.83 | 0.07 | 93 | 120.8 | 0.07 | 119 |
| LYM1182 | 81492.4 | 8.08 | L | 167 | 164.4 | L | 198 |
| LYM1182 | 81493.2 | 5.55 | L | 83 | 107.1 | L | 95 |
| LYM1182 | 81494.2 | 4.17 | 0.05 | 38 | 85.8 | 0.02 | 56 |
| LYM1182 | 81495.5 | 4.92 | 0.02 | 63 | 98.1 | 0.02 | 78 |
| LYM1176 | 80809.1 | 3.60 | 0.29 | 19 | 69.0 | 0.03 | 25 |
| LYM1176 | 80810.3 | 4.03 | 0.03 | 33 | 74.9 | 0.03 | 36 |
| LYM1176 | 80810.6 | 4.60 | 0.06 | 52 | 92.1 | 0.02 | 67 |
| LYM1176 | 80811.3 | 5.93 | 0.05 | 96 | 181.3 | 0.27 | 229 |
| LYM1176 | 80811.4 | — | — | — | 72.5 | 0.15 | 32 |

TABLE 116-continued

Genes showing improved plant performance at Normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LYM1173 | 80464.1 | 9.03 | L | 198 | 165.0 | L | 200 |
| LYM1173 | 80464.4 | 7.50 | L | 148 | 147.4 | L | 168 |
| LYM1173 | 80464.5 | 4.25 | 0.13 | 40 | 119.7 | 0.02 | 117 |
| LYM1173 | 80466.2 | — | — | — | 98.8 | 0.07 | 79 |
| LYM1170 | 80187.1 | 4.77 | 0.06 | 58 | 84.4 | 0.10 | 53 |
| LYM1170 | 80187.5 | 3.88 | 0.09 | 28 | 78.0 | 0.11 | 42 |
| LYM1170 | 80189.1 | 4.22 | 0.08 | 40 | 117.7 | 0.11 | 114 |
| LYM1170 | 80189.3 | 5.38 | 0.09 | 78 | 107.1 | L | 95 |
| LYM1170 | 80189.4 | 4.95 | L | 64 | 125.7 | 0.06 | 128 |
| LYM1169 | 80606.4 | 6.33 | 0.02 | 109 | 110.4 | L | 100 |
| LYM1169 | 80607.2 | — | — | — | 72.0 | 0.13 | 31 |
| LYM1169 | 80607.3 | 5.22 | L | 73 | 107.1 | L | 95 |
| LYM1146 | 81487.4 | 7.00 | L | 131 | 164.9 | 0.03 | 199 |
| LYM1146 | 81487.5 | 5.00 | 0.01 | 65 | 131.9 | 0.07 | 139 |
| LYM1146 | 81488.2 | 7.60 | L | 151 | 149.0 | L | 171 |
| LYM1146 | 81491.4 | 5.42 | L | 79 | 139.2 | 0.03 | 153 |
| LYM1146 | 81491.5 | 7.55 | 0.01 | 150 | 148.4 | 0.03 | 169 |
| CONT. | — | 3.02 | — | — | 55.1 | — | — |
| LYM1208 | 83928.4 | 4.38 | L | 67 | 108.6 | 0.30 | 49 |
| LYM1208 | 83928.5 | 3.20 | 0.18 | 22 | — | — | — |
| LYM1208 | 83929.5 | 3.98 | 0.05 | 52 | 106.7 | 0.20 | 46 |
| LYM1208 | 83929.6 | 4.92 | L | 89 | 104.5 | 0.09 | 43 |
| LYM1205 | 83050.6 | 5.77 | L | 121 | 130.3 | L | 79 |
| LYM1205 | 83054.3 | 4.42 | L | 69 | — | — | — |
| LYM1174 | 83270.2 | 3.15 | 0.21 | 21 | — | — | — |
| LYM1174 | 83274.1 | 5.22 | 0.03 | 100 | 94.5 | 0.25 | 30 |
| LYM1174 | 83274.5 | 8.18 | L | 213 | 172.4 | 0.03 | 136 |
| LYM1160 | 81861.2 | 3.70 | 0.09 | 42 | 90.0 | 0.24 | 23 |
| LYM1160 | 81862.3 | 5.47 | L | 110 | 103.9 | 0.09 | 43 |
| LYM1153 | 83265.5 | 4.77 | 0.09 | 82 | 103.9 | 0.19 | 43 |
| LYM1153 | 83267.2 | 4.12 | L | 58 | 139.4 | 0.12 | 91 |
| LYM1153 | 83267.4 | 5.60 | L | 114 | 109.7 | 0.07 | 50 |
| LYM1153 | 83267.5 | 5.45 | 0.01 | 109 | 112.9 | 0.04 | 55 |
| LYM1125 | 83041.4 | 5.68 | 0.04 | 117 | 105.4 | 0.16 | 45 |
| LYM1125 | 83042.1 | 3.17 | 0.06 | 22 | — | — | — |
| LYM1125 | 83042.5 | 5.35 | 0.20 | 105 | 115.3 | 0.20 | 58 |
| LYM1122 | 81983.5 | 3.55 | 0.06 | 36 | — | — | — |
| LYM1122 | 81983.6 | 5.92 | 0.02 | 127 | 129.3 | 0.04 | 77 |
| LYM1122 | 81985.2 | 3.55 | 0.13 | 36 | 104.2 | 0.18 | 43 |
| LYM1122 | 81985.4 | 4.45 | 0.03 | 70 | 134.6 | 0.14 | 85 |
| LYM1122 | 81985.5 | 5.20 | L | 99 | 101.5 | 0.08 | 39 |
| LYM1090 | 83375.3 | 2.95 | 0.29 | 13 | — | — | — |
| LYM1090 | 83377.1 | 3.78 | 0.07 | 44 | — | — | — |
| LYM1090 | 83379.3 | 4.77 | 0.12 | 83 | 118.5 | 0.03 | 62 |
| LYM1090 | 83379.4 | 3.52 | 0.07 | 35 | — | — | — |
| LYM1090 | 83379.6 | 4.72 | L | 81 | — | — | — |
| LYM1088 | 83557.1 | 7.58 | L | 190 | 170.4 | L | 134 |
| LYM1088 | 83557.2 | 5.83 | 0.03 | 123 | 127.0 | 0.10 | 74 |
| LYM1088 | 83558.1 | 3.85 | 0.23 | 47 | — | — | — |
| LYM1088 | 83558.4 | 6.05 | L | 132 | 141.5 | L | 94 |
| LYM1088 | 83558.5 | 4.22 | 0.04 | 62 | — | — | — |
| LYM1046 | 81907.2 | 3.10 | 0.22 | 19 | 86.7 | 0.27 | 19 |
| LYM1046 | 81909.2 | 3.38 | 0.14 | 29 | — | — | — |
| LYM1046 | 81909.4 | 3.12 | 0.21 | 20 | — | — | — |
| LYM1046 | 81909.5 | 4.72 | L | 81 | 96.4 | 0.12 | 32 |
| LYM1035 | 83260.3 | 5.25 | 0.14 | 101 | — | — | — |
| LYM1035 | 83260.5 | 4.47 | 0.03 | 71 | 103.1 | 0.12 | 41 |
| LYM1035 | 83262.1 | 4.90 | L | 88 | 110.9 | 0.01 | 52 |
| LYM1035 | 83264.6 | 3.20 | 0.12 | 22 | — | — | — |
| LYM1030 | 83544.1 | 3.88 | 0.09 | 48 | — | — | — |
| LYM1030 | 83547.2 | 3.85 | 0.05 | 47 | 98.5 | 0.29 | 35 |
| CONT. | — | 2.61 | — | — | 72.9 | — | — |
| LYM1118 | 82534.6 | 4.33 | 0.24 | 26 | 97.9 | 0.23 | 27 |
| LYM1114 | 82487.11 | 4.22 | 0.08 | 23 | 96.5 | 0.17 | 25 |
| LYM1114 | 82487.7 | 4.93 | 0.03 | 44 | 156.4 | 0.06 | 102 |
| LYM1113 | 81872.4 | 5.30 | L | 55 | 125.4 | L | 62 |
| LYM1106 | 82627.2 | 5.77 | 0.02 | 68 | 109.7 | 0.21 | 42 |
| LYM1106 | 82627.6 | 4.15 | 0.28 | 21 | — | — | — |
| LYM1078 | 82657.6 | 4.77 | 0.17 | 39 | 131.0 | L | 70 |
| LYM1078 | 82657.9 | 5.57 | L | 63 | 125.2 | L | 62 |
| LYM1078 | 82659.2 | 6.10 | L | 78 | 118.6 | 0.04 | 53 |
| LYM1078 | 82659.5 | 5.00 | 0.13 | 46 | 101.6 | 0.07 | 32 |
| LYM1075 | 83047.2 | 4.98 | 0.03 | 45 | 117.4 | 0.03 | 52 |

TABLE 116-continued

Genes showing improved plant performance at Normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LYM1075 | 83047.8 | 4.37 | 0.19 | 27 | — | — | — |
| LYM1075 | 83049.1 | 5.30 | 0.03 | 55 | 113.1 | 0.05 | 46 |
| LYM1075 | 83049.3 | 4.93 | 0.01 | 44 | 105.8 | 0.09 | 37 |
| LYM1074 | 82571.1 | 5.25 | 0.02 | 53 | 121.0 | 0.07 | 57 |
| LYM1074 | 82572.2 | 5.20 | L | 52 | 111.2 | 0.07 | 44 |
| LYM1066 | 82003.1 | 4.33 | 0.17 | 27 | — | — | — |
| LYM1033 | 82883.6 | 4.95 | 0.04 | 45 | 112.5 | 0.02 | 46 |
| LYM1033 | 82885.5 | 4.95 | 0.02 | 45 | 99.4 | 0.09 | 29 |
| LYM1027 | 82520.3 | 6.65 | L | 94 | 160.9 | 0.01 | 108 |
| LYM1027 | 82520.6 | 5.07 | 0.02 | 48 | 99.5 | 0.16 | 29 |
| LYM1027 | 82523.1 | 4.40 | 0.14 | 28 | — | — | — |
| LYM1027 | 82523.2 | 4.25 | 0.07 | 24 | 115.8 | 0.16 | 50 |
| LYM1024 | 82475.5 | — | — | — | 116.2 | 0.04 | 50 |
| LYM1024 | 82477.2 | 5.73 | 0.22 | 67 | — | — | — |
| LYM1023 | 82516.1 | 5.30 | L | 55 | 117.5 | 0.06 | 52 |
| LYM1023 | 82518.10 | 4.62 | 0.07 | 35 | — | — | — |
| CONT. | — | 3.43 | — | — | 77.3 | — | — |

"CONT."-Control;
"Ave."-Average
"% Incr." = % increment;
"p-val."-p-value,
L-p < 0.01.

The genes presented in Tables 117 and 118 show a significant improvement in plant performance since they produced a larger leaf biomass (leaf area) and root biomass (root length and root coverage) (Table 117) and a higher relative growth rate of leaf area, root coverage and root length (Table 118) when grown under normal growth conditions, compared to control plants. Plants producing larger root biomass have better possibilities to absorb larger amount of nitrogen from soil. Plants producing larger leaf biomass have better ability to produce assimilates. The genes were cloned under the regulation of a constitutive promoter (At6669). The evaluation of each gene was performed by testing the performance of different number of events. Some of the genes were evaluated in more than one tissue culture assay. This second experiment confirmed the significant increment in leaf and root performance. Event with p-value <0.1 was considered statistically significant.

TABLE 117

Genes showing improved plant performance at Normal growth conditions under regulation of At6669 promoter

| Gene Name | Event # | Leaf Area [cm$^2$] | | | Roots Coverage [cm$^2$] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM1228 | 82560.2 | 0.643 | 0.28 | 15 | — | — | — | 7.34 | 0.30 | 3 |
| LYM1226 | 82893.10 | — | — | — | — | — | — | 7.31 | 0.25 | 3 |
| LYM1226 | 82893.5 | — | — | — | — | — | — | 7.69 | 0.02 | 9 |
| LYM1225 | 82564.2 | — | — | — | — | — | — | 7.32 | 0.24 | 3 |
| LYM1225 | 82566.1 | — | — | — | 9.36 | 0.19 | 20 | — | — | — |
| LYM1225 | 82566.6 | — | — | — | — | — | — | 7.44 | 0.08 | 5 |
| LYM1207 | 80247.4 | — | — | — | — | — | — | 7.57 | 0.10 | 7 |
| LYM1203 | 81750.1 | — | — | — | — | — | — | 7.49 | 0.27 | 6 |
| LYM1185 | 81024.4 | — | — | — | 9.13 | 0.15 | 17 | 7.30 | 0.26 | 3 |
| LYM1178 | 82652.6 | — | — | — | — | — | — | 7.59 | 0.10 | 7 |
| LYM1172 | 82555.5 | — | — | — | — | — | — | 7.40 | 0.21 | 4 |
| LYM1172 | 82558.3 | 0.642 | 0.22 | 15 | 9.82 | 0.25 | 26 | 7.99 | L | 13 |
| LYM1155 | 82888.5 | 0.689 | 0.24 | 23 | — | — | — | — | — | — |
| LYM1155 | 82890.4 | 0.706 | 0.04 | 26 | 9.49 | 0.19 | 22 | — | — | — |
| LYM1155 | 82890.5 | — | — | — | — | — | — | 7.43 | 0.11 | 5 |
| LYM1128 | 82548.1 | — | — | — | 10.1 | 0.15 | 30 | 7.63 | 0.05 | 8 |
| LYM1070 | 82533.5 | — | — | — | — | — | — | 7.38 | 0.20 | 4 |
| LYM1070 | 82533.8 | — | — | — | — | — | — | 7.47 | 0.06 | 5 |
| LYM1059_H7 | 82876.9 | — | — | — | 9.86 | 0.29 | 26 | — | — | — |
| LYM1037 | 82524.1 | — | — | — | — | — | — | 7.58 | 0.02 | 7 |
| CONT. | — | 0.560 | — | — | 7.79 | — | — | 7.09 | — | — |
| LYM1237 | 83878.2 | 0.531 | 0.18 | 26 | — | — | — | — | — | — |
| LYM1237 | 83880.3 | 0.446 | 0.29 | 6 | — | — | — | — | — | — |
| LYM1237 | 83882.1 | 0.627 | L | 49 | 6.54 | 0.02 | 26 | — | — | — |
| LYM1237 | 83882.2 | 0.590 | 0.01 | 41 | 7.30 | L | 40 | 7.19 | 0.04 | 11 |

TABLE 117-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM1230 | 80490.1 | 0.509 | L | 21 | 6.55 | 0.04 | 26 | — | — | — |
| LYM1230 | 80490.2 | 0.586 | L | 40 | 5.92 | 0.11 | 14 | — | — | — |
| LYM1230 | 80493.5 | 0.456 | 0.04 | 9 | — | — | — | — | — | — |
| LYM1225 | 82566.1 | 0.571 | 0.04 | 36 | 6.62 | 0.05 | 27 | 7.07 | 0.09 | 9 |
| LYM1225 | 82566.2 | 0.545 | 0.03 | 30 | 6.49 | 0.11 | 25 | 7.12 | 0.15 | 10 |
| LYM1225 | 82566.6 | 0.492 | 0.10 | 17 | 6.42 | 0.05 | 23 | — | — | — |
| LYM1225 | 82566.8 | 0.462 | 0.24 | 10 | — | — | — | — | — | — |
| LYM1186 | 83933.1 | 0.638 | 0.02 | 52 | 7.46 | L | 43 | 7.10 | 0.16 | 10 |
| LYM1186 | 83933.3 | 0.605 | L | 44 | 6.75 | 0.06 | 30 | — | — | — |
| LYM1186 | 83933.4 | 0.491 | 0.10 | 17 | — | — | — | — | — | — |
| LYM1186 | 83937.1 | 0.555 | 0.02 | 32 | 6.37 | 0.07 | 23 | — | — | — |
| LYM1185 | 81023.4 | 0.488 | 0.25 | 16 | — | — | — | — | — | — |
| LYM1185 | 81024.3 | 0.540 | 0.03 | 29 | 6.50 | 0.08 | 25 | 7.14 | 0.10 | 10 |
| LYM1185 | 81025.3 | 0.467 | 0.04 | 11 | — | — | — | — | — | — |
| LYM1172 | 82555.3 | 0.523 | L | 25 | — | — | — | — | — | — |
| LYM1172 | 82555.5 | 0.507 | 0.16 | 21 | 7.15 | 0.05 | 37 | 7.35 | L | 13 |
| LYM1172 | 82555.6 | 0.521 | 0.04 | 24 | — | — | — | — | — | — |
| LYM1172 | 82558.10 | 0.505 | 0.07 | 20 | 6.19 | 0.24 | 19 | — | — | — |
| LYM1172 | 82558.3 | 0.510 | 0.01 | 22 | — | — | — | — | — | — |
| LYM1091_H5 | 83925.6 | 0.546 | L | 30 | 7.30 | L | 40 | 7.50 | 0.02 | 16 |
| LYM1091_H5 | 83927.4 | 0.570 | 0.03 | 36 | 7.56 | 0.01 | 45 | 7.42 | 0.01 | 14 |
| LYM1091_H5 | 83927.5 | 0.528 | 0.07 | 26 | 6.43 | 0.12 | 24 | 7.02 | 0.27 | 8 |
| LYM1091_H5 | 83927.6 | 0.508 | 0.17 | 21 | 6.31 | 0.18 | 21 | — | — | — |
| CONT. | — | 0.420 | — | — | 5.20 | — | — | 6.48 | — | — |
| LYM1186 | 83933.1 | 0.343 | L | 17 | 4.96 | 0.01 | 18 | 6.25 | 0.03 | 11 |
| LYM1186 | 83933.2 | 0.423 | L | 44 | 6.42 | L | 52 | 6.21 | 0.07 | 10 |
| LYM1186 | 83933.3 | 0.447 | L | 52 | 6.51 | L | 54 | 7.28 | L | 30 |
| LYM1186 | 83933.4 | 0.340 | L | 16 | 4.58 | 0.17 | 9 | — | — | — |
| LYM1186 | 83937.1 | 0.482 | 0.03 | 64 | 6.77 | L | 61 | 7.18 | L | 28 |
| LYM1076_H4 | 83975.2 | 0.355 | L | 21 | — | — | — | — | — | — |
| LYM1076_H4 | 83976.1 | 0.402 | 0.01 | 37 | 5.14 | 0.29 | 22 | 6.66 | 0.01 | 19 |
| LYM1076_H4 | 83976.3 | 0.349 | 0.03 | 19 | 5.43 | 0.07 | 29 | 6.63 | 0.03 | 18 |
| LYM1076_H4 | 83977.3 | 0.399 | 0.03 | 36 | — | — | — | — | — | — |
| LYM1076_H4 | 83977.5 | 0.520 | 0.08 | 77 | 5.89 | 0.15 | 40 | 6.51 | 0.14 | 16 |
| CONT. | — | 0.294 | — | — | 4.22 | — | — | 5.62 | — | — |
| LYM1161 | 80178.3 | — | — | — | 5.37 | 0.09 | 18 | 6.40 | 0.12 | 10 |
| LYM1161 | 80178.4 | 0.463 | 0.14 | 28 | — | — | — | — | — | — |
| LYM1161 | 80179.1 | 0.540 | 0.08 | 50 | 6.50 | 0.25 | 43 | — | — | — |
| LYM1161 | 80179.3 | — | — | — | — | — | — | 6.67 | 0.08 | 14 |
| LYM1157 | 82231.2 | 0.385 | 0.13 | 7 | 5.06 | 0.26 | 11 | 6.55 | 0.12 | 12 |
| LYM1157 | 82231.4 | 0.548 | 0.02 | 52 | 6.86 | 0.08 | 50 | — | — | — |
| LYM1157 | 82232.2 | 0.468 | 0.11 | 30 | — | — | — | — | — | — |
| LYM1132 | 82013.1 | 0.476 | L | 32 | — | — | — | 6.49 | 0.08 | 11 |
| LYM1132 | 82013.4 | 0.437 | L | 21 | — | — | — | 6.73 | 0.02 | 16 |
| LYM1132 | 82017.6 | 0.412 | 0.15 | 14 | — | — | — | — | — | — |
| LYM1124 | 82008.4 | 0.450 | 0.01 | 25 | 6.00 | 0.12 | 32 | 6.35 | 0.26 | 9 |
| LYM1115 | 80133.1 | 0.452 | L | 25 | — | — | — | 6.82 | 0.06 | 17 |
| LYM1115 | 80133.6 | 0.412 | 0.14 | 14 | — | — | — | — | — | — |
| LYM1115 | 80134.2 | 0.463 | 0.03 | 28 | 5.89 | 0.02 | 29 | 7.31 | L | 25 |
| LYM1115 | 80135.2 | 0.564 | 0.11 | 56 | 6.90 | 0.24 | 51 | 6.47 | 0.05 | 11 |
| LYM1085 | 82683.2 | 0.576 | 0.12 | 60 | — | — | — | — | — | — |
| LYM1085 | 82683.3 | 0.437 | 0.21 | 21 | 6.04 | 0.07 | 32 | 6.25 | 0.20 | 7 |
| LYM1085 | 82685.1 | 0.488 | 0.02 | 35 | 5.96 | 0.18 | 31 | 6.73 | 0.18 | 15 |
| LYM1085 | 82685.12 | 0.447 | 0.03 | 24 | 5.47 | 0.23 | 20 | 7.14 | L | 22 |
| LYM1082 | 82481.2 | 0.410 | 0.14 | 14 | — | — | — | — | — | — |
| LYM1082 | 82481.4 | — | — | — | 5.24 | 0.08 | 15 | — | — | — |
| LYM1082 | 82482.4 | — | — | — | 5.08 | 0.26 | 11 | 6.96 | 0.02 | 19 |
| LYM1082 | 82482.5 | 0.397 | 0.04 | 10 | — | — | — | — | — | — |
| LYM1073 | 80978.3 | 0.469 | 0.02 | 30 | — | — | — | — | — | — |
| LYM1073 | 80978.4 | 0.430 | L | 19 | — | — | — | — | — | — |
| LYM1073 | 80980.3 | 0.390 | 0.25 | 8 | — | — | — | — | — | — |
| LYM1073 | 80981.1 | 0.490 | 0.05 | 36 | — | — | — | — | — | — |
| LYM1054 | 80106.2 | 0.436 | L | 21 | — | — | — | 6.52 | 0.02 | 12 |
| LYM1054 | 80108.2 | 0.491 | L | 36 | — | — | — | — | — | — |
| LYM1054 | 80110.4 | 0.506 | 0.09 | 40 | — | — | — | — | — | — |
| LYM1044 | 82612.2 | 0.490 | 0.10 | 36 | — | — | — | — | — | — |
| LYM1044 | 82613.4 | 0.457 | L | 27 | 6.00 | 0.03 | 31 | 6.75 | 0.11 | 16 |
| LYM1044 | 82614.1 | 0.425 | 0.06 | 18 | — | — | — | — | — | — |
| LYM1042 | 81998.2 | 0.402 | 0.23 | 11 | — | — | — | 6.98 | L | 20 |
| LYM1042 | 82000.2 | 0.415 | 0.10 | 15 | — | — | — | — | — | — |
| LYM1042 | 82000.4 | 0.418 | L | 16 | — | — | — | 6.47 | 0.07 | 11 |

TABLE 117-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM1042 | 82001.2 | 0.429 | 0.18 | 19 | — | — | — | — | — | — |
| LYM1029 | 81349.4 | 0.417 | 0.09 | 16 | — | — | — | — | — | — |
| LYM1029 | 81351.4 | 0.422 | 0.15 | 17 | 6.79 | 0.03 | 49 | 6.99 | 0.03 | 20 |
| LYM1029 | 81353.1 | 0.424 | 0.08 | 18 | 5.26 | 0.23 | 15 | 6.50 | 0.22 | 12 |
| CONT. | — | 0.361 | — | — | 4.56 | — | — | 5.83 | — | — |
| LYM1229 | 81574.1 | 0.523 | L | 77 | 9.53 | 0.01 | 137 | 7.66 | L | 28 |
| LYM1229 | 81574.2 | 0.433 | 0.02 | 47 | 7.72 | 0.05 | 92 | 7.35 | 0.02 | 23 |
| LYM1229 | 81575.1 | 0.413 | L | 40 | 5.92 | 0.06 | 47 | — | — | — |
| LYM1229 | 81575.3 | 0.577 | L | 96 | 9.24 | L | 130 | 7.33 | L | 22 |
| LYM1229 | 81576.5 | 0.373 | L | 27 | 5.19 | 0.07 | 29 | — | — | — |
| LYM1227 | 81179.1 | 0.408 | L | 38 | 6.01 | 0.01 | 49 | 6.80 | 0.08 | 14 |
| LYM1227 | 81179.2 | 0.471 | L | 60 | 7.52 | L | 87 | 7.34 | L | 23 |
| LYM1227 | 81179.3 | 0.374 | L | 27 | 5.73 | 0.03 | 42 | 6.81 | 0.13 | 14 |
| LYM1227 | 81179.7 | 0.449 | 0.12 | 52 | 7.16 | 0.14 | 78 | — | — | — |
| LYM1227 | 81180.2 | 0.541 | L | 84 | 9.11 | L | 127 | 7.36 | 0.02 | 23 |
| LYM1219 | 80509.2 | 0.548 | L | 86 | 7.06 | 0.01 | 76 | 7.02 | 0.03 | 17 |
| LYM1219 | 80510.3 | 0.488 | L | 66 | 7.46 | L | 85 | 7.39 | 0.02 | 23 |
| LYM1219 | 80510.4 | 0.504 | 0.03 | 71 | 6.74 | 0.01 | 68 | — | — | — |
| LYM1219 | 80513.2 | 0.506 | 0.01 | 72 | 8.61 | 0.04 | 114 | 7.79 | L | 30 |
| LYM1218 | 81114.1 | 0.391 | L | 33 | 7.34 | 0.03 | 82 | 6.79 | 0.25 | 13 |
| LYM1218 | 81114.2 | 0.712 | L | 142 | 9.49 | 0.05 | 136 | 7.46 | 0.01 | 25 |
| LYM1218 | 81116.6 | 0.349 | 0.02 | 18 | 5.68 | 0.08 | 41 | 6.87 | 0.08 | 15 |
| LYM1218 | 81116.7 | 0.544 | 0.13 | 84 | 8.61 | 0.01 | 114 | 7.19 | 0.01 | 20 |
| LYM1218 | 81116.8 | 0.675 | L | 129 | 9.03 | L | 125 | 7.73 | L | 29 |
| LYM1216 | 80256.4 | 0.332 | 0.24 | 13 | — | — | — | — | — | — |
| LYM1216 | 80256.7 | 0.561 | L | 90 | 9.87 | 0.03 | 145 | 7.48 | 0.02 | 25 |
| LYM1216 | 80259.1 | 0.486 | L | 65 | 6.38 | L | 59 | 6.97 | 0.07 | 16 |
| LYM1216 | 80259.2 | 0.447 | L | 52 | 6.99 | L | 74 | 7.06 | 0.02 | 18 |
| LYM1216 | 80260.1 | 0.582 | L | 97 | 9.75 | L | 142 | 7.74 | L | 29 |
| LYM1212 | 80777.1 | 0.414 | L | 41 | 5.00 | 0.15 | 24 | — | — | — |
| LYM1212 | 80779.1 | 0.538 | L | 83 | — | — | — | — | — | — |
| LYM1210 | 80617.1 | 0.349 | L | 18 | 5.53 | 0.07 | 37 | — | — | — |
| LYM1210 | 80618.2 | 0.444 | L | 51 | 5.68 | 0.14 | 41 | — | — | — |
| LYM1210 | 80618.3 | 0.600 | L | 103 | 8.93 | L | 122 | 7.76 | L | 30 |
| LYM1210 | 80620.2 | 0.567 | L | 92 | 7.60 | 0.06 | 89 | 7.53 | L | 26 |
| LYM1210 | 80620.5 | 0.493 | 0.02 | 67 | 6.25 | 0.13 | 55 | — | — | — |
| LYM1209 | 80479.1 | 0.524 | L | 78 | 8.37 | L | 108 | 7.22 | 0.02 | 21 |
| LYM1209 | 80480.1 | 0.661 | L | 124 | 8.89 | 0.01 | 121 | 7.25 | 0.05 | 21 |
| LYM1209 | 80482.3 | 0.386 | L | 31 | 4.83 | 0.21 | 20 | — | — | — |
| LYM1209 | 80482.4 | 0.489 | L | 66 | 5.51 | 0.08 | 37 | — | — | — |
| LYM1209 | 80482.6 | 0.449 | L | 52 | 6.93 | L | 72 | 6.51 | 0.22 | 9 |
| LYM1201 | 81102.1 | 0.412 | L | 40 | 7.13 | L | 77 | 7.50 | L | 25 |
| LYM1201 | 81102.3 | 0.367 | 0.08 | 25 | 5.42 | 0.03 | 35 | 6.68 | 0.13 | 12 |
| LYM1201 | 81103.1 | 0.430 | L | 46 | 6.83 | L | 70 | 7.37 | L | 23 |
| LYM1201 | 81104.4 | 0.587 | 0.03 | 99 | 6.81 | 0.06 | 69 | — | — | — |
| LYM1201 | 81105.2 | 0.483 | 0.01 | 64 | 6.94 | 0.03 | 73 | 6.79 | 0.09 | 13 |
| LYM1195 | 81918.1 | 0.335 | 0.18 | 14 | — | — | — | — | — | — |
| LYM1195 | 81918.3 | 0.578 | L | 96 | 10.3 | 0.03 | 156 | 8.03 | L | 34 |
| LYM1195 | 81919.3 | 0.567 | L | 92 | 7.89 | 0.01 | 96 | 7.36 | 0.02 | 23 |
| LYM1195 | 81919.4 | 0.575 | L | 95 | 7.02 | L | 75 | 6.94 | 0.04 | 16 |
| LYM1195 | 81919.6 | 0.538 | 0.02 | 83 | 7.04 | 0.09 | 75 | 7.45 | 0.11 | 24 |
| LYM1189 | 81097.2 | — | — | — | 5.42 | 0.14 | 35 | 6.67 | 0.19 | 11 |
| LYM1189 | 81099.1 | 0.460 | L | 56 | 6.01 | 0.06 | 49 | — | — | — |
| LYM1189 | 81099.2 | 0.460 | L | 56 | 7.54 | L | 88 | 7.55 | L | 26 |
| LYM1189 | 81100.2 | 0.389 | L | 32 | 6.39 | 0.09 | 59 | 6.75 | 0.20 | 13 |
| LYM1189 | 81101.4 | 0.391 | 0.03 | 33 | 5.12 | 0.21 | 27 | 6.91 | 0.13 | 15 |
| LYM1182 | 81492.1 | 0.509 | 0.02 | 73 | 6.13 | 0.12 | 52 | 6.86 | 0.21 | 14 |
| LYM1182 | 81492.2 | 0.740 | L | 151 | 11.8 | L | 192 | 7.89 | L | 32 |
| LYM1182 | 81493.2 | 0.496 | 0.03 | 68 | 7.26 | 0.01 | 81 | 6.94 | 0.18 | 16 |
| LYM1182 | 81494.2 | 0.388 | 0.02 | 32 | 6.95 | L | 73 | 6.70 | 0.19 | 12 |
| LYM1182 | 81495.5 | 0.474 | 0.04 | 61 | 7.02 | 0.02 | 75 | — | — | — |
| LYM1176 | 80809.1 | 0.326 | 0.09 | 11 | — | — | — | — | — | — |
| LYM1176 | 80810.3 | 0.412 | L | 40 | 5.03 | 0.09 | 25 | 6.45 | 0.27 | 8 |
| LYM1176 | 80810.6 | 0.467 | L | 58 | 5.92 | 0.06 | 47 | 6.42 | 0.28 | 7 |
| LYM1176 | 80811.3 | 0.526 | 0.10 | 78 | 8.45 | 0.09 | 110 | — | — | — |
| LYM1176 | 80811.4 | 0.381 | 0.02 | 29 | 6.36 | 0.15 | 58 | — | — | — |
| LYM1173 | 80464.1 | 0.724 | L | 146 | 14.1 | L | 251 | 7.78 | L | 30 |
| LYM1173 | 80464.4 | 0.663 | L | 125 | 9.93 | L | 147 | — | — | — |
| LYM1173 | 80464.5 | 0.455 | 0.04 | 54 | 8.45 | 0.03 | 110 | — | — | — |
| LYM1173 | 80466.2 | 0.394 | 0.02 | 34 | 8.68 | 0.02 | 116 | 7.15 | 0.09 | 19 |
| LYM1170 | 80187.1 | 0.449 | 0.10 | 52 | 5.71 | 0.11 | 42 | — | — | — |

TABLE 117-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM1170 | 80187.5 | 0.446 | L | 51 | 6.03 | 0.05 | 50 | 6.97 | 0.11 | 16 |
| LYM1170 | 80189.1 | 0.419 | L | 42 | 7.59 | L | 89 | 6.96 | 0.07 | 16 |
| LYM1170 | 80189.3 | 0.455 | L | 54 | 7.64 | 0.06 | 90 | — | — | — |
| LYM1170 | 80189.4 | 0.465 | 0.01 | 58 | 8.03 | L | 100 | 7.42 | 0.02 | 24 |
| LYM1169 | 80606.4 | 0.501 | 0.04 | 70 | 7.74 | 0.07 | 93 | — | — | — |
| LYM1169 | 80607.2 | 0.328 | 0.25 | 11 | 5.29 | 0.15 | 32 | — | — | — |
| LYM1169 | 80607.3 | 0.456 | L | 55 | 8.76 | 0.02 | 118 | 7.36 | 0.07 | 23 |
| LYM1146 | 81487.4 | 0.645 | 0.01 | 119 | 6.86 | 0.03 | 70 | — | — | — |
| LYM1146 | 81487.5 | 0.460 | L | 56 | 7.61 | L | 89 | 7.59 | L | 27 |
| LYM1146 | 81488.2 | 0.691 | L | 134 | 11.2 | L | 179 | 7.99 | L | 33 |
| LYM1146 | 81491.4 | 0.536 | L | 82 | 5.05 | 0.09 | 25 | — | — | — |
| LYM1146 | 81491.5 | 0.673 | 0.01 | 128 | 8.02 | L | 99 | 6.93 | 0.12 | 16 |
| CONT. | — | 0.295 | — | — | 4.02 | — | — | 5.99 | — | — |
| LYM1208 | 83928.4 | 0.516 | 0.04 | 45 | 6.65 | 0.04 | 31 | — | — | — |
| LYM1208 | 83928.5 | 0.392 | 0.27 | 10 | — | — | — | — | — | — |
| LYM1208 | 83929.5 | 0.431 | 0.05 | 21 | — | — | — | — | — | — |
| LYM1208 | 83929.6 | 0.510 | 0.02 | 43 | 6.23 | 0.28 | 23 | — | — | — |
| LYM1205 | 83050.6 | 0.606 | L | 70 | 7.67 | L | 52 | — | — | — |
| LYM1205 | 83054.3 | 0.498 | 0.02 | 40 | 6.43 | 0.04 | 27 | — | — | — |
| LYM1174 | 83270.2 | 0.382 | 0.26 | 7 | — | — | — | — | — | — |
| LYM1174 | 83274.1 | 0.577 | 0.02 | 62 | 7.82 | 0.16 | 54 | — | — | — |
| LYM1174 | 83274.5 | 0.734 | L | 106 | 7.42 | 0.05 | 46 | — | — | — |
| LYM1160 | 81861.2 | 0.440 | 0.14 | 24 | 6.67 | 0.28 | 32 | — | — | — |
| LYM1160 | 81862.3 | 0.597 | 0.02 | 68 | 9.40 | 0.01 | 86 | 8.18 | 0.01 | 16 |
| LYM1160 | 81862.5 | — | — | — | 6.26 | 0.19 | 24 | 7.51 | 0.16 | 6 |
| LYM1153 | 83265.5 | 0.517 | L | 45 | 7.47 | 0.21 | 47 | — | — | — |
| LYM1153 | 83267.2 | 0.452 | L | 27 | — | — | — | — | — | — |
| LYM1153 | 83267.4 | 0.593 | L | 67 | 7.50 | 0.07 | 48 | — | — | — |
| LYM1153 | 83267.5 | 0.498 | 0.07 | 40 | — | — | — | — | — | — |
| LYM1153 | 83269.5 | 0.403 | 0.15 | 13 | — | — | — | — | — | — |
| LYM1125 | 83041.4 | 0.589 | 0.06 | 65 | 6.97 | 0.23 | 38 | — | — | — |
| LYM1125 | 83042.1 | 0.446 | L | 25 | 5.71 | 0.25 | 13 | — | — | — |
| LYM1125 | 83042.5 | 0.573 | 0.13 | 61 | — | — | — | — | — | — |
| LYM1122 | 81983.5 | 0.417 | 0.24 | 17 | — | — | — | — | — | — |
| LYM1122 | 81983.6 | 0.648 | 0.01 | 82 | 8.24 | 0.09 | 63 | — | — | — |
| LYM1122 | 81985.2 | 0.507 | L | 42 | 6.60 | 0.05 | 30 | — | — | — |
| LYM1122 | 81985.4 | 0.474 | 0.03 | 33 | — | — | — | — | — | — |
| LYM1122 | 81985.5 | 0.507 | L | 42 | — | — | — | — | — | — |
| LYM1090 | 83377.1 | 0.439 | 0.18 | 23 | 6.69 | 0.06 | 32 | — | — | — |
| LYM1090 | 83379.3 | 0.558 | 0.04 | 57 | — | — | — | — | — | — |
| LYM1090 | 83379.4 | 0.453 | 0.03 | 27 | 6.86 | 0.12 | 36 | 7.63 | 0.13 | 8 |
| LYM1090 | 83379.6 | 0.522 | 0.04 | 47 | 6.76 | 0.14 | 34 | — | — | — |
| LYM1088 | 83557.1 | 0.747 | L | 110 | 9.98 | 0.02 | 97 | 7.67 | 0.20 | 8 |
| LYM1088 | 83557.2 | 0.611 | L | 72 | 8.41 | 0.06 | 66 | 8.01 | L | 13 |
| LYM1088 | 83558.1 | 0.505 | 0.08 | 42 | 7.63 | 0.14 | 51 | — | — | — |
| LYM1088 | 83558.4 | 0.638 | L | 79 | 8.74 | 0.02 | 73 | — | — | — |
| LYM1088 | 83558.5 | 0.476 | L | 34 | 6.45 | 0.06 | 27 | — | — | — |
| LYM1046 | 81907.2 | 0.456 | 0.03 | 28 | — | — | — | — | — | — |
| LYM1046 | 81907.4 | 0.421 | 0.08 | 18 | — | — | — | — | — | — |
| LYM1046 | 81909.2 | 0.414 | 0.05 | 16 | — | — | — | — | — | — |
| LYM1046 | 81909.4 | 0.403 | 0.20 | 13 | — | — | — | — | — | — |
| LYM1046 | 81909.5 | 0.555 | L | 56 | — | — | — | — | — | — |
| LYM1035 | 83260.3 | 0.493 | 0.21 | 39 | 7.96 | 0.22 | 57 | — | — | — |
| LYM1035 | 83260.5 | 0.527 | 0.03 | 48 | 8.02 | 0.11 | 58 | — | — | — |
| LYM1035 | 83262.1 | 0.531 | L | 49 | 7.67 | L | 52 | — | — | — |
| LYM1030 | 83544.1 | 0.399 | 0.26 | 12 | — | — | — | — | — | — |
| LYM1030 | 83544.3 | 0.417 | 0.04 | 17 | — | — | — | — | — | — |
| LYM1030 | 83547.2 | 0.448 | 0.02 | 26 | 7.34 | L | 45 | — | — | — |
| CONT. | — | 0.356 | — | — | 5.06 | — | — | 7.08 | — | — |
| LYM1118 | 82534.6 | 0.432 | 0.13 | 26 | — | — | — | — | — | — |
| LYM1114 | 82487.11 | 0.472 | L | 38 | 5.03 | 0.18 | 21 | 6.34 | 0.21 | 10 |
| LYM1114 | 82487.7 | 0.476 | L | 39 | 5.98 | 0.07 | 44 | 6.62 | 0.21 | 15 |
| LYM1113 | 81872.4 | 0.489 | L | 43 | 6.01 | 0.02 | 45 | 7.05 | 0.02 | 22 |
| LYM1106 | 82627.2 | 0.545 | 0.08 | 59 | 6.00 | 0.02 | 45 | — | — | — |
| LYM1106 | 82627.3 | — | — | — | 5.15 | 0.16 | 24 | — | — | — |
| LYM1106 | 82627.6 | 0.399 | 0.19 | 16 | 4.90 | 0.25 | 18 | — | — | — |
| LYM1078 | 82657.6 | 0.446 | 0.10 | 30 | — | — | — | — | — | — |
| LYM1078 | 82657.9 | 0.518 | L | 51 | 7.22 | L | 74 | 6.83 | 0.06 | 19 |
| LYM1078 | 82659.2 | 0.598 | L | 75 | 7.02 | L | 69 | 7.49 | L | 30 |
| LYM1078 | 82659.5 | 0.438 | 0.03 | 28 | — | — | — | — | — | — |
| LYM1075 | 83047.2 | 0.472 | 0.01 | 38 | 5.55 | 0.05 | 34 | 6.63 | 0.10 | 15 |

TABLE 117-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM1075 | 83047.8 | 0.429 | 0.04 | 25 | — | — | — | — | — | — |
| LYM1075 | 83049.1 | 0.513 | 0.04 | 50 | 6.35 | 0.06 | 53 | 6.84 | 0.07 | 19 |
| LYM1075 | 83049.3 | 0.522 | 0.03 | 52 | 6.43 | 0.04 | 55 | — | — | — |
| LYM1074 | 82571.1 | 0.427 | 0.08 | 25 | 5.08 | 0.18 | 22 | — | — | — |
| LYM1074 | 82572.2 | 0.453 | 0.01 | 32 | 5.00 | 0.22 | 21 | — | — | — |
| LYM1066 | 82003.1 | 0.419 | 0.07 | 22 | — | — | — | — | — | — |
| LYM1033 | 82883.6 | 0.445 | 0.04 | 30 | 6.46 | L | 56 | 6.53 | 0.13 | 13 |
| LYM1033 | 82885.5 | 0.408 | 0.11 | 19 | 5.63 | 0.06 | 36 | — | — | — |
| LYM1027 | 82520.3 | 0.664 | L | 94 | 6.67 | 0.06 | 61 | — | — | — |
| LYM1027 | 82520.6 | 0.477 | 0.04 | 39 | — | — | — | — | — | — |
| LYM1027 | 82523.1 | 0.404 | 0.22 | 18 | — | — | — | — | — | — |
| LYM1027 | 82523.2 | 0.394 | 0.26 | 15 | — | — | — | — | — | — |
| LYM1024 | 82475.5 | 0.441 | 0.04 | 29 | — | — | — | — | — | — |
| LYM1023 | 82516.1 | 0.549 | 0.02 | 60 | 5.97 | 0.28 | 44 | — | — | — |
| LYM1023 | 82518.1 | 0.401 | 0.19 | 17 | — | — | — | — | — | — |
| LYM1023 | 82518.10 | 0.429 | 0.06 | 25 | — | — | — | — | — | — |
| CONT. | — | 0.342 | — | — | 4.15 | — | — | 5.76 | — | — |

"CONT."-Control;
"Ave."-Average
"% Incr." = % increment;
"p-val."-p-value,
L-p < 0.01.

TABLE 118

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYM1228 | 82560.2 | — | — | — | — | — | — | 0.660 | 0.23 | 8 |
| LYM1226 | 82893.10 | — | — | — | — | — | — | 0.669 | 0.13 | 10 |
| LYM1226 | 82893.5 | — | — | — | — | — | — | 0.725 | L | 19 |
| LYM1225 | 82566.1 | — | — | — | 1.10 | 0.18 | 22 | — | — | — |
| LYM1207 | 80247.4 | — | — | — | — | — | — | 0.674 | 0.10 | 10 |
| LYM1194 | 81624.5 | — | — | — | — | — | — | 0.659 | 0.29 | 8 |
| LYM1192 | 81128.3 | — | — | — | — | — | — | 0.666 | 0.19 | 9 |
| LYM1185 | 81024.4 | — | — | — | 1.06 | 0.27 | 17 | — | — | — |
| LYM1178 | 82652.6 | — | — | — | — | — | — | 0.686 | 0.10 | 13 |
| LYM1172 | 82555.3 | — | — | — | — | — | — | 0.677 | 0.10 | 11 |
| LYM1172 | 82558.3 | — | — | — | 1.17 | 0.13 | 29 | 0.740 | L | 21 |
| LYM1155 | 82888.5 | 0.0696 | 0.14 | 29 | — | — | — | — | — | — |
| LYM1155 | 82890.4 | 0.0694 | 0.09 | 28 | 1.14 | 0.13 | 26 | 0.672 | 0.14 | 10 |
| LYM1155 | 82890.5 | — | — | — | — | — | — | 0.655 | 0.29 | 7 |
| LYM1128 | 82548.1 | 0.0670 | 0.24 | 24 | 1.17 | 0.10 | 30 | — | — | — |
| LYM1059_H7 | 82876.9 | — | — | — | 1.14 | 0.18 | 26 | — | — | — |
| LYM1037 | 82524.3 | — | — | — | — | — | — | 0.656 | 0.25 | 8 |
| CONT. | — | 0.0541 | — | — | 0.902 | — | — | 0.610 | — | — |
| LYM1237 | 83878.2 | 0.0512 | 0.06 | 29 | — | — | — | — | — | — |
| LYM1237 | 83882.1 | 0.0611 | L | 54 | 0.759 | L | 37 | — | — | — |
| LYM1237 | 83882.2 | 0.0558 | L | 41 | 0.811 | L | 46 | 0.589 | 0.06 | 13 |
| LYM1230 | 80489.3 | 0.0490 | 0.11 | 24 | 0.645 | 0.27 | 16 | 0.580 | 0.23 | 11 |
| LYM1230 | 80490.1 | 0.0506 | L | 28 | 0.718 | 0.02 | 29 | 0.572 | 0.18 | 10 |
| LYM1230 | 80490.2 | 0.0539 | L | 36 | 0.658 | 0.10 | 19 | — | — | — |
| LYM1230 | 80493.5 | — | — | — | — | — | — | 0.574 | 0.14 | 10 |
| LYM1225 | 82566.1 | 0.0539 | L | 36 | 0.730 | 0.02 | 32 | 0.570 | 0.12 | 9 |
| LYM1225 | 82566.2 | 0.0501 | 0.02 | 27 | 0.725 | 0.02 | 31 | — | — | — |
| LYM1225 | 82566.6 | 0.0486 | 0.03 | 23 | 0.740 | 0.01 | 33 | — | — | — |
| LYM1225 | 82566.8 | — | — | — | 0.661 | 0.19 | 19 | 0.579 | 0.28 | 11 |
| LYM1186 | 83933.1 | 0.0623 | L | 57 | 0.842 | L | 52 | 0.565 | 0.24 | 9 |
| LYM1186 | 83933.3 | 0.0590 | L | 49 | 0.781 | L | 41 | 0.595 | 0.10 | 14 |
| LYM1186 | 83933.4 | 0.0475 | 0.07 | 20 | — | — | — | — | — | — |
| LYM1186 | 83937.1 | 0.0500 | 0.02 | 26 | 0.732 | 0.01 | 32 | — | — | — |
| LYM1185 | 81023.4 | 0.0493 | 0.05 | 25 | 0.692 | 0.12 | 25 | — | — | — |

TABLE 118-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYM1185 | 81024.3 | 0.0509 | L | 29 | 0.704 | 0.04 | 27 | 0.561 | 0.25 | 8 |
| LYM1185 | 81024.4 | — | — | — | — | — | — | 0.566 | 0.15 | 9 |
| LYM1185 | 81025.3 | 0.0464 | 0.07 | 17 | — | — | — | — | — | — |
| LYM1172 | 82555.3 | 0.0517 | L | 31 | — | — | — | — | — | — |
| LYM1172 | 82555.5 | 0.0498 | 0.06 | 26 | 0.811 | L | 46 | 0.607 | 0.02 | 17 |
| LYM1172 | 82555.6 | 0.0514 | L | 30 | 0.659 | 0.15 | 19 | 0.633 | L | 22 |
| LYM1172 | 82558.10 | 0.0493 | 0.02 | 24 | 0.686 | 0.09 | 24 | — | — | — |
| LYM1172 | 82558.3 | 0.0464 | 0.09 | 17 | — | — | — | — | — | — |
| LYM1091_H5 | 83925.6 | 0.0533 | L | 35 | 0.858 | L | 55 | 0.592 | 0.04 | 14 |
| LYM1091_H5 | 83927.3 | — | — | — | 0.626 | 0.25 | 13 | — | — | — |
| LYM1091_H5 | 83927.4 | 0.0558 | L | 41 | 0.840 | L | 51 | 0.561 | 0.23 | 8 |
| LYM1091_H5 | 83927.5 | 0.0504 | 0.03 | 27 | 0.740 | 0.01 | 33 | 0.585 | 0.14 | 12 |
| LYM1091_H5 | 83927.6 | 0.0486 | 0.08 | 23 | 0.682 | 0.10 | 23 | — | — | — |
| CONT. | — | 0.0396 | — | — | 0.555 | — | — | 0.520 | — | — |
| LYM1186 | 83933.1 | 0.0316 | 0.03 | 21 | 0.590 | 0.06 | 23 | 0.546 | 0.13 | 13 |
| LYM1186 | 83933.2 | 0.0404 | L | 54 | 0.777 | L | 63 | 0.587 | 0.02 | 22 |
| LYM1186 | 83933.3 | 0.0405 | L | 55 | 0.709 | L | 49 | 0.611 | L | 27 |
| LYM1186 | 83933.4 | 0.0306 | 0.04 | 17 | 0.543 | 0.25 | 14 | — | — | — |
| LYM1186 | 83937.1 | 0.0431 | L | 65 | 0.726 | L | 52 | 0.615 | L | 28 |
| LYM1076_H4 | 83975.2 | 0.0319 | 0.01 | 22 | — | — | — | — | — | — |
| LYM1076_H4 | 83976.1 | 0.0323 | 0.03 | 24 | — | — | — | — | — | — |
| LYM1076_H4 | 83976.3 | 0.0316 | 0.05 | 21 | 0.648 | 0.02 | 36 | 0.579 | 0.05 | 20 |
| LYM1076_H4 | 83977.3 | 0.0371 | L | 42 | 0.562 | 0.23 | 18 | — | — | — |
| LYM1076_H4 | 83977.5 | 0.0478 | L | 83 | 0.666 | 0.05 | 40 | 0.587 | 0.07 | 22 |
| CONT. | — | 0.0262 | — | — | 0.478 | — | — | 0.482 | — | — |
| LYM1161 | 80178.3 | 0.0385 | 0.06 | 20 | 0.654 | 0.10 | 19 | 0.606 | 0.16 | 10 |
| LYM1161 | 80178.4 | 0.0427 | 0.03 | 33 | — | — | — | — | — | — |
| LYM1161 | 80179.1 | 0.0505 | L | 58 | 0.781 | 0.04 | 42 | — | — | — |
| LYM1161 | 80179.3 | — | — | — | — | — | — | 0.617 | 0.11 | 12 |
| LYM1157 | 82231.2 | 0.0364 | 0.12 | 14 | — | — | — | 0.614 | 0.13 | 12 |
| LYM1157 | 82231.4 | 0.0543 | L | 69 | 0.827 | L | 51 | — | — | — |
| LYM1157 | 82232.2 | 0.0452 | L | 41 | 0.67 | 0.15 | 22 | — | — | — |
| LYM1132 | 82013.1 | 0.0451 | L | 41 | — | — | — | 0.636 | 0.05 | 16 |
| LYM1132 | 82013.4 | 0.0401 | 0.01 | 25 | — | — | — | 0.632 | 0.04 | 15 |
| LYM1132 | 82017.6 | 0.0386 | 0.06 | 21 | — | — | — | — | — | — |
| LYM1124 | 82008.4 | 0.0398 | 0.02 | 24 | 0.713 | 0.03 | 30 | — | — | — |
| LYM1115 | 80133.1 | 0.0429 | L | 34 | — | — | — | 0.685 | L | 25 |
| LYM1115 | 80133.6 | 0.0391 | 0.04 | 22 | 0.629 | 0.29 | 15 | — | — | — |
| LYM1115 | 80134.2 | 0.0443 | L | 38 | 0.707 | 0.01 | 29 | 0.674 | L | 23 |
| LYM1115 | 80135.2 | 0.0563 | L | 76 | 0.834 | 0.04 | 52 | 0.612 | 0.17 | 11 |
| LYM1085 | 82683.2 | 0.0558 | L | 74 | 0.728 | 0.12 | 33 | — | — | — |
| LYM1085 | 82683.3 | 0.0405 | 0.07 | 26 | 0.724 | 0.01 | 32 | — | — | — |
| LYM1085 | 82685.1 | 0.0476 | L | 48 | 0.724 | 0.04 | 32 | 0.663 | 0.04 | 21 |
| LYM1085 | 82685.12 | 0.0453 | L | 41 | 0.663 | 0.09 | 21 | 0.716 | L | 30 |
| LYM1082 | 82481.2 | 0.0382 | 0.07 | 19 | — | — | — | — | — | — |
| LYM1082 | 82481.4 | — | — | — | 0.629 | 0.18 | 15 | — | — | — |
| LYM1082 | 82482.4 | — | — | — | — | — | — | 0.666 | L | 21 |
| LYM1082 | 82482.5 | 0.0375 | 0.06 | 17 | — | — | — | — | — | — |
| LYM1073 | 80978.3 | 0.0454 | L | 42 | — | — | — | — | — | — |
| LYM1073 | 80978.4 | 0.0421 | L | 31 | — | — | — | — | — | — |
| LYM1073 | 80980.3 | 0.0369 | 0.12 | 15 | — | — | — | — | — | — |
| LYM1073 | 80981.1 | 0.0463 | L | 44 | — | — | — | — | — | — |
| LYM1054 | 80106.2 | 0.0405 | L | 26 | — | — | — | 0.661 | L | 20 |
| LYM1054 | 80108.2 | 0.0479 | L | 49 | — | — | — | — | — | — |
| LYM1054 | 80110.4 | 0.0473 | L | 47 | — | — | — | — | — | — |
| LYM1044 | 82612.2 | 0.0468 | L | 46 | — | — | — | — | — | — |
| LYM1044 | 82613.2 | 0.0372 | 0.11 | 16 | — | — | — | — | — | — |
| LYM1044 | 82613.4 | 0.0430 | L | 34 | 0.726 | L | 32 | 0.654 | 0.03 | 19 |
| LYM1044 | 82614.1 | 0.0408 | L | 27 | — | — | — | — | — | — |
| LYM1042 | 81998.2 | 0.0374 | 0.12 | 17 | — | — | — | 0.683 | L | 24 |
| LYM1042 | 82000.2 | 0.0388 | 0.04 | 21 | — | — | — | — | — | — |
| LYM1042 | 82000.4 | 0.0399 | L | 25 | — | — | — | 0.647 | 0.02 | 18 |
| LYM1042 | 82001.2 | 0.0395 | 0.06 | 23 | — | — | — | — | — | — |
| LYM1029 | 81349.4 | 0.0399 | 0.02 | 24 | — | — | — | 0.597 | 0.19 | 9 |
| LYM1029 | 81351.4 | 0.0429 | L | 34 | 0.824 | L | 50 | 0.696 | L | 27 |
| LYM1029 | 81353.1 | 0.0410 | 0.02 | 28 | 0.628 | 0.23 | 14 | 0.620 | 0.13 | 13 |
| LYM1029 | 81353.3 | 0.0393 | 0.08 | 23 | 0.662 | 0.14 | 21 | — | — | — |
| CONT. | — | 0.0321 | — | — | 0.549 | — | — | 0.549 | — | — |
| LYM1229 | 81574.1 | 0.0509 | L | 85 | 1.10 | L | 141 | 0.696 | 0.01 | 33 |
| LYM1229 | 81574.2 | 0.0423 | L | 53 | 0.911 | L | 100 | 0.662 | 0.06 | 27 |
| LYM1229 | 81575.1 | 0.0417 | L | 51 | 0.674 | 0.05 | 48 | — | — | — |

TABLE 118-continued

Genes showing improved plant performance at Normal growth conditions under regulation of At6669 promoter

| | | RGR Of Leaf Area | | | RGR Of Roots Coverage | | | RGR Of Root Length | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| LYM1229 | 81575.3 | 0.0566 | L | 105 | 1.09 | L | 139 | 0.639 | 0.08 | 22 |
| LYM1229 | 81576.5 | 0.0350 | L | 27 | 0.598 | 0.12 | 31 | — | — | — |
| LYM1227 | 81179.1 | 0.0384 | L | 39 | 0.672 | 0.02 | 47 | — | — | — |
| LYM1227 | 81179.2 | 0.0466 | L | 69 | 0.878 | L | 93 | 0.632 | 0.11 | 21 |
| LYM1227 | 81179.3 | 0.0341 | 0.02 | 24 | 0.660 | 0.04 | 45 | 0.603 | 0.25 | 15 |
| LYM1227 | 81179.7 | 0.0462 | L | 67 | 0.837 | 0.01 | 84 | — | — | — |
| LYM1227 | 81180.2 | 0.0548 | L | 99 | 1.04 | L | 128 | 0.675 | 0.03 | 29 |
| LYM1219 | 80509.2 | 0.0520 | L | 89 | 0.796 | L | 75 | 0.655 | 0.06 | 25 |
| LYM1219 | 80510.3 | 0.0466 | L | 69 | 0.862 | L | 89 | 0.643 | 0.09 | 23 |
| LYM1219 | 80510.4 | 0.0475 | L | 72 | 0.764 | L | 68 | — | — | — |
| LYM1219 | 80513.2 | 0.0529 | L | 92 | 0.989 | L | 117 | 0.742 | L | 42 |
| LYM1218 | 81114.1 | 0.0370 | L | 34 | 0.875 | L | 92 | — | — | — |
| LYM1218 | 81114.2 | 0.0679 | L | 146 | 1.12 | L | 145 | 0.660 | 0.08 | 26 |
| LYM1218 | 81116.6 | 0.0330 | 0.04 | 20 | 0.668 | 0.03 | 47 | 0.609 | 0.20 | 17 |
| LYM1218 | 81116.7 | 0.0512 | 0.01 | 86 | 0.977 | L | 114 | 0.607 | 0.25 | 16 |
| LYM1218 | 81116.8 | 0.0654 | L | 137 | 1.05 | L | 130 | 0.649 | 0.10 | 24 |
| LYM1216 | 80256.7 | 0.0565 | L | 105 | 1.15 | L | 153 | 0.672 | 0.05 | 29 |
| LYM1216 | 80259.1 | 0.0462 | L | 67 | 0.740 | L | 62 | 0.650 | 0.07 | 25 |
| LYM1216 | 80259.2 | 0.0454 | L | 65 | 0.798 | L | 75 | 0.610 | 0.18 | 17 |
| LYM1216 | 80260.1 | 0.0594 | L | 115 | 1.14 | L | 150 | 0.683 | 0.03 | 31 |
| LYM1212 | 80777.1 | 0.0392 | L | 42 | 0.593 | 0.13 | 30 | 0.619 | 0.19 | 19 |
| LYM1212 | 80779.1 | 0.0466 | L | 69 | — | — | — | — | — | — |
| LYM1210 | 80617.1 | 0.0344 | 0.01 | 25 | 0.659 | 0.04 | 45 | 0.604 | 0.22 | 16 |
| LYM1210 | 80618.2 | 0.0413 | L | 50 | 0.678 | 0.04 | 49 | — | — | — |
| LYM1210 | 80618.3 | 0.0571 | L | 107 | 1.01 | L | 122 | 0.647 | 0.07 | 24 |
| LYM1210 | 80620.2 | 0.0561 | L | 103 | 0.872 | L | 91 | 0.687 | 0.02 | 32 |
| LYM1210 | 80620.5 | 0.0494 | L | 79 | 0.710 | 0.04 | 56 | — | — | — |
| LYM1209 | 80479.1 | 0.0510 | L | 85 | 0.995 | L | 118 | 0.706 | 0.01 | 35 |
| LYM1209 | 80480.1 | 0.0601 | L | 118 | 1.04 | L | 128 | 0.635 | 0.11 | 22 |
| LYM1209 | 80482.3 | 0.0361 | L | 31 | 0.563 | 0.23 | 24 | — | — | — |
| LYM1209 | 80482.4 | 0.0477 | L | 73 | 0.649 | 0.04 | 42 | — | — | — |
| LYM1209 | 80482.6 | 0.0437 | L | 58 | 0.810 | L | 78 | 0.592 | 0.30 | 13 |
| LYM1201 | 81102.1 | 0.0403 | L | 46 | 0.791 | L | 73 | 0.718 | L | 37 |
| LYM1201 | 81102.3 | 0.0351 | 0.02 | 27 | 0.649 | 0.04 | 42 | 0.650 | 0.06 | 24 |
| LYM1201 | 81103.1 | 0.0406 | L | 47 | 0.804 | L | 76 | 0.670 | 0.03 | 28 |
| LYM1201 | 81104.4 | 0.0540 | L | 96 | 0.794 | L | 74 | — | — | — |
| LYM1201 | 81105.2 | 0.0510 | L | 85 | 0.818 | L | 80 | 0.651 | 0.06 | 25 |
| LYM1195 | 81918.1 | 0.0317 | 0.17 | 15 | — | — | — | — | — | — |
| LYM1195 | 81918.3 | 0.0542 | L | 97 | 1.23 | L | 170 | 0.769 | L | 47 |
| LYM1195 | 81919.3 | 0.0558 | L | 102 | 0.905 | L | 99 | 0.683 | 0.03 | 31 |
| LYM1195 | 81919.4 | 0.0528 | L | 91 | 0.770 | L | 69 | — | — | — |
| LYM1195 | 81919.6 | 0.0505 | L | 83 | 0.806 | L | 77 | 0.672 | 0.08 | 29 |
| LYM1189 | 81097.2 | — | — | — | 0.605 | 0.13 | 33 | — | — | — |
| LYM1189 | 81099.1 | 0.0448 | L | 63 | 0.711 | 0.02 | 56 | — | — | — |
| LYM1189 | 81099.2 | 0.0437 | L | 58 | 0.876 | L | 92 | 0.668 | 0.04 | 28 |
| LYM1189 | 81100.2 | 0.0381 | L | 38 | 0.730 | 0.02 | 60 | 0.635 | 0.12 | 22 |
| LYM1189 | 81101.4 | 0.0388 | L | 41 | 0.589 | 0.18 | 29 | 0.653 | 0.08 | 25 |
| LYM1182 | 81492.1 | 0.0502 | L | 82 | 0.696 | 0.03 | 53 | 0.622 | 0.20 | 19 |
| LYM1182 | 81492.4 | 0.0736 | L | 167 | 1.39 | L | 206 | 0.716 | 0.01 | 37 |
| LYM1182 | 81493.2 | 0.0450 | L | 63 | 0.833 | L | 83 | — | — | — |
| LYM1182 | 81494.2 | 0.0373 | L | 35 | 0.808 | L | 77 | 0.602 | 0.26 | 15 |
| LYM1182 | 81495.5 | 0.0467 | L | 69 | 0.834 | L | 83 | 0.620 | 0.18 | 19 |
| LYM1176 | 80810.3 | 0.0376 | L | 36 | 0.580 | 0.15 | 27 | — | — | — |
| LYM1176 | 80810.6 | 0.0452 | L | 64 | 0.701 | 0.02 | 54 | 0.617 | 0.15 | 18 |
| LYM1176 | 80811.3 | 0.0497 | L | 80 | 0.998 | L | 119 | 0.615 | 0.29 | 18 |
| LYM1176 | 80811.4 | 0.0353 | 0.01 | 28 | 0.741 | 0.03 | 63 | 0.628 | 0.19 | 20 |
| LYM1173 | 80464.1 | 0.0727 | L | 164 | 1.69 | L | 272 | 0.745 | L | 43 |
| LYM1173 | 80464.4 | 0.0599 | L | 117 | 1.18 | L | 159 | 0.634 | 0.14 | 21 |
| LYM1173 | 80464.5 | 0.0452 | L | 64 | 1.00 | L | 120 | 0.650 | 0.13 | 24 |
| LYM1173 | 80466.2 | 0.0393 | L | 42 | 1.03 | L | 127 | 0.710 | 0.02 | 36 |
| LYM1170 | 80187.1 | 0.0439 | L | 59 | 0.664 | 0.04 | 46 | 0.615 | 0.26 | 18 |
| LYM1170 | 80187.5 | 0.0452 | L | 64 | 0.702 | 0.02 | 54 | 0.665 | 0.05 | 27 |
| LYM1170 | 80189.1 | 0.0413 | L | 50 | 0.879 | L | 93 | 0.612 | 0.19 | 17 |
| LYM1170 | 80189.3 | 0.0473 | L | 72 | 0.865 | L | 90 | 0.622 | 0.24 | 19 |
| LYM1170 | 80189.4 | 0.0459 | L | 66 | 0.929 | L | 104 | 0.687 | 0.02 | 32 |
| LYM1169 | 80606.4 | 0.0516 | L | 87 | 0.907 | L | 99 | 0.608 | 0.28 | 16 |
| LYM1169 | 80607.2 | 0.0312 | 0.24 | 13 | 0.601 | 0.14 | 32 | — | — | — |
| LYM1169 | 80607.3 | 0.0452 | L | 64 | 1.01 | L | 121 | 0.672 | 0.05 | 29 |
| LYM1146 | 81487.4 | 0.0605 | L | 119 | 0.781 | L | 71 | — | — | — |
| LYM1146 | 81487.5 | 0.0441 | L | 60 | 0.873 | L | 92 | 0.667 | 0.04 | 28 |
| LYM1146 | 81488.2 | 0.0682 | L | 147 | 1.29 | L | 184 | 0.730 | L | 40 |

TABLE 118-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYM1146 | 81491.4 | 0.0501 | L | 82 | 0.589 | 0.14 | 29 | — | — | — |
| LYM1146 | 81491.5 | 0.0642 | L | 133 | 0.963 | L | 111 | 0.670 | 0.04 | 28 |
| CONT. | — | 0.0276 | — | — | 0.456 | — | — | 0.522 | — | — |
| LYM1208 | 83928.4 | 0.0482 | L | 45 | 0.778 | 0.03 | 35 | — | — | — |
| LYM1208 | 83929.5 | 0.0406 | 0.06 | 22 | — | — | — | — | — | — |
| LYM1208 | 83929.6 | 0.0495 | L | 49 | 0.700 | 0.20 | 21 | — | — | — |
| LYM1205 | 83050.6 | 0.0566 | L | 70 | 0.894 | L | 55 | — | — | — |
| LYM1205 | 83054.3 | 0.0475 | L | 43 | 0.766 | 0.03 | 32 | 0.709 | 0.19 | 8 |
| LYM1174 | 83274.1 | 0.0537 | L | 62 | 0.910 | 0.01 | 57 | — | — | — |
| LYM1174 | 83274.5 | 0.0690 | L | 108 | 0.881 | L | 52 | — | — | — |
| LYM1160 | 81861.2 | 0.0402 | 0.15 | 21 | 0.785 | 0.09 | 36 | — | — | — |
| LYM1160 | 81862.3 | 0.0531 | L | 60 | 1.08 | L | 87 | 0.732 | 0.11 | 12 |
| LYM1160 | 81862.5 | — | — | — | 0.735 | 0.09 | 27 | 0.720 | 0.15 | 10 |
| LYM1153 | 83265.5 | 0.0522 | L | 57 | 0.862 | 0.02 | 49 | — | — | — |
| LYM1153 | 83267.2 | 0.0430 | 0.02 | 29 | — | — | — | — | — | — |
| LYM1153 | 83267.4 | 0.0531 | L | 60 | 0.873 | L | 51 | — | — | — |
| LYM1153 | 83267.5 | 0.0495 | L | 49 | — | — | — | — | — | — |
| LYM1125 | 83041.4 | 0.0550 | L | 65 | 0.820 | 0.05 | 42 | — | — | — |
| LYM1125 | 83042.1 | 0.0398 | 0.07 | 20 | 0.669 | 0.27 | 16 | — | — | — |
| LYM1125 | 83042.5 | 0.0571 | L | 72 | 0.698 | 0.28 | 21 | — | — | — |
| LYM1122 | 81983.5 | 0.0381 | 0.28 | 15 | — | — | — | — | — | — |
| LYM1122 | 81983.6 | 0.0611 | L | 84 | 0.967 | L | 67 | — | — | — |
| LYM1122 | 81985.2 | 0.0461 | L | 39 | 0.766 | 0.03 | 33 | — | — | — |
| LYM1122 | 81985.4 | 0.0475 | L | 43 | — | — | — | — | — | — |
| LYM1122 | 81985.5 | 0.0474 | L | 42 | 0.686 | 0.24 | 19 | — | — | — |
| LYM1090 | 83377.1 | 0.0456 | 0.02 | 37 | 0.782 | 0.03 | 35 | — | — | — |
| LYM1090 | 83379.3 | 0.0507 | L | 53 | — | — | — | — | — | — |
| LYM1090 | 83379.4 | 0.0417 | 0.04 | 25 | 0.802 | 0.03 | 39 | — | — | — |
| LYM1090 | 83379.6 | 0.0478 | L | 44 | 0.772 | 0.05 | 34 | — | — | — |
| LYM1088 | 83557.1 | 0.0690 | L | 107 | 1.17 | L | 102 | — | — | — |
| LYM1088 | 83557.2 | 0.0563 | L | 69 | 0.983 | L | 70 | 0.717 | 0.15 | 10 |
| LYM1088 | 83558.1 | 0.0467 | 0.02 | 40 | 0.893 | 0.01 | 55 | — | — | — |
| LYM1088 | 83558.4 | 0.0615 | L | 85 | 1.04 | L | 80 | 0.733 | 0.17 | 12 |
| LYM1088 | 83558.5 | 0.0425 | 0.02 | 28 | 0.725 | 0.07 | 25 | — | — | — |
| LYM1046 | 81907.2 | 0.0418 | 0.05 | 26 | — | — | — | — | — | — |
| LYM1046 | 81907.4 | 0.0383 | 0.22 | 15 | — | — | — | — | — | — |
| LYM1046 | 81909.2 | 0.0398 | 0.09 | 20 | — | — | — | — | — | — |
| LYM1046 | 81909.5 | 0.0531 | L | 60 | — | — | — | — | — | — |
| LYM1035 | 83260.3 | 0.0493 | 0.03 | 48 | 0.941 | 0.03 | 63 | — | — | — |
| LYM1035 | 83260.5 | 0.0510 | L | 53 | 0.933 | L | 61 | — | — | — |
| LYM1035 | 83262.1 | 0.0494 | L | 49 | 0.867 | L | 50 | — | — | — |
| LYM1035 | 83264.6 | — | — | — | 0.695 | 0.28 | 20 | — | — | — |
| LYM1030 | 83544.3 | 0.0377 | 0.22 | 13 | — | — | — | — | — | — |
| LYM1030 | 83547.2 | 0.0430 | 0.02 | 29 | 0.852 | L | 47 | — | — | — |
| CONT. | — | 0.0332 | — | — | 0.578 | — | — | 0.654 | — | — |
| LYM1118 | 82534.6 | 0.0443 | 0.13 | 30 | — | — | — | — | — | — |
| LYM1114 | 82487.11 | 0.0436 | 0.11 | 28 | — | — | — | — | — | — |
| LYM1114 | 82487.7 | 0.0489 | 0.03 | 43 | 0.720 | 0.07 | 46 | — | — | — |
| LYM1113 | 81872.4 | 0.0498 | 0.01 | 46 | 0.731 | 0.04 | 48 | 0.721 | 0.03 | 31 |
| LYM1106 | 82627.2 | 0.0538 | 0.02 | 58 | 0.724 | 0.06 | 47 | — | — | — |
| LYM1106 | 82627.3 | — | — | — | 0.620 | 0.24 | 26 | — | — | — |
| LYM1078 | 82657.6 | 0.0434 | 0.14 | 27 | — | — | — | — | — | — |
| LYM1078 | 82657.9 | 0.0521 | 0.01 | 53 | 0.854 | L | 73 | 0.656 | 0.23 | 20 |
| LYM1078 | 82659.2 | 0.0558 | L | 64 | 0.830 | L | 68 | 0.664 | 0.13 | 21 |
| LYM1078 | 82659.5 | 0.0427 | 0.20 | 25 | — | — | — | — | — | — |
| LYM1075 | 83047.2 | 0.0474 | 0.03 | 39 | 0.663 | 0.12 | 34 | 0.637 | 0.26 | 16 |

TABLE 118-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYM1075 | 83047.8 | 0.0427 | 0.19 | 25 | — | — | — | — | — | — |
| LYM1075 | 83049.1 | 0.0495 | 0.03 | 45 | 0.770 | 0.03 | 56 | 0.664 | 0.15 | 21 |
| LYM1075 | 83049.3 | 0.0521 | 0.02 | 53 | 0.780 | 0.03 | 58 | — | — | — |
| LYM1074 | 82572.2 | 0.0444 | 0.08 | 30 | — | — | — | — | — | — |
| LYM1033 | 82883.6 | 0.0449 | 0.08 | 32 | 0.787 | 0.01 | 60 | 0.639 | 0.24 | 16 |
| LYM1033 | 82885.5 | 0.0406 | 0.26 | 19 | 0.683 | 0.09 | 39 | — | — | — |
| LYM1027 | 82520.3 | 0.0580 | L | 70 | 0.789 | 0.02 | 60 | — | — | — |
| LYM1027 | 82520.6 | 0.0463 | 0.08 | 36 | — | — | — | — | — | — |
| LYM1024 | 82475.5 | 0.0423 | 0.18 | 24 | — | — | — | — | — | — |
| LYM1023 | 82516.1 | 0.0533 | 0.01 | 57 | 0.718 | 0.12 | 46 | — | — | — |
| LYM1023 | 82518.10 | 0.0433 | 0.14 | 27 | — | — | — | — | — | — |
| CONT. | — | 0.0341 | — | — | 0.493 | — | — | 0.549 | — | — |

"CONT."-Control;
"Ave."-Average
"% Incr." = % increment;
"p-val."-p-value,
L-p < 0.01.

Results from T1 Plants

Tables 119-121 summarize the observed phenotypes of transgenic plants expressing the gene constructs using the TC -T1 Assays.

The genes presented in Tables 119-121 showed a significant improvement in plant biomass and root development since they produced a higher biomass (dry and fresh weight, Table 119), a larger leaf and root biomass (leaf area, root length and root coverage) (Table 120), and a higher relative growth rate of leaf area, root coverage and root length (Table 121) when grown under normal growth conditions, compared to control plants grown under identical growth conditions. Plants producing larger root biomass have better possibilities to absorb larger amount of nitrogen from soil. Plants producing larger leaf biomass has better ability to produce assimilates). The genes were cloned under the regulation of a constitutive promoter (At6669; SEQ ID NO: 8190). The evaluation of each gene was performed by testing the performance of different number of events. Some of the genes were evaluated in more than one tissue culture assay. This second experiment confirmed the significant increment in leaf and root performance. Event with p-value <0.1 was considered statistically significant.

TABLE 119

Genes showing improved plant performance at Normal growth conditions under regulation of At6669 promoter

| | Dry Weight [mg] | | | Fresh Weight [mg] | | |
|---|---|---|---|---|---|---|
| Gene Name | Ave. | P-Val. | % Incr. | Ave. | P-Val. | % Incr. |
| LYM1164_H1 | 9.15 | 0.25 | 44 | — | — | — |
| LYM1018 | 8.00 | L | 26 | 234.9 | 0.29 | 41 |
| CONT. | 6.33 | — | — | 167.0 | — | — |
| LYM1052 | 10.0 | 0.14 | 13 | 210.8 | 0.27 | 27 |
| CONT. | 8.84 | — | — | 165.4 | — | — |

"CONT."-Control;
"Ave."-Average
"% Incr." = % increment;
"p-val."-p-value,
L-p < 0.01.

TABLE 120

Genes showing improved plant performance at Normal growth conditions under regulation of At6669 promoter

| | Leaf Area [cm2] | | | Roots Coverage [cm$^2$] | | | Roots Length [cm] | | |
|---|---|---|---|---|---|---|---|---|---|
| Gene Name | Ave. | P-Val. | % Incr. | Ave. | P-Val. | % Incr. | Ave. | P-Val. | % Incr. |
| LYM1164_H1 | 0.870 | 0.12 | 31 | 9.35 | 0.02 | 48 | 7.64 | 0.19 | 18 |
| LYM1018 | 0.772 | 0.05 | 17 | — | — | — | — | — | — |
| CONT. | 0.661 | — | — | 6.33 | — | — | 6.45 | — | — |

"CONT."-Control;
"Ave."-Average
"% Incr." = % increment;
"p-val."-p-value,
L-p < 0.01.

TABLE 121

Genes showing improved plant performance at Normal growth conditions under regulation of At6669 promoter

| Gene Name | RGR Of Leaf Area | | | RGR Of Roots Coverage | | | RGR Of Root Length | | |
|---|---|---|---|---|---|---|---|---|---|
| | Ave. | P-Val. | % Incr. | Ave. | P-Val. | % Incr. | Ave. | P-Val. | % Incr. |
| LYM1164_H1 | 0.0829 | 0.03 | 38 | 1.12 | L | 49 | 0.807 | 0.08 | 22 |
| LYM1018 | 0.0708 | 0.26 | 18 | — | — | — | — | — | — |
| CONT. | 0.0603 | — | — | 0.754 | — | — | 0.662 | — | — |

"CONT."-Control;
"Ave."-Average
"% Incr." = % increment;
"p-val."-p-value,
L-p < 0.01.

These results demonstrate that the polynucleotides of the invention are capable of improving yield and additional valuable important agricultural traits such as increase of biomass, abiotic stress tolerance, nitrogen use efficiency, yield, vigor, fiber yield and/or quality. Thus, transformed plants showing improved fresh and dry weight demonstrate the gene capacity to improve biomass a key trait of crops for forage and plant productivity; transformed plants showing improvement of seed yield demonstrate the genes capacity to improve plant productivity; transformed plants showing improvement of plot coverage and rosette diameter demonstrate the genes capacity to improve plant drought resistance as they reduce the loss of soil water by simple evaporation and reduce the competition with weeds; hence reduce the need to use herbicides to control weeds. Transformed plants showing improvement of relative growth rate of various organs (leaf and root) demonstrate the gene capacity to promote plant growth and hence shortening the needed growth period and/or alternatively improving the utilization of available nutrients and water leading to increase of land productivity; Transformed plants showing improvement of organ number as demonstrated by the leaf number parameter exhibit a potential to improve biomass yield important for forage crops and improve the plant productivity; Transformed plants showing increased root length and coverage demonstrate the gene capacity to improve drought resistance and better utilization of fertilizers as the roots can reach larger soil volume; Transformed plants showing improvement of leaf petiole relative area and leaf blade area demonstrate the genes capacity to cope with limited light intensities results from increasing the plant population densities and hence improve land productivity.

Example 22

Evaluation of Transgenic Brachypodium NUE and Yield Under Low or Normal Nitrogen Fertilization in Greenhouse Assay Assay 3: Nitrogen Use efficiency measured plant biomass and yield at limited and optimal nitrogen concentration under greenhouse conditions until heading—This assay follows the plant biomass formation and growth (measured by height) of plants which were grown in the greenhouse at limiting and non-limiting (e.g., normal) nitrogen growth conditions. Transgenic Brachypodium seeds were sown in peat plugs. The $T_1$ transgenic seedlings were then transplanted to 27.8×11.8×8.5 cm trays filled with peat and perlite in a 1:1 ratio. The trays were irrigated with a solution containing nitrogen limiting conditions, which were achieved by irrigating the plants with a solution containing 3 mM inorganic nitrogen in the form of $NH_4NO_3$, supplemented with 1 mM $KH_2PO_4$, 1 mM $MgSO_4$, 3.6 mM KCl, 2 mM $CaCl_2$ and microelements, while normal nitrogen levels were achieved by applying a solution of 6 mM inorganic nitrogen also in the form of $NH_4NO_3$ with 1 mM $KH_2PO_4$, 1 mM $MgSO_4$, 2 mM $CaCl_2$, 3.6 mM KCl and microelements. All plants were grown in the greenhouse until heading. Plant biomass (the above ground tissue) was weighted right after harvesting the shoots (plant fresh weight [FW]). Following, plants were dried in an oven at 70° C. for 48 hours and weighed (plant dry weight [DW]).

Each construct was validated at its $T_1$ generation. Transgenic plants transformed with a construct conformed by an empty vector carrying the BASTA selectable marker were used as control (FIG. 9B).

The plants were analyzed for their overall size, fresh weight and dry matter. Transgenic plants performance was compared to control plants grown in parallel under the same conditions. Mock-transgenic plants with no gene and no promoter at all, were used as control (FIG. 9B).

The experiment was planned in blocks and nested randomized plot distribution within them. For each gene of the invention five independent transformation events were analyzed from each construct.

Phenotyping

Plant Fresh and Dry shoot weight—In Heading assays when heading stage has completed (about day 30 from sowing), the plants were harvested and directly weighed for the determination of the plant fresh weight on semi-analytical scales (0.01 gr) (FW) and left to dry at 70° C. in a drying chamber for about 48 hours before weighting to determine plant dry weight (DW).

Time to Heading—In both Seed Maturation and Heading assays heading was defined as the full appearance of the first spikelet in the plant. The time to heading occurrence is defined by the date the heading is completely visible. The time to heading occurrence date was documented for all plants and then the time from planting to heading was calculated.

Leaf thickness—In Heading assays when minimum 5 plants per plot in at least 90% of the plots in an experiment have been documented at heading, measurement of leaf thickness was performed using a micro-meter on the second leaf below the flag leaf.

Plant Height—In both Seed Maturation and Heading assays once heading was completely visible, the height of the first spikelet was measured from soil level to the bottom of the spikelet.

Tillers number—In Heading assays manual count of tillers was preformed per plant after harvest, before weighing.

Example 23

Evaluation of Transgenic Brachypodium NUE and Yield Under Low or Normal Nitrogen Fertilization in Greenhouse Assay Assay 4: Nitrogen Use efficiency measured plant biomass and yield at limited and optimal nitrogen concentration under greenhouse conditions until Seed Maturation—This assay follows the plant biomass and yield production of plants that were grown in the greenhouse at limiting and non-limiting nitrogen growth conditions. Transgenic Brachypodium seeds were sown in peat plugs. The $T_1$ transgenic seedlings were then transplanted to 27.8×11.8×8.5 cm trays filled with peat and perlite in a 1:1 ratio. The trays were irrigated with a solution containing nitrogen limiting conditions, which were achieved by irrigating the plants with a solution containing 3 mM inorganic nitrogen in the form of $NH_4NO_3$, supplemented with 1 mM $KH_2PO_4$, 1 mM $MgSO_4$, 3.6 mM KCl, 2 mM $CaCl_2$ and microelements, while normal nitrogen levels were achieved by applying a solution of 6 mM inorganic nitrogen also in the form of $NH_4NO_3$ with 1 mM $KH_2PO_4$, 1 mM $MgSO_4$, 2 mM $CaCl_2$, 3.6 mM KCl and microelements. All plants were grown in the greenhouse until seed maturation. Each construct was validated at its $T_1$ generation. Transgenic plants transformed with a construct conformed by an empty vector carrying the BASTA selectable marker were used as control (FIG. 9B).

The plants were analyzed for their overall biomass, fresh weight and dry matter, as well as a large number of yield and yield components related parameters. Transgenic plants performance was compared to control plants grown in parallel under the same conditions. Mock-transgenic plants with no gene and no promoter at all (FIG. 9B). The experiment was planned in blocks and nested randomized plot distribution within them. For each gene of the invention five independent transformation events were analyzed from each construct.

Phenotyping

Plant Fresh and Dry vegetative weight—In Seed Maturation assays when maturity stage has completed (about day 80 from sowing), the plants were harvested and directly weighed for the determination of the plant fresh weight (FW) and left to dry at 70° C. in a drying chamber for about 48 hours before weighting to determine plant dry weight (DW).

Spikelets Dry weight (SDW)—In Seed Maturation assays when maturity stage has completed (about day 80 from sowing), the spikelets were separated from the biomass, left to dry at 70° C. in a drying chamber for about 48 hours before weighting to determine spikelets dry weight (SDW).

Grain Yield per Plant—In Seed Maturation assays after drying of spikelets for SDW, spikelets were run through production machine, then through cleaning machine, until seeds were produced per plot, then weighed and Grain Yield per Plant was calculated.

Grain Number—In Seed Maturation assays after seeds per plot were produced and cleaned, the seeds were run through a counting machine and counted.

1000 Seed Weight—In Seed Maturation assays after seed production, a fraction was taken from each sample (seeds per plot; ~0.5 gr), counted and photographed. 1000 seed weight was calculated.

Harvest Index—In Seed Maturation assays after seed production, harvest index was calculated by dividing grain yield and vegetative dry weight.

Time to Heading—In both Seed Maturation and Heading assays heading was defined as the full appearance of the first spikelet in the plant. The time to heading occurrence is defined by the date the heading is completely visible. The time to heading occurrence date was documented for all plants and then the time from planting to heading was calculated.

Leaf thickness—In Heading assays when minimum 5 plants per plot in at least 90% of the plots in an experiment have been documented at heading, measurement of leaf thickness was performed using a micro-meter on the second leaf below the flag leaf.

Grain filling period—In Seed Maturation assays maturation was defined by the first color-break of spikelet+stem on the plant, from green to yellow/brown.

Plant Height—In both Seed Maturation and Heading assays once heading was completely visible, the height of the first spikelet was measured from soil level to the bottom of the spikelet.

Tillers number—In Heading assays manual count of tillers was preformed per plant after harvest, before weighing.

Number of reproductive heads per plant—In Heading assays manual count of heads per plant was performed.

Statistical analyses—To identify genes conferring significantly improved tolerance to abiotic stresses, the results obtained from the transgenic plants were compared to those obtained from control plants. To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (8653 sequences)

SEQ ID NO: 1 - DNA, 1219 bp, Hordeum vulgare
ctctccttatccacaatttccacaccaatccaccactttccactcggccttcctctcgctaccactccgcctgctgccgcgccatggcgctccacgccgtctcccctgcggcggcggcacctccgccccgcgccctctcctctgcccgtctgccccagcgcccaggttgtggttgtctctcaaaccgttcatccctgttaagttcgcccacaaacttcatgaaaattcagtctggagcagtgggtttctttggtgtgcctttggttcttcaacactcggacaagagagcagttttgaggcatgccactaatgaagaaattgaggaagaaaagacaatcgttgaagaacaagctaaagaaaagatggagaaggccattgaaacagttcagtcgaacttcaataccgtgaggactgggcgggcaaacccgtctatgcttgacaggattgaggttgagtactatggaactcctgtaaacttgaagactattgcacaagtaaatactccagatgcgacttctcttcttatccagccatatgacaagtcttgcctcaagctcattgagaaagctatagttgctgcaaatattggggtaacaccaagcaatgatggagaagtgatacgagtcactgtcccaccattgacatctgatcgcagaaaggagatgacaaaaaccgtagctaagttatctgaagaaggcaaggttgctatcagaaacataagacgagacgcaatcaaagcctatgataagctagagaaggaaaagaaactttctgaagataatgtgaaggatttatcagccgatctacaaaaaatcacagacgagtacatgaaaaaggttgaagccatccaaaagcagaaggaacaggagctgagcaaggtttagatcccgcccccgactgaacaaaaactggccacaagatttctgaagccttcttgtcatcggatggttgccactgcgctgtgcgatcactccttgggttggactcttgctaagactgatggatgcaaagtgcagacctcgtttcccttttgtaattaggcctccgccgacttcctgtccgactgctattgtcaatatttctcttcgccacatctatgatgtgcactctaaaagtctcagtttcctttgctaattatacaccctgggctgggctccactgcaatcgggtgctacaaattgggcaagttctttttcatgtttcagagattgaaacgagg

SEQ ID NO: 2 - DNA, 1256 bp, Hordeum vulgare
acgcacgcacgcgactcctccctccaccccgaccgacacgcacctcaccgcaccggcgagctagggttcgctcgctcgctcgggcgtccgtccatccatccatctccggcgggcgggcggggcgggcatggcggggatacggtggccgccggaggacccggagatgttcccgacgcggatgctggggacgggggtctggggcgggccccccgccgcgcccggcgaggcggcgtcggacgacgaccgctccgtggcggccgactcctggtccatcaagagcgactacgggagcacgctcgacgacgagcagcgctacgccgacaccgccgaggtgctcctcgcctcctcctcctcctcggccgcctccgccgccgcgccctccgcctgctcctcctccctcagcgcccaccactcctccgacttcagcttcgacaaggacgtgcccgacgtcgtgccgccgatgctgggcctgcacaattaccaggacggcgcgttcgccgaagacctagccaattaccacgaacgcagccacgccgatgactggtttggcaccgaggccatggatgtccttgtaggctggacgaaaaacttatgttccagcaaggatttgtccggctgcagcgtacttgacataggaaccgggagcggacgactcttacagcagcttgcaaaacaagggttttctgatctaactggcattgactatagtgaagccgcaattgagcttgctcgaaaccttgcaattcgtgatggatttgagcacattaatttcttggttgatgatgttctggagtcgaagttggagaggagatttgaacttgtgatggatgaaggaactctggatgcaatagggctccaccctgatggacctgtaaagagaatgatgtattggcagtcagtggctagcttggtttctcctggtggcatactggtgatcacatcctgcagcaggaccaaggatgagctagtgcaggaggtggagaacttcaatcagagaaagttgggcgccacgctatctgaaggagcgctgaccagcgatgctgtggtgttcaagtacctcgaccatgtgcaagcttacccaaacgtcgatggtgtttgcatcgccaccgttgctttcctgcatacatgaaatatatgtatatgtatccatcctccctctcttgttcctaacttatcagacctgtgagtaacaatgtaccccaggacagctgttcttccatggatgataatttaccttgtcggatacgttattcgct

SEQ ID NO: 3 - DNA, 1118 bp, Hordeum vulgare
aggccgtccaagaaaaaccccatcgatgggcatggggacaacagtgctgcccgtcgcccacaagctctcgctcgcctcccccttcctcccgcgccaccggcggccctgccgtccccccgcccagcagcactgccggcgccggcgccatggggcggtggtggcgtacatggagccggacccgaactcgccggcggccatcctggggcgcatcgtcggggccctccccgtggtgggcctcgtggcgcgcatcctgagcgacgacggcggcgtcggcggcgacaccgtcgacttcgccgagttccggcgccgcgtcagcaagaagtgcaccgtcatggactcccaggccttctacgacttcaacgaccgccgcggcaaggtgggagaccccttctacgtcctgctgtgctgctggctggccgccattggcgccgggctgctgaaaacagaggagatcctggaaggcgtggcccggctccggatgtccaacgacatccagtacgaggaggagaccttcctcgacatgatgaagatagcaagggagaaacgggccaagtccaagagccaggcgccggtgataccgatggaggtgcgggcggagaaggcgctggaggccatctacgtgtgctgcttcgggcaggagatggtggagccggaggacgagaagctgctgtgcacgatgctgaacgcggtgttcccgtcggtggggaggccggcggtggagaggatggtgtccaccatggccaagcaggtggcctccggcgagaggaggggccccgacacaaaggtcgtgtccaaggaggtggcgcagaggcagctcaaggacctcgagttcctgcagcagaacaagctggactcggtgtgaggaggggctcattttttggcagctaggtccatggagaaatgagaatggattttgatgtagccacacacggtacggtacgtaggaggaaccaactgccattgtgggattgtaaacgacacgatttgcagggtcgagtcgatgcttgcttgctatcactctccttattcgtagtgttgttgcagtgtgatatgagtggcactgccatgggcatcagaagcttgcaagatagtactataagatttgactcgtgctcctt

SEQ ID NO: 4 - DNA, 1537 bp, Hordeum vulgare
caaaaccccgccccctcctcttctagggtttcctcctccccatccgcgccaggaccccaccgcccgcccatgtccgccgcctcccgcgacgccccagtcccgcccgccatgccggacctcgtccgcgaccacctctacttcggcgacatcaacgacgccatcgcggccctcaccgcctccctcccagacggcaccgacatcacccacgtcctctccgtcgtcagctccgcctccatctccttcttcaccgactaccgcccgggcctctgcttgccgaccgaggaggtccgccgcgtcgttgccggggaggatgggacgccctcggtggtggctccagggcggctggtgcgggtggtggagaggacgggggaagggctaagggtgacgcggatggccgtgccgctcaaggacacggaggaggagaacctgctcgaccacctcgagccgtgcctcgactttatcgacgaggggaggaaggcgggcagcgtgctcgtgcattgcttcgcgggggtctccaggagtgctaccatcatcacggcatatctaatgagaacagagcagaaatctctggaagaagcactacagtccttgaaggaaattaatgagtccgtttgcccaaacgatggtttccttgaccagttaaaattgtttgaagaaatgggtttcaaggttgatacttcaagtcctttatacaggcgcttccgcttaaaattgttaggtcagtcctatagagttggagagaaaatagggaaccatgtatttgaagacgatcctggggttactcgacagcctaatcctaccgaggaattgtcaggcaaggggaagacccctaaaacagcataccgctgcaagaaatgcaggaggattgtcgcagcacaggacaatgttatcggtcacactcctggtgagggcaactctagctttgagtggcacgacaagaggaaaggccacacacacaacaaggaacaacaagattgttcctctctgtatgtcgagcctctcaagtggatgactccagtagaagatggcgctttggaggggaagctgtcttgtatccactgcggagcacgcttagggtacttcaactggtcagggatccagtgcaactgtggcagctggatcacccctgccttccaaatttccaagagcaaagttgatgtaagcaccatctagaacttctccgcgggctagcagattcgaggagtttgtcagggtgtggtgtaaataccatatcgtctgaaccgtcatgcattggatcacaaggatcaaaagctggaacctgcttcatgtattcacctattgtactctgaaatacaacagcttacaatagaagttttaacacatcatagttaagcagtcgcagatcctaaacgtttactaccttcttttccattgattgtaagtggcaaccttatatatttttagcgttctagggaattcaattgtgtagtgtagtgggatggagttgtgtggagcggcttgcaaggggtagaatgggtgagtggaatgacttgtggtggaatagagaccctgtttc

SEQ ID NO: 5 - DNA, 1522 bp, Hordeum vulgare
acgtcgacacctaatctcatcccaccttctcctcccccacctccttctatctatccatcttcttcctccgcccccacgcaggccggcgcgacccagctcccgcaatctccccgatcgtttctcgccgccccctcgctcgattctcggaggccagcgacccctgggcggcggcgcgcgtgcggattggattccttcccagtaccgtgagttcttcaaccagaactgtctgcaacagatagcatcctgattgctatggaaggtgggggaatggaccaggtttgcatggctgccatgaccaaccaaccttcagtatctgataacaagctgatgaagaacatcagcggggagatgcctgcaacagcaacggctggaagcggctcctttgactgcaacatctgcctcgacttcgctgcagatccagtcgttaccctttgtggccatctgtactgctggccttgcatctacgagtggctgcggccatcggtggtatcagctaccagcggcaacaacacttcagcaaggcagcagtgccccgtgtgcaaggccgcactatctgctgacagccttgtgccactctatggccgtggtggtagctcaaagaaatcattggatggtacggccattcctagacggccaacggtgcaccgggagaatgttgcgcagcagcacgcgcaaaccagcatcgatgacctgcaccaccagaacatggagcccagccctccgctccggccactgcggcatgcacaccaccaccaccaccctggtgccaccgagttcgactttgtgtaccctccttcaccaatggggcgtggcttgatccattccacggctggaggggtgctaggagggatggcggaggcggtgcttccgtgggcgtttcgtgggcaggtgccgccgagcatgtactacacaagcccctacgctgtcgcggaccacactgtgggtccccggctaaggaggcagcagatggaggtggagaggtccctgcaccagatctggttcttcctctttgtgtttgtggtgttgtgtctgctcttgttctgaagaaagactagaggggcccttgtgaagaggcggtatacggcttgtgtatatattggaaggcatgatatactgcttctcgaggaaaaagaaggcaagatactgatgaatgggtgttgcttatatagtgatgaagagagggtaaggaatggttgatgctgttaagtgttaacggtctctatcaataagcatgcgggtaaatcatgcttgtaatatgaagacttggaggtgaaatgcaattctcattcttgtcttgcctaagtcatgaactccattacaacccatgtatggtctgtttggttttgcccgcatctgtgaccaccatgtaatgcaattttttcctctcaaatgtgcatctggaatctgcactattctcttcttttataggcgatgtgcatctgtctgcactttttttggtcacgttttaagcacatctcaaaatgcacatttgtcgaattgcaacggaatgacctcgaagccc

SEQ ID NO: 6 - DNA, 1524 bp, Hordeum vulgare
aaaggatgaagctctgaaggtacatagcaaaacatggctcctctgactcccagacttgtggtgcccatagatgtgaagaagaagccatgggagcagaaggttcgtctccataaccgctggcatccggatattcctcctgttgctgatgtaaccgaaggggaattattccgtgttgagatggtcgattggactggaggacgagttagagatgatgactctgcagatgatatcaaatttctggacctcacaattactcattatctcagtggcccccttagaatagttgatgctgaaggggttccagcttcacctggtgatcttctcgcggtagagatctgcaacctcggtccgctccctggtgacgagtggggttatactggaatattcgaaagggagaatggaggcgggttcttaaccgaccacttcccaagtgcaagaaaagccatttggtattttgaaggaatttatgcatactcgcctcagataccaggtgttcggtttccgggattaactcatcctggtatagtgggaactgcaccatcagctgagcttcttaatatatggaacgaaagggaaagaaaattggccgagacaggtcacgagtctctgaaattgtgcgaagttctacatcagagaccccttgctaacttaccaacctctgacaactgcttacttggaaagattcaagaagggactgctgaatggcaaaaaattgcaaatgaagcagcaagaactattcctggaagagagaatggggggaactgtgacataaagaatctaagcagaggttccaaagtttatctaccagtatttgttgatggagcaaatctgagtactggtgatatgcacttctcccaaggtgatggtgaagtctcattttgcggagcaatagaaatgagtggattccttgagctaaagtgtgagatcataagaggtgggatgaaggaatacttgactcctgttggtccaacagcacttcatgtgaatcctatctttgagataggtcctgtggagccacgtttctcagaatggttagtctttgagggcatcagtgtagatgagtcggggaaacagcatttccttgatgcatcagttgcatacaagcgtgcagttctcaatgccattgagtatctttccagatttgggtactccaaggagcaggtctatcttttactgtcatgctgtccatgtgagggtaggatatctggaatagtagacgcccctaatgcagtggcgacgcttgcgattcctacagcaatattcgaccaggatataaagccaaaacgcctggggcatggaccaaaattgagaagacttccggatgttctgcgatgaagttgcagtggacaccttcctgtaacacaagaccaaatatcatgtttagaatatctaataataaatctaaataatcatctttagtattcccacaaccatctatgtatgtgcaacatggaatgtggacccgtagttgtaatatgggctttcctgtttctccatacttgataatttatatatcagacaatc

SEQ ID NO: 7 - DNA, 2314 bp, Hordeum vulgare
cgcctctcccttctccgccttgtctctgctcctctccgctccgcgaccgcgaccgccgccccccggcgccgacgttctcgccctacttccccggcctctccccgcacaccagcacaggccacggcgacgagagaaggtaccgctcgacaccgacagacaggcgggtccaacacgtggtgtgggcgccccacgtcagggtgacttccgcactcgtttctgcgtgcggttgaagtcacccgattccgcccgcgactcctcccgtccctcctggtgtggagtccaggtcggactcaccgcgcctccgattcgatcccctcacgccggggttcaccaggaatccaagcttggagagaagggcggaggaattcttctgcatacacatagcttcggaatcacgcaaccgcgacaacgtccggagctaagcccgagttactgctgcggcatgaagcccaaggttgccggcgccgccgccgccggcgagaagggccgcggggtggacccgtcgctgccgcggttcaagtgccaggaatgccaccgggcgctcgtcgtcgtcggcgtggagtcattccccgataggttgcccgctcacgccaactctggtatgcatgcatcttctgttcagggcagcattatgggggcgagcaggatggacagttcttacgttgtgttgtccaagcagaacagacctcaaggccctggtattcccccacggccacctagtgcagcagcccggcatgtcgagcctaaccaatcaacaagagcaatggaggggtcatatataatgcttccacctgccgctgcttccatatacaagacatctacctccgaaggaggtggcgcacatctgtcgcctccaaatcttaactctactagcccttcaccaggcaacaattctggatttcactctagtgtgactgtcttaaagcgggcatttgagattgctagttcacaaactcaggttgagcagccactctgtctggaatgtatgagggtgctatctgataagatggacaaggagattgaggatgtaaatactgatatcaaagcttatgatgcatgtcttcaacgcttggagcaggaatcctacaacatccttagtgaaactgatttcctcaaggagaaagaaaagatagaggaagaagaaaagaaactaaaagctgctattgaagaagcagaaaagcagtattcagaagttagctctgagatgaaggatcttgaaacaaagtctaaacaatttgaagaattagaagagcggtattggcatgaattcaacagcttccagtttcagctgacatctcaccaggaagaaagagatgcggttatggccaagatagaagtttcccaggtccacctggaattgttaaagcgcacaaatgttctcaatgatgcattctatatttcacatgatggagtgattggaacaataaacagcttccgtctcggtcgtctgcctaatgtacaggttgagtgggatgagataaatgctgcctggggtcaggctgctcttctgttacacacgatggctcagtacttcccgaaatttcaataccggatcaagattcaccctatgggaagctacccaagagtaacagacatcaacagtaatacctacgaactgtttggtcctgtgaatttgttctggagcacccgatttgacaaagccatgacatggtttctcacttgccttcaagagttctctgagtttgccataagtttggataaagagaacaatgttccagctgaaaagtcactgaagcttccctacaagattgatggtgacaaagtagggagctacacaatcttcttaagttttaataaactggagaactggacaaaggctctaaaatatatgctttgcaacctgaagtgggttctctactggtttattggcaatacaagtttcgcgcctccatctgcatctttgtacttggcgcagtctccaaacaagaagggttgatgtgattgtagctgcatgctgaccaatcacaatacaatatgaaatttatgtacataaacaccaggcgtagctagtttccttgttgcttgcaagttatctgcccattgtatataaatatggacttgagtgggtttcattagtatgtagtactacagagtgcagagaaattggaatgacaagaagaatgcagcgttgtttgcatattttctcattttctattgaatcggattctaaaatcattgcttaaagtggaaacccgcataaaagaggactccacttatagacattaaggatattatagtatagatctagcctggctccaccctccttaatgcatatatactttgaaagttccat

SEQ ID NO: 8 - DNA, 967 bp, Hordeum vulgare
actcgtcttgagcccgcctgcctcgcccctccctctccccaaacccccaattccgaagccgccgccaagccgaagcgccggacccttcagcgccgccgaactcgccgactgctctcaccaaggctgagatggatacttcagctccttcaccatttgtcaatggagagattctgaagatgtttcttgggcgacgagtgcgcacagtggttcaagtccaacacaatgaaggtggagttcttcttgggctgtccactgatgggcatcagttgactatcagaggtgctcctggtgcccctgagccaccacactacatcgaggttattgggatcgctgatagcagcctgtcaatccgtgctgaatcttgcactgattttggtgaaaactttgatggtgtggcattcaacgggctatgcaagcttgcaaacgacaagtacaagtacatgttcctgtagaatttggcatcacatagaagacgtttgggaaatcaaacatgcttgggatgatgtgtttactgctttaagatctgttcaaatgttacttcaatcacatcagtaacctgttacttagggtcaactttgtgcacttatcaggacatgttaacctaatctatgtagctgtatgagggcaagtgtgtgtttgccccttgcagttggagagcttattgcttttgctgcttctaagcaaagtaaaccaagctttatgttactatcacatggatttggatcctagaaggttacacttgtgtgtgatgatcctgtatgcaccttgatgatttctgatgaatccttcaaagtagtccagactacctgtaagctgattgctttggtggaaaatatgtcccttgatcaaacaggtactgttgaacgcgttgaccctttgtgaactactgtactgaatgtctgaaaccaccagatttgtgctctgtgaagcagagagccttctatttgaaagttttatggtttagatc

SEQ ID NO: 9 - DNA, 1802 bp, Hordeum vulgare
cggttagcgttttcattttggcgcgcgtctggtctcgtctctcccatccccttccctctccccagaaagaccaaaacaccccccaaaatccgcgggcggcgcactggcggcaagttgagcggcggccatggacgaggggctggtgtccgtggacaagttcagcggcggcagccaggtctacttcctcacgcacctccacctggaccacacgcggggcctcggcgcgtcgggcggctggcgccacggcccgctctactgctccccggccacggcgcgcctcctccccatccgcttcccgggggtcgacgcctccctcctccgccccgtcgccgccggcgcctccgcctcgctctccctctcctcccccaactccgggcgccccgtctccatccacgtcaccgccctccccgccctccactgccccggctcgctcatgttcctcttccgcagcgatatcggatgcatgctgtacaccggggatttcaggtgggagttggggtgcgacaaggcgcggtccgcgaagaaggcgctactcgacgcgctcgccggggataccgtcgacgtgctctacctggacaacacctactgccacccgtcgctgaacttccctccgcgccacgtcgtcgctcagcagatagttgacattattcgtgctcatcctgatcatgaatttattcttggcattgacactcttggcaaagaagacctcttgctttatatagccagagcactacaaacgaagatatgggtctggccccagcgcctactgacaatacaccttctaggcattgataacaatgaagagatcttcaccacccagaccagcttgaccaggatccgggctgtaccaagatacgccctgagcattgagagtcttgaagctttgaacacagtatgtccaactataggaatcatgccttcaggcagcccttggctatggagaaacagtgagggaaaggctaagttcagtgataaagcaccagcaaagtctagcagatgcaaagggcgagggcggggcgctggcgcaatagagatgaactatgatcccttgtcaccaccaaagctatttgagaaggactcctacactctgccatactccgaccatgcttgttttttggagctagaggattttatgcagacagtgcgcccgtcagcagtcgtagggatcgtccgcacgtcatactgttacgtgaatcctcgtggtcacttcggccatctctgtgcagacgaagacgaagcgtgcactgacaatacgcccaagcagagctataatgatgaaaaggaaaactcgccgcctaagagaagaccaagtgctttgaagaccccgaggagaaggatggtcaagatctccagtccaacgctgtacagaagcagagctataatgatgaaaaggaggcattcctgtggtgcaaagattgaagaacccgaagaaaccatccctttctcttgagttatctcccctcccaagtagattttatcttagtcctgcaaaatgatcgacagcagctggatgtagaacctatgatcgtccctcgagttatctcccctccccgagtaaattctatctcgctcctgcaaaaagatcgacagcagctggatgaagaacctgtcatcgtccctcgagttatttctccaagtaaattttattctgctcctgtaaagtttaacaactggataggaagagcctgtgtgcgacctacctccctttgagttattttcacaagtaaaatttgtttagctcgtgtaataattaacagatggactgtggaagcaagtgggctaggaagtgttctgatactctt

SEQ ID NO: 10 - DNA, 1177 bp, Hordeum vulgare
ctcgactccaccaaccaaccaaccagccaagcaacgaagccagattagaatagcggcgccgatgggctggactagttggcgccatccgcgtgcgccaccaccaaccgccccctgccaccacgccgcgccatgctctccctcgcccgccgcccgctctccgccgccgtccccgccggcaacctcctcggcatccacctcttccagtgccccgacgcggtgggcatcgtggccaagctgtccgagtgcatcgcctcccgcggcggcaacatccacagcgtcgacgtcttcgtccccgacgacgcccccgtcttctacgcccgcagtgagttcacctacaacccaaggctatggccacgcgacgtgcttcgcaccgacttcctccatctctcggactgcttcaatgcgcagaaatccaccgtgcgtgtacctgacattgaccccaagtacaagattgcagtcctcgcttcgaagcaggaccattgtttgtttgacttgctgcatagatggcaagaaggcaggcttccagttgacattcattgtgtgataagcaaccatgatcggcctgtagataatcatgtaatgcgtttcctccagaggcacgaaatcccctatcattacttaccaacgacttctgggaataaaagagaacaagagatattggaattgattgaaggtacagattttgtcgtgctggcaagatatatgcaggtaatgtctgaaagctttcttaaagcatatggaaaagatattatcaatattcaccatggccttcttccctcgttcaaaggaggaagtccttctagacaggccttcaatgctggggtgaagttgattggtgcaactagccattttgttactccggaacttgatgctgggccaatcattgagcagatggttgagcgagtttctcacagagacacgttacatagctttgttgtgaagtccgagaaccttgagaagcagtgcctagcagaagctatcaagtcatactgcgagctccgtgtgctaccatatgaagtgatgaagactgttgtgttttgaatttcttttaatggttattatgatgtgtattcttttccaaaattagcagtacattattcttttattaatatattcacgttgagccattaggtgtatcttaacctgggttgaggttacgagaataatcaagcaatat

SEQ ID NO: 11 - DNA, 2204 bp, Hordeum vulgare
gagacgccacacgagctcgactctcgccaaacccaacccccacacacacgaacacgcggccatgtaccgggcggcggcggcggccatttcgcggtcctcctcctcggcgctgcgcaggcatctcgcgcgcggcggcggcggcggcggggagcagcggcagtgggcgcgcgggtatgcggcgaaggaggtcaccttcggcgtcggcgcgcgcgccgccatgctgcggggcgtcaacgacctcgccgacgccgtcaaggtcaccatgggccccaagggccgcaatgtggttatcgagagaccgaacagatcccccaaggtcaccaaggacggggtcacggttgccaagagcatagagttcgaggacagcgccaagaacgttggggcgagcctggtgaagcaggtcgctgatgccactaacaaggccgcaggagatggtaccacttgtgcaactgtgcttacacaggcaattctcacggaaggatgcaaggctgtggcagcaggggtcaatgttatggatttgcggaatggcataaacaaggctataagcgctgtcactgctcaccttaaaagtaaagcatggatgattgattccccagatgaaataaatcaggtagctacaatttccgcaaatggcgaaaaggaaattggagatctgatatcaaaagctatgggaatagttggaaaggatggcgtcattactattgctgatggcaaaacgttggataatgagcttgaagcagtccagggaatgaagttgactagaggctacatatcaccttactttgtaactgatcagaagactcagaaatgtgagttgaaaaatcctttgattcttattcacgacaagaaaatctcaagcatgaattcacttcttccagcattgcaaatttccatccagaacaacagaccccttctcatttttgctgaggatgtagaaggagaagctctatcaatgcttgtactgaacaagcatcgtgctggactcaagatatgtgctgtcaaagctcctggatttggtgaaaacagaagggcaaatctggatgatatggctattttaacaggagggcaggttattagcgaggaacaaggtcttgatcttgataaagttgaactacaaatgctcggcacagctaagaaggttactgtatctcttgatgatactatcattctagatggtggaggtgaaaggcaacagatagaagagaggtgtcagcagcttcgagaatcactcgagaacaacaccgccatgttcgacaaagaaaaggctcaagagcgtttatcaaagttatctggaggcgttgctgttctcaagattggtggagctagtgaagctgaagttggtgagaaaaaagacagggtaacagatgctctaaatgctgcaagggctgctgtggaggagggtattgttccaggtggtggagttgccctattatatgccgccaaggagctcgaccagattagcacgtcgcatgaggatgaaaggattggagttcaaattatcaagaatgctttgaaggcccccctgatgaccatagctgcaaatgctggtgttgatggtgctatagttattgggaagctactggaacaagacaatcttagtttgggctatgatgcagcaaaaggggagtatgttgacatgatcaaggctggtatcatcgaccctgtgaaggtgatccgaactgcacttcaagatgcggcaagcgtttctctgctgatgacaaccacagaggccgcagtcgctgagctcccgtcgacaaaggccagaatcgccagtcgaatgccggacatgagcggaatgggcttctgaggacagtgcggcatgctgtctcatttacctgtttttggttaaagacatgagaaacgtaacttccccggcctatacatgaatggaaattcccctccctatcaagtgagatgagaggtgcaaagctggcacctattttggttttcgaaaaactcacggttcagtgctgatgtaaccttaactagatttagagccctttcattttgggtcgaaattcgagtaggctcagacaagacaagcattatcttggctttgaatgttaactgggcaacgtctggtgttattgaggtgcttcttttgatgagtgcaatttgcgttttcatggtggcctcaagacattgcctatcgttggctgcacgctacatgcttgtagtgttgatcaccatctcaaccttgtcca

SEQ ID NO: 12 - DNA, 1548 bp, Hordeum vulgare
gtcacactcgcactccacaagacactccctcctccgcggctcattcacaccaccccaccccaccccacggtcgatcgaggtgcagaggcatgaggggttcacggtggtgctgctgctgcttcggccgaggcggcggcggggccgggcggtcggggagcgtggccgacgacgggctggtgtgggacgtgggcctcaaggcgcacgcctccggcgagtactccgtcgccgtggcccaggccaacgaggcgctcgaggaccaggcgcaggtgctcgtctcccccgcctccacgctcgtcggcgtctacgacggccacggcggccccgacgccgcccgcttcgtcaacgcgcgcctcttctccctcatccaagagttggcgtcccagagcgggggcctctcggcgcaggtgatcaagagggccttcggcgccacggaggaggagttcatgggcatggtggagaagtcgtggccgtcgcagccgcggctcatgtccgtcggctcctgctgcctggtgggcgccatcgaggacggcacgctccacgtcgccaacctcggcgactcgcgcgccgtgctgggccgcctcgccagcaccgccgggaagaagcgccgggcccgggcggtggtggcggagcggctgtcgcgggaccacaacgtggccgacgaggaggtgcggcgggaggtcgccgaggcgcacccggacgacccgcacatcgtgatgagcagccacggcgtgtggcggatcaaggggatcatccaggtgtcccgctccatcggggacgcctacctgaagcggcccgacctgtgcagcccggcggtgatgcagtcgctctgcccgttcccgctgcgccgcccggtcatgagcgccgtgccgtcggtcacctcccgcaggctgcgccccggcgaccagttcatcatcttcgcgtccgacgggctgtgggagcagctcagcgacgacgccgccgtgggcatcgtgtcccgcagcccgaggaagggcgtggcgatgcgcctcgtgcgggccgcgcagctggaggccgccaggaagaaggacatgaggtacgagagcatcgcggccatcgagaagggccggagaaggcgcttccacgacgacatcaccgtcgtcgtgctcttcctcgacaacaggtgcgagggcacgccgcagtccacggtcggggccggcgagatcgacggcacgcgcgcccccgtcgacgtgttctcgctcggccccgacgaccacggggacgacccgaccaggcccgtgctgcgctgatcgttctgccagccggtcagtcggtcagcgacgtggatgctcaccgaaaacgtgctcgcggtgttaattttcagagactttttgctccctgaaacggaagatacgggagcgtgcgttctttgctttctgcatcgaactaagaggattttcatatgttatgtttaattagttgtgtagataattagtgccgtgtcgtgttggtgtgcagagaattaagtggtatactgtactctgtgcttaagcttcttctgtgatcaattcagaggttgctttgcccccctcc

SEQ ID NO: 13 - DNA, 1183 bp, Hordeum vulgare
aattgcaacttgagcgagcacgctccctgtcccatggagccacatcaccctcggcgcgctccgacggcggccatggaacccccgacgcctgcgggggcgaggccggcgatgtcccactcctccgccttcctcctcccctcctccgcaacccccgccggctccggggacgcgtacgcggtcgtcgtcctcaaccagcgcctgccccgcttcgcccctctcctctgggaccgcgcgcaggtgcgggtgtgcgccgacgggggcgctaatcgcgtgttcgacggcatgccggagctgctccccggccacgcccccgacgatgtacgctccagatacaaaccagatgtgatcaaaggggatatggattcagtgcgaccagaagtgaaggaatattattccaatttgggcaccaaaatagttgatcaatcacacgatcaggacaccaccgacttgcacaaatgtgtagcatttatcactgacaagtctcctggcccagacaaatcgaatctatgcatccttgtcctcggagcactgggaggtaggtttgatcacgagatgggaaacatcaatgtactccatctcttcccaaacattaagatcgtcctcctatcagatgattgcctgatctttctgctcccaagaacgcacagtcacaacatccacattgaacggtcagttgagggcccccactgtggattgattcccattggcacgccttcgaccagcaccactaccaccgggctccgatggaatttagataatgctcatatgagctttggtgggttgattagcacatcgaacattgttgatgaggaccaggttatggtcacttcagattctgacctgatctggacaatatctctccgacactgagtttttggatgaattttctcgtcagacaatacttgtatgagctacggtggattgattagcccgtccaacatcgttgatgaggaccaggttatggtcactttagattctgacctgatttggacaatatctctctggcaccgagcttatgctatgcagaacgtttgagatatcgccaattttgtctcgtttaatttatgtctatgacaactacacccagcagtgatgtgataaattttggcgtgttagaatttcaagccttgtaaatttctaatttctaatttggtagctttggcaattaaatatagttgccccc

SEQ ID NO: 14 - DNA, 6171 bp, Hordeum vulgare
agcaagtccagccccgtgagcgagtggcgctcgtctggaaccctcgtcacctcctaatgggaaccctcgtcacctcctaatcccatccgaaattctctctttgtcttaagccaaataaaaaatcagtcctcccgccccttgtgcaattcccgtccccccccgttcgatccagcgctgccgaattagtgccgagcttggagtggtgccggttgaattctgatctggtggcgtgccgcgttggagtgcccctggtttcggaagcggcgagggccatgcaaatcgagtgagcatgaggggtgggagcgctaaaggcctgggtgatgggatcaccggaggggcggctcgttgagctgttgggaacagttaagtcgcggatgccgcggcggggagagcactcgccgccgcctgcgccgaaggctgctgctgccgatgtgccgcagccgcatgacttgtccagagacttctggatgccggaccaaagttgtcgcgtgtgttacgactgcgatgctcagttcaccatccttaatcggcgtcaccactgccgccactgtggccgcgtgttctgtgcccgttgtacggccaattccgtgccccgctcgctgggggacgccacgcgggaggacatcgagcggatcagggtctgcaactactgcttcaagcgctggctggaggaggaggcggtcactccgagggatgtggcgcagccgtcgggcctgtcacattcggccacgagtgcggggagcgaaaaatcatgttccaccgggcgtagcagcacggtgaccagcgaccagatgttgtcttatgcgaatgcctgctgcactgactctgcatcacggtcggtgggcagcgagggcaactgcggcgagctcgatgcttctctggagttgcagcatgctgcgatggagggcgtggagcatgtggcttatgtggacaattcgcctgatccattcaatttctgcttgaataggagtgatgatgaagatgatgactacacaattttccgctctgattcagaagtacaccacctacaaaactctggtgggcctatgtgttttgatgatcatcaagttgtttgcagtgatgctgctaaaggttcagtatcaccaagaaaagatacagcaaccttagttaattctgagggaatgtgtaagactggagatcatcatatcattgataatgctgaggattgcaatgctcgatcttcttcgttgtatggcatggaagtgctagaaaatgaacttgtggattttgaaaacaatagctcactttggctacctcctgaagcggaggatgaagaggacgaccatgatggtgctccatttgatgatgatgagggggaggatgccacaggagaatggggttatctacgctcaaacagcttcagtggacattgtcgaagtcgagataaatccactgaggaacacaagaaagccatgaaagatattgttgatgggcattttcgggcattggtggctcaacttcttcaagctgaaaaggtagaattggctgacaaaattggcaatgagagttggctagatatagttacctctttgtcttgggaagccgcatctcttttgagaccagataccagcaaaggagggcgtatggaccctggaggctatgtaaaggtgaaatgcttggcttgtggccgtccaagtgacagtttggttgtaagaggagttgtttgtaagaagaatgttgctcatcggcgtatgtcaacaaagaaggaaaagccacgaatcctaattcttggtggtgcacttgaatatcagcgtgtatcgaatttgctttcaagttttgatactttactgcagcaggaaacggattatctgaaaatggcagttgtgaagatcaaagcacaccaaccaagtgttgtattggtagagaaatctgtgtctcgttatgctcaggatttatttctggagaaaaacatttcacttgttttaaatatcaaaagaccacttctggaaaggatatcccgttgcactggtgctcatatagttccctcaattgattatctgtcatcccaaaagcttggaaattgtgatttattccatgtggagaagtatattgaagagcatgggactgctggagaaggtgggaagaaaatgctgaagacccttatgttttttgaaggctgtccaaagcccttgggttttacgatcttgctaaaaggagctaatggggatgagttgaaaaaagtgaagcacgttgtgcaatatggagtctttgcagcctatcacttggctcttgaaacatcttttcttgtggatgaaggtgcaaccctaccagaactccctcttaagtcgccaattattgttgctttgccggacaaaccttccagtgctgatagatccatttcaacgatacctattttgcaaatgcctactatttcatcacccaacaacaacctgcaagcatttgatattcaaaaggatgactttacattcagtggttttagaataatggaccaaacggcagcagcatctttccctgataacaaatgctgtgaaagattgggagttacccaagcatcatcagttcaaatcaatgaccaaactggaaacattggctgtttgcttggtatgaaccctcaatcatataatgatcctctggttcagcagttgagaatttcattctgccattgccctgcttgtactagagatgttggtagcaaaatgaaatttgaagaactccagcctgaaaccaatagacatacactggctaatggtttgagtgtgttgcctgctcatcctgcaaatttggtggctgctgaaagtgatctttcatttgcccataacgccaacaatggtgccaaggtagcggctaagccatctgctcctctcaacttacaagtttcttataataatggcagttcaaatgatggttcaatagtaaaaagggatgagattccagcatctcctgccgacaaccagagtatattagtttctctgtcctcacgttctgtttggaaagaagctatctgtgagaggccacaccttcttcgcataaaatattatggtaactttgacaaacctttaggcaggtttttacgtgaccagctatttgatcagagcaaccgttgcctctcttgtgagctggcaccagaggcccatgtttattgctatgttcacccccaaggcagcttaacaatatcagtgcggaaactcatagtgaagttacctggtgaacatgatggtaaaatctggatgtggcatagatgcttacgctgttcgcgcgataaagggctccctccatcaactaaaagagtagtgatgtctgatgctgcctggggcttatcttttggtaaatttttggaacttagtttttcaaatcatgcagcagcaagtagggtagccagctgtggtcattctcttcacagggactgccttcgtttttatggttttggtgaaatggttgcttgcttccgatacgcatcaatcaaggttcactcagtctatttgcctccgccgaaacttgattttacttcccagcatcaggaatgggtagagcaagaagcaaatgaggtggttgattcagctgaactcctgttcactgaagtactgaatgcactccatcaaatttcagagaaaaggccaattacaggctcttttgatggcaatatgaagattcttgagttaagacaaaacatagtagagttggaagatatcctgcaagcagagaaggtcgatttcacggagtcactaaagaatctactgaaaaaggaaatcagaaaggggcagttattcattgatattcttgaggttaacaaactaaggaggcagctactatttctctgttacttgtgggatcaacgcctaagtttcatagcaacctcaggtggcaagtattgcgatgctttgggaggtctacgagttggaagtaataattctgaaatcaatgatagatcagctgatagcgatacaaacacaaagttggtgaagaactcaaagggcaccgattcaaatgcacttcatgctgatgacgaggagatcaaccaacatgatcaatctaatgaaactaactcgagaaatactgaagagttgaatggtgctgaaggtacaatagctaaattaaatcatgcaaacagtgttaatgtcaatgatcatttagatcatcaaggatcaattatcggcgttcgtagggtttcttctgaaggtcagttccgagtagctactgacatttcagataaactggatgcaaaatggagaggtgaggatagacctgctcctgatgcaagcctggtgaaaccactagctctgttagaaggtacagctgcggatgtaaaaaaacaagctaaggcagtaccacggcacacttctgcatctgtcaggtctggggatacagtagaagacttactaagctgccttaaaatgccatacatgacattttataattccttgaacacaaactctggcacagcaccgacattcggtaccttggccgactacaatcctgtatacatttcattgtttcgcgatctatcacagcaaggtggagcaagactttttctgccaactggagctaatgatgttgttatcccggtatttgatgatgaaccgactagtattatttcttatgcactcgtttcacctgtgtatcactttcaaatgtcagtagagagcaatcaaaataaagacagcggagattcttcactttcgttgcctgtttatgattcaggaaattttaacctgttccatttatttgaggattttggatcctctgatgattttgcttcatcgatatcttccagtagagggtcctttgctcgtgatctactgcactccagagtttcttttcaagatggtgggccacttgggaaagttaaatacactgtgacatgctattatgcaaaaaactttgaagaactcagaaggtcttgttgtccatcagagcttgattatttaagatctatcagtcgatgcaagaaatggggagcacaaggtggcaaaagtaatgtgttcttcgcaaaatctctggatgatagatttattataaagcaggtcacgaaaacagagcttgaatcattccttcagttcggcccagattattttaagtatttgtcagagtcagtaagcactggaagccctacatgccttgcaaagattctgggaatctatcaggttacaattaagcatctgaaaggtggcaaggaatcaaaaatggatttgctcgtgatggaaaatctcttatttggacggaatattacgaggctttatgatctcaagggatcttcaaggtcacggtataatgcagactccagcaggaacaaggtccttcttgaccagaacttaattgaggcaatgccaacgtcgccaatttttgtcgggaacaaggcgaagcgccttcttgaaagagctgtttggaatgacacttcttttctagcaggaattgatgtaatggattattccttgcttgtgggtgttgatgaggagaaacatgaacttgtcctgggaataattgatttcatgaggcagtatacatgggacaagcaccttgaaacatgggtcaaatcttctggcattcttggtgggcctaagaatgccgctccaactgttgtctcacctatgcagtacaagaagcggtttaggaaagcaatgtctgcttattttattgtgattcctgagcaatggatgcctgcaataatcaatccagaccaatcatcgtcaaatatttgtgaggacgattctcaaaatgcttcaccagagtagcacggtgttctgtgcgttattaatggacggaggttgctggatttggtcctactgcagtcatgagaaatactgacctgatgagttttggtactcgggcggcactgaaatgatcttctggctggacagtttatactcttgtggtcatttgcacagatcagatcgcactagtcgatttccatctaataagaaaacgcatcacatgtgtatattcttgcgactgcaattgtgattagtttttcctgtgttacccatatggtacatatatcaagtgtaagtgccttctcgtttcttgtaggtggttttcattttggctagatgtaactacatggatttgggcctttttcttttgtataagtggttgttgtgtgtctgttgatttttagaggggctatcgccgtctgtggtgtatataacaaaataaaagttgagctcgtgctaatacccgtgtcaagattcctat

SEQ ID NO: 15 - DNA, 1477 bp, Hordeum vulgare
ggaaggaaagcagcagcagaagtcgacgcctgcgttgggtgccgctgccactgtgctccagcattttttgttggttcttggtcttggattcttccgtctgcgataggaggttgctggttagtcgttcgtttgcttgttgggtgggtggctgatccgggatggaccgcctgctgctgccggtgagggtgaaggaggagtggccgccgccgccgcctccggaggaggaggaggaggagttggaggagcaccggggcctggcgccgcggccgatggtggggctgcacgagacggggccgccgccgttcctgaccaagacgttcgacctggtggccgacccggccaccgacggcgtcgtctcctggggccgcggcgggaacagcttcgtcgtctgggacccgcacctcttcgccgccgtgctgctcccgcgcttcttcaagcacagcaacttctccagcttcgtccgccagctcaacacctacggttttagaaagatcgatccagacagatgggagtttgcgaatgagggtttcattaggggccagagacagctcctaaagatgataaagagaaggagaccattgtcttatctcccttcatcacagcagcaggcccttggctcctgcctcgaggtcggccagttcggattcgacgatgaaatcgaagtgctaaagcgcgacaagaacgccttactctcagaggtggtgaaactgaggcaggagcagcagagcacgagagctgacatgcgagccatggaggagaggctacaccgggcggagcagaagcagctccagatgatgggtttcctggcaagagcaatacagaaccctgacttctttctccagcttgtccagcaacaagataaactgaaggacctcgaggacccttacccaacgaagaggaggaggtccatcaacgtaatgccgttccttggccctgaggggacgagtcagagtgagcaactcgagtccacattcatttttgaggacagggaattttcagagctggagaatttagcaatgaacattcaagggatcaggaagggcatggaggatgacaaaggtggtcggagtcagggctgcggtgaggccgagctgactgatgacttctgggaggagctgctgagtgaaggaatgagggatgaggctgagatgctagagctggaaaggaggagatctagatatgtcgacgcgtagcgcgaaagctgggtcgtctaagtaacaacgatccaaactctaccagaattcataaccatttaatctgtataccattgtattgatagctgtattgtatattgtagtgctaatttatagtcatagtctcatagactgattgtattgcggttccacaccgattatgtggtatatatctagtggtataaaaactgtccctggattcacgtcgacagttttttactctgatgatcttagttcatcctcacgcctgctgaatgaatggtttttctggatttggaacctgc

SEQ ID NO: 16 - DNA, 1239 bp, Hordeum vulgare
gattccgaatcccatttctccaacccaatcactcctcccccctcccactcctcacccacggcgaggagacggacaggcccgccgctgctgcaccgtccggcaggggttgccttgatcccttcctccactatcgatgggggacattgccaaggacttgacagccggaaccgtcggagggatcgctaatctggttgttggccacccatttgacaccatcaaggtcaagctccagagccagcccagccctgctccaggccagctacctaagtatgcgggcgcctttgatgctgtcaagcaaacagttgcggctgaagggccgaggggattgtataagggaatgggggctcctctcgctaccgtcgcagccttcaacgctctcctgttcactgtgaggggccaaatggaggctctcttgagatcggagcctggggtgccattgacagttaagcagcaggttgtcgctggtgctggtgccgggcttgcggtctccttcctggcatgcccaacagagctgattaagtgcaggttgcaggcccagagctctttagctgaagcaggtgctgtctccggcgtggcgcttcccaaagggccaatggatgtggcaaggcatgtcataagggacgccggcttcaaaggactgttcaagggcatcgtcccgacaatgggccgtgagatccccggcaacgccataatgttcggtgtgtacgaggccgtcaagcagtacatggccggcggccgggacacgtcaggcctcggccagggctctctcatcctcgccggggggctcgccggaggggcgctgtggctcacggtgtacccgaccgacgtcgtcaagagcgtgatccaggtggacgactacaagaagccgaggtactccgggtcgatcgacgcggtcaagaagatcgtcgcggccgacggggtcaagggcctgtacaaggggttcggccccgccatggcccgcagcgtcccggcaaatgccgccaccttcgtggcctacgagatcacgcggtcggccatgggctgactgacccaaggtcctggcgccgccctccgtttcttctccgacgcggctgaagcggcattaagcggagcaactgagacagaattgggatccatggcagacaaaagaaaggaaaaattaaccattcttctttgctgcgacattgtttctcagaacctcgcatagactggcagcaatggcaggatcgttggtgataataaaggttgagctttacctgt

SEQ ID NO: 17 - DNA, 1564 bp, Hordeum vulgare
ctcctaaacctcctccgctcttctccccccagccgcctcgccgccgcccgccgtccgccgcccgccgcccgcgatggaggccctccacgaggagacgcccttcgacctctccttccacccctcgtcgcccctggtcgccacctccctcatcaccggcgagctccacatgttccgctacgccgacggtctgccgctcgagaggttgttcgcagaaaaaccccacaaggactcatgcagggctgttcgatttgtggactcgggaactgtgattctgacggggtctgctgatatgtcgattgtcgcttctgatgtagaaacaggcaaagtcattgcccgtttggatgatgcacatggtgacgccataaaccgccttgtgtgtcttactgaaactacagttgcttcaggcgatgatgcgggttgcattaaggtgtgggatactcgacaacgatcttgctgcaacacttttcaccgccatgaagattatatatcagatatgacctatgtagctggctcagatcaaatattggccacaagtggtgatggaactttatctgttaacagtctccggggtaacagagtaaaatcgcaatctgaattttcagaagacgaactcctatctttggtgataatgaagaatggccaaaaagttgtttgtggaactccaagtggagccctgttgttgtattcgtggggacattttaaggactgcagtgaccgttttctggggcacgcacagtctgttgataacttgctgaagctggacgaagaaactctgatatctgctgcagcagatggcgtgatcaggttggtgggtatcctaccgaatcagataatccagccattggccgagcattcagaatttccgatcgaggcgcttggtttctcgcatgataggaagtatctaggcagcgtttcgcatgacaaaatgataaagctctgggacatggaagaactcctgggcggcccgcagttgaatcatcagaacgacatgccggaagccactgcggtcgccgttgaccacgacgacgagctgcctgaagccaacgccgccaacgctgtccaacacgaggagttgcctgaagccaacgttgccgccgtcgatgacgaccagttgacggctcaggccgacagcgacgacgatgggatggacgtggacatggagccgagctcttccaacgggtcgaggagcaagaagaaaggcaagggcaagaagctgaacggattcgcgccggacttctttgcggatttgtagggcgggcagacgcaccgccgggcaagaagctgaacggattcgcgccggacttctttgcggatttgtagggcgggcagacgcaccgcccttgaaattcgcgtcgggttgactttgcgaggtttcgatgtttaggttgaagcatttttgggtcgtcgtaggaggtggggaggaatctctagtttttagtggtgaggtgtgtttaaggtgtggcggtgagtgaactggatatgccgtagtaacgtgtactctactttaaaaaaaataaaatcaaacgtgtactctacttgggatgcaaatgacccgtgaaccgtt

SEQ ID NO: 18 - DNA, 2392 bp, Hordeum vulgare
caaccagcaccccagcagcgcgcgcggggcaatggcggaccccgtcgagctcgtgcgccgcctctgcctccgtttcccgccgcggctgccgcctccgcggcgctccagggtgccgccgccacagtcgcgatgcctcgtcagggctcgcctccgcctccagcgctctcccctgtcgctccggtgccgcgcgctcgacgccagcaagtcgtcggcggtcaagggggagccgagcgaggagtacgacgatgatgacgaggagccgtacttttccgtgacatcgtcgaggctgtcagaggtggactacctcggggagagcaccaagggggatttgaacgtgcgcaggaggcacctcgatgcgctcggtgggaatggaaagtcaacattgcatggtcctatagaggagatagcttggaaagaagcaagacaagctgaaacgttgctcagtgacctgggaattgcagatcctttaacagtaaggaactctcctcgtggaattttctgcaccagaacactaaatcttcgatctatcagtgtcattggctatgacatggattatacattgattcattacaacgtcatggcctgggaagggcgggcatatgattatgggatggccaacctgaagagcatgggttttctagtagatgaccttgaatttgatcctgacctggttattaggggtcttattatggataaagtaaaaggaaacttggtaaaagctgaccgttttgggtacatcaagagggtcatgcatggtacccaaatgttgcccactcgtgctgtgagtgaaatatatggacgagagttggtggacctgcggaaagaagatacgtgggagttcctcaatacccttttctctgtttcagaagctgtcatgttcatgcagatggttgacaagttggatcaggggttggtgcctgctgaacttgggccactggattacaaagggctgtacaatgctgtttccaaagcactctttcgagcacatgtagaaggtcaactcaagagcgaaataatggctgagcccgagcgatttgtagagcctgatccagaactgcctctagctcttctagatcaaaaagaggctggaaagaggttacttcttattactaactcagattaccactatacaaacaaaatgatgaatcatgcattcaatcgctttcttcctaatgatatgggatggagagatctatttgaaatggttatagtctccgcaaggaaaccagagtttttccaaatttcgcatcccttgtatcaagttgtcactgacgatggattattgcgtccctgttttaaagcaaattcaggtggcctgtactctggtggttgtgctcagatggttgagaagtcactagatattcatggagatgaaatattatatgtgggggaccatatttttacagatgtcagccaatcaaaggttcatttacgatggaggacagcattaatatgccgtgaactggaagatgagtttgacgcactaatccaaagccatggtcagaaagaaaagcttgtcacgctcatacagcaaaaggaaattgtcggagaccttttcaaccaacttcgcctggctcttcagagacgcataaattcacgtcctgcacagacgcttgctgcaacttgtatgaatgaccaggagcttacagaaagtatgcaaaagttgctcattgttatgcagagattggatgaaaagatcgtgccattgctggaatcagatggagaacttttcaataaaagatggggttggctgtcacgtgctggcctatgggacaagagtcatctaaccaggcaaattgagaaatatgctgatatatacacatcaagggtctcaaactttctacactatactccattcatgtatttccgatcacaagaacagacgcttgcacacgatgtccattcttattctcgcggtcaataatattggtgccaacgggctccctctatgtgagtcacgcgtggagacgaagtgatggaaagaagaagaattgcaagggaactgatcatgactgtgtggccgtagttgctgggctgcaacaagctcctggatacagtgcaagctctgctgatttaggagatgttgccacgtgtaagtaatttttatggcctcgtgcatgtataggtaaagccattagctagttgtaagtttttacacgattagattcctacagtaggcgatgaccgtagtcgtttgttttggtttagttttatttggttgggaataagaatgatgaccagtgtgatttttagcggatcatgtgaagtgttacagtggagatccggcaaattatgcaacatattttgtgcaaaacatatgtataaagacgattgaatctctattcatggatgaaatatttatttctcgttgcaagcctatgttttccatgcc

SEQ ID NO: 19 - DNA, 1968 bp, Hordeum vulgare
cgatccgtcggttccccgcggacgcgcttccctcgccgccgaccggtggctcgtctgatcggagcgcgcggcagccgttagggacggcggagagaagcgcggagtcgatctgagagagagggaggggcgaaccccttcgtgctcccgtcggtttcgatctgttcgtcgggtgcagatccggaagggcttggttcgatctgccgcttacgaccgggcgccatggagactctggtcatctcgcagcagcgcagccaccaccaccaccactctggtcgccggaggaagccatccccgcactactcgtcgcctcagcccatgcgtggctaccacgccttcaactgccgtgccttccactccagtatcagcatcggcatcctgccgtccccacccccacccccagccccgcctgcaccccgggctcggacctactccccggagcccaagacgcccaagcagcagctgcacaacggcaaaaagcgcagccgggcgatccctataactccatcaggatctcctccttcccgtcctgagctttgggctggcccggcatactccaactcgccgccacccagctcactgccgattcccaagttctcgctccaccagaagcgcagtgtatcacttgagttgccacctgctgacaggacagagcatgtggaggtgcttgtgcatgccaagtcagcaccttcgacacccactgctggctcaggatttggcttctttggtgagaatgatactgccattgccacggagaatctgaggaggatccttaatttggaaatcaccgaggactgaatgatcggggcatcaccgtgtacataggtcatcagcaactaaccttgggttctttgtataaagtaacttagaatagcagctttccacctagattctgcatcaataggagtactgttaggttggttagcaagcacatcatgactcacgggaagctgccgtgaaggatgtggtggtggagactgtggggtggacgagagcacagcagtttcagagtcaccttgtagcttgtggtcacctatatggtcctgacttaggtatttgttctttaggtgttagatcttcgtttccatccatggtcagtgatccattagtggttggtagtctgcatgatcctagctagtaggaaactgcatcaggcaggggtagggtggtaagttctgttctactgttagatgactggagtttacactccggcatctgttcccatgttatattctgtaggatatctgcatcttatattcttccaatacatacagtctgcctcaccatcttgacactcttctaatcacaccgacttccctggtgctctgcaaagaacacaaggatatctcctcactggctcttctgtattttttggaatgaagaggccagtgtaggttcaagaagcccccccttcgacgccctttctccctcatgtgtctactaactttgatctgtgcacctctccccccaccatagtttgttgcatatgtagtcaaatcccctcccctgccatccaatcttcattccatgcatatataatccaaagttccatccagtagcagggatgcatttgttccagcaccctgtgtagttcctggtccttgttcatgttcatggaacatgtggaggatacgagttccgttggtatgcgagactccatttcagagacctgcgagcagacaaaccataatacggttggcttctccagtgcacttcatgacgcacatacctttggtgttcagagccgagtttccaataaatctagttgcttgtttcctttgtagttaatgagcagcgcagcttaagctagactgtttccttatatgtaatgtctgcttggcttgttgtttaaaccttggaactagtggtgttccaccttattagcagatgttgctgctttctttgttagcttcatgtgtttgagcgcataaatgcaagactttcatattggtgctaaattctgtgcggtga

SEQ ID NO: 20 - DNA, 1262 bp, Hordeum vulgare
cactctttgagcttactctcctagcccgttcgcccacccgccggatcccgtcgaaccaaaccctatcccgcccgggacggctcgccgtcgtcgccatgccccgccgcagccagagcagtgaccccatcgacctcgacgaagaggatgagtgcaagagcaagcgttctcgagcgagtataaggcgagcaccgaagatgcctgggagctcaaatcgcattgcaagtagcagaagggacaaggaaaatcaagacaaactggatacccgtatctttgatttatacatggaggacctttggaagcgtacagatgaagatcagaagaatgcttacgcatatttggatccgttatggtttaacagttatgtcaatgggggcaatgaacagaaatcaagaattcttagatggacaaagaaactgaaaatattttcaaggaaatatgtgtttgtccctattgttctttggggacattggaacctccttgtcctatgccactttgatgagacagactgctcggatgcaaaaaaaggaccgcgaatgctgctgctggattcacttaacacaacagatccaaagaggctgggacctgatatcagaggattcattcgtggtatttatgaaatcgaagagcggaaagaaagcgcgcacttcatagaaaaaatccgtctcgagtttcctaaggtgccacaacaaaatggggaggaatgtggtatatatgttctttactttatcaactgttttcttcaaaacggaaaattggcagaagttcttcagaataaaacactggaagaagatttcaaacagctgtttgatgatggcacgtttgatccagaggaactagagaacttccgcaaggatgttcatgcattccaagtagaaaggagtaccgaaaccggacagtaggtggactgtagcattgtgctgcatatatgtagttagttcttacaaggcagtggaaaatttcatcttcgctggtggtgaattctgaggaagcttgaaggtcgtggagaagctggtggtaatatacagcttatgcagccgagagaaagccgacaccatggagctttgtgacagttagcaggtgttgtatgatctgtatcgacattctagaactgttgtgtgtccatcttttgtatgacaccatgagagttatctactttatggactggaatgatctcaatagtctcaacttgttttccctgagtcttaagatagcagcatcacgtacaatgcttgctaggggtgaaaaaacacactcagtttcat

SEQ ID NO: 21 - DNA, 2058 bp, Hordeum vulgare
atccgagccgctcggaaccctagcctagcctaccctcgcccgccccgccatggcaagtcctccttgcccgccgtcgccgctcgccagggtgcggctcgacgacgtggcgccccacgacggcgcggccgccccgggctacgcgcgcgccgtcgccgccctcgccgcctcgctcgcccgccgcggcgccgccgtgctcgagctccccgcggcggacgcggccgtcgtccgctgcgccctcgagtccgcccgcgccttcttccgcggccgccacgccgcctacctctaccgcgccgggaggactttggaagatggagagttgtcccctgcttgcatggctgatgctttcagatgtttgggcaaagcagcccgggccgccctctgtgcaatagcacggcacctgcgcctgcgtaccgatgtattcaaccaattacttgatgatactccactgccggttaacgagatctcctcatctgagttgctggtgtcatattctcacgaacagctccaaagtggtcaggcactcatgggatgtcccagcaggtcctcaatgcctcaagttgataggggatttgtaatgctagttgcttccgattgtccaggaattgaggtttgtgacccaaatggccattggtacatagctgatggggtttcaggcccaaataatctattgcttctgactggaagggccctaaatcatgttactgctggtctctgcccaatttcccactacagggtcaccaatgagaatagggcatcactcacctttaggttggtgcctcatgccaacgccatattggattgctctccaattttagctgctgggcattgcatacgacaggtgtaccaacccatacctgcaagccaatttatggatgattcctgtgccgaagaacatgctgtttccagtcacttggatgaaccttctgaatctcagggcaactttgttagtgacccatcactgagaagtgtcctgtcagaccctctgtctgggtcatttcttgaagatgccatggttctccaatgtgggcactcatttggtggcctcatgctgaagaaagtcattgaaatggctaggtgcaccatttgcaatggagaagttgacccatcctctttgttccctaatctcgctttgagagcagtagccacggtggtgaagatggaggatgataggagactgtttcataacgctgctcttcggaagcgcaggaaagatgtgaccgagcatacagatgtgccaaagcggactgggagtagcaaagacaacaatgagcttgctctggatgctggaagcccggtggcattcaagggagtgcagtacccttttgtagtgggcgagagggtcctgatcatggggaacaaaaggacgcccgataaattcgtcgggaaggaggcagtcatcacttcgcagtgtctgaatggctggtatcttgtgaaggcgctcgacagcggagagagtacgcggctgcagtaccggtcactgaagaaagtgtcggagctgcaactacagacgcaagcgaggctgcagcccctggcatttctcggaggcagatgataagagatggtgatgaaggatcatgtgtgaaccataagtccataaccactacccaaggtgtcggtcaggtagtaagaggaagatatggtggtagtgctgctgtgtgcaagttgtgaatcaatgtatcttgatttcttttctttgtttgtataggtagggcgctcccatgctcccttgttcgaaggcaagatcaatgtaaaagtcgagagtaggaaatgcagtcccgtgcctgcctcagggtatccgacggctggaatagtaagcgacacatgtttgtgcgtccaatctgggtttgtagaagaggaagaatgtgtttgtgtgtgttcttcaaggctgtctccagattgtacaagacctttctgtgaccggacctgtcatgtccacagtgccatggctggctcatttgctagtaggagtattcactaactatgtttgggcaattatatttcggtatgatgacccatcaatgtttttgtttgtttgaatccatgtgaaacatcttaggc

SEQ ID NO: 22 - DNA, 4131 bp, Hordeum vulgare
gctcgagctcaccttatctacatcgtcctcctccgcgggatcctctctccgacgatccgccgcgccaccccttaccccgcctgccacccccaccccatcccaaacccactgacgtacgtcgccgtcgtcaccatccacctcgaccccgtctccccttactcccttctcggctataaagggcgccgcgatggccgccgcgtagccccccgcgcgcgggcagccggatggccgacggcggcgacagggagggcgcgggcgagagctgctggccgacccccgccgccgccgcctccggccacggccgcggcggcggcggggtgctgctgtccgacatcaggagggagatctacgaccgcctgcgggccgtcggcaaccaggaggcgctcgccgaccccttctttgaccgcgtgctcgaggacaactactaacgcctcccgccaaggtccgtcctttccgctcaccccccttccaggcccgcgttttcacctcaccaacacctgtctctctgtttgtttgtctgtgtccgcgcccaccggggatgcagctactacatcgacctcgacgtgagcatggaagccagggatcccccacaattaccgttttgatttggagccagaggtttgtcctgctgaaggtactgcgcaaggaagcagaggagcatgataataccgtaagcgatagtgtgcagggaagatttcatgagtttaatggatggatgaatttacccttaggaatcgggcgtggaagacggggcgattgtcggggtcggcacactcggcgaggatccggcgatggagcagcacgtcctccgccttgttcaccagcgttcctgcgtggcatagttctgtaagaattctcaaaagctcaaaagcgaatgttagaagcctggagaatgagaagactgatggaacgagagcttgacaaaaggtcaaatgattggtcagccaggctggcaagatttcaagccgaacaacagcgactacgggatagagtaatggagctagcagagcagaatgtgtcatttcagagagaagttactttgtttgaatcgaaccgagttgaggcttctaacaagattagaagtttggaactgcaaaacaaacaactgaatgatgagatggacaaagttaaaggtgagcacaccagtctttacagatcctcagtagagttgcatgatagctttacaaaagctgcagaagaaagggaccaaatccaagaatgcttaaaatccaaagaagataacagtagggcactgcacaaggtgattgcaaggttacaaggggcatctaatgagcaggaaaaaacaataaatgggctcaggcaaggatttagtgttgaattaggaaatagatctgttggaagtagcgaaagcatcaccaggatgcaaatggaacttttgagacttactggagttcagcaaaagctgagaaaagaaattcagtcctgtaaccttgaagtagagtctcttcagcaagagaacatagggatttcaaatcgtctacaaagcagtgggaatggattaagtttatcctcacatcgtcttgtcctggaacttcacgctagagtggacaacttgcacatgcaaggcttatcgttacttgaagatactagctgtctttgtggcaagttgttgggcgtcatgaaatcgaagagtgagacaattggcagtgttgatgcactagcagacattgaatacactgtgaagtaccagaacctaagacaaggaatagattatttagcccttagtctgagaaaagttaaatctgtgttggttgaaaaacacaataaagaagacaacatagtgggtgtttctgtgggacatgatacattatatgttattgctgttcttgagtaaagtgtaagttgttcactggtttatcattttgcactagagaatgacatcaagctagtaacattcttttagaactaatatagtaaaatttgtgttaccatgaaatgtgctcgagaaaaatatgttaatttacataatacaaatatattatgaagccaagttgcttaaagaggtactctataacattaaaataccgcataatatttatattggcatggccagctgaaccatggcccactgatgaaactgtaagatggttttactattgtactgagcaaaaaatgttattttaccgaaatagactttttacatggaaaatgatttgtttatatagacatgtgatcagaatatgctttgtttatgtatattctgcaactctgcatttagatttagggttacttggttaatatttttgaaagaaaaatatcactctaagagtatattatccaaaacttcatatcagcgtgttgtcgggtaggcaggaaggcatgaattcaacggcgaaaacttctatcaggatggggtccctctaggcgggaagacatggacccaacagcaaggacatcgattatgatggattcaaccacactgctcgattgctgaatgacataatatggttatgatgtgggttcatggaggtactctagccccaacaaaactatgactcatccaaccttttcgggcaggttcactattcttcaatcatagtgctgcatattcctatttgaatgataggtggtgcatagaattaatgattcagaaaaattattttgtctttgttacgaacaagtctgcaactctcccagatagaaaattatcactaaaagagaacaactattagtcttggtagatgatgtcagattatgtagtgacattgtggtaatctctgtatcctatttcttcctgttatttgtgttattttgcttacacaaaatggtcatttttatctaaaatttcttttgtcaactgcctccaaattaaaaaatcagggtaacatatagaatgtgtatgttccattacccacaactgtaccattatcttctattgaataattggattaataaatttttcataatcttttgttgtagtttgtagaagagcaaagttttaactgcttataacgtgtctccttcttccggtatagttaattacacatgaaggtttgagaaagagctcgttggacggacatttgtactagtctaacataattaataagctcacggccgaccggtggcacagccagccgtgcacagacacacgcaaacagactcacacaccacacacacgaagcacacccgtggccgtggccatggcaatggctagaggcaagagcaagcagcgccagcacacaacgagcagcagtggcgagtagcatgtagagcagcagcgacgcagctagaaagatgcagtggaaagcagcaacggatgcgctcggcaagaagagcagacaggcgcggctacgagtgacacatgcggatgcagccaggctgcggcgaggccacgcacaagtgcacgcgcacagtagcagcagcagaaagcggagcagggcgagcggcgacaagcagcggcgggccgttcgggctgcgacggggtgcgcgcaggggcgcggccacgcgtaggtgggcgcggccagtggctccaccaactgcgggtgcgcacggccaaggcaacaggcagtcgcgagcagtggccgcacggtgagtggagctccggccaagctcggtcgcagcgacgtacggcactacggctacggggacggattcgacagggaaaagggggattcgagggagaagctcacgaggagctcggaggtggaccggagcagtggcaatcggtgatggacgaagacgatgtacgcggagaagacaatgtcgatggcgagcatacggtctgcctcgactcgatttggtgatctgaatggacgaagagggttgtggcggttctcctggacaagctcaaggggcgcgagaacgacgacggccgccgaatcaacatcgaacgacaacggcggcgactcttatccacacggggagctgtgggatggccgacacgatgccatccgtggccatggcggcctggatggacgccacaactccctgctcccactgtagcgggaggtaagagatgaccgaggtgggttgggctctcctatgcactagaggcccggtagtgcgataagttttagcccgtttcgttttaattattttcctttatttcctctagaactttgtattttgttgagctactaaataaatttagttaaaagcaaaatttagcac

SEQ ID NO: 23 - DNA, 542 bp, Hordeum vulgare
ggagtccatggtggagtacctcgccaccgccgtcccggacgagccgtcgtctccggcggaggagcgcgcgtcggcgtcgaacacgcactgcatctcgccgcggttcctgaagcacctggagcggcggcgcgcggggttcgtggcacggctgaacagggcaatgagggaccggtggagcgacgcagcggtggacgccgccctcggggcgccggcccggcctgtctgcgccgcctacctcgcggcggcgacggaaaccggcggccaacgaccggtggttggctctgcggtggcgggttgagagccagcaaggcgtcggaacagcgcacaaagggcggtttgcacatgcaaaccgtgattgtcacgtgactcagtcggtcagtcccttgtaaatgtaattgatccgccattatcggtgagagcttaattaagtaatgggatgagacgagtcagcgctcgctactctgtatagttttttcttttttagtatatatgctacaaatgtactctctctgtttcaaaatataaaccttttagagatttta

SEQ ID NO: 24 - DNA, 935 bp, Hordeum vulgare
aaagcgagcagctggctggaggctggtccatcgagcggccgggactgacatgaggccgccgtcttcttcttcttccatcgttgccgccgctgcaacagctccctcctcctccactgctccccctgttgcagtcacaaccaggagagcacttctcttctccacctcgttcatcgcgctcgcacctgctgcagcagctcaggccgccaacccctcctccacgccctactcccagtccaggaccctgcagatcggcctcgacaccaacgggaagattcggacatgcccctccaccaatcccgggtgcgtgtgcaccaaccccaccgtcggcgcctcctcctccgtcgcctccccgctcatcatcccggagtccacctccgccgacgctgccgcccagttgttgcggcaagccatcctcaagacgcagaagaatgtcagcttcaacgttgatcagcaaactcccaatggccagtacatccaggcggaggtggacggtggtttcggccgggacgtgatggagttccttgtgaagaaagacgccggcgtggtggcctaccgctgcgtggccaccaaggtcacctttgtctaccccttcaccaccgccgtcggcgactcgcggggacaggagcagagggtcgccgccgtcgcgcaggagctcgggtggtacgcgcccgacataagatcctccgtcgacgacgttgctacgtaatcaagctacgtaacgcgccgactgtgagatgcgtttcaagatcaaacgacatgcgtgcaagagattggtatgtatgcagattgattgatcatggtcatggaccagataatttgacttttaattttttagttgggactcataatttgtcgtccaaccaccgatgtactatggacaatagttgctgggcccatctcccctagtaaaacagtttaatatttgtttgggacaa

SEQ ID NO: 25 - DNA, 1481 bp, Hordeum vulgare
gggtccagtccacaatttttttctccgcataaatcatcctccgtcaccggcggggtgagggagacgcggtcggcggggcgagacgccagagacaaacccaacggagtttcccccctgccgccgaccccaaaccctagccgctcctcccagccccagccgctcctaccgaccccagccagccgccggaattctcctgggggctctattggctttcctcaagcctgtggcttcatcgcggcagcatgagctctgctggttctgcaaggattccaaagaggagacgaactaccaaggcgtcggaggctgcagaccgacaacttcgggagggacagtttccggacctgaacttgcttccagtggttgaagcactcaatactgggggttcactctccattaatgagcctgtctcacacaggcagccccctcctatggtggttagcctgggttacgagaccacacaggttgtggtgtcatctgctgctgcagggtcaaacattggcatgaatagtttccccatcaacgtggaagtgattgatgatgatgttgcgatttatacctcagggccgccccctcaagcaaggcaacagtcgtccaggacaggacctatcactgtgataatagatgatgattctgaaactactgctggaccagcaggggaagctcttgatgagcatgtgaacactctgctgtctctgggaatgaacccgaggcacaatccctcgagagcacaacccaacactgaccttgtaataaacatagtagacatacctgagaccaacaacacaccgcccaaggtggcccaggctgcccctgaacctgtgaaggagatcccaaaggaaacaaagttcagctgtccagtctgcatgaatgagctggtcaatgcatcatcgaccatctgcggccacatcttctgccagaagtgcatcaaggcctccatccaggctcagaagaagtgccctacctgccggaggaagttgaccataagcaacttccaccgggtctacctcccgatggcagataattaaaacttatccagccattcttggagcattagagccgatggcagataactaaaacctatccagccattcttggagcattagagccgtggcagctgtgacccttttttggcaccggcattgtggtgattgtatctgagctattcttcacagggtcatcatgaacaatcagtttccccccccaacaatttaacaagtgcttgagacgtgattaccaatctgcatacatggtgctagtggacaccgttagttagttgttccttgtggaaagtggaaacctaaattcagaccggtatatgtttgctgttcaggtatatgtttttttttcttctgcataactctagaaaatgtttgtgctcgctgccacctaaattcagacccattgggtctgtatcctgtcacaccaacacatagttgttgctgggaatttcttgaaaagaaaagttgtttctgggcttgaaa

SEQ ID NO: 26 - DNA, 1134 bp, Hordeum vulgare
gcacgcactcggtgattgtcgttcagttgaccgatcggaccaagaaatcatcgtcagcagcggagttaacacgtagtggaggccaagggcatggagagcgaaggcagcacgagcgccaacggcggcgccgcctgcgcggtctgcggcgggtccgcggccttgtactgcccggcggacgccgcggcgctctgcgtgccctgcgacgcggctgtccactccgccaaccctctggcctcccgccacgagcgcgtgccgctggcggccgccgtggccgtggcggcgacctccggcgtgtacgacggcctcttcgcggctgacgacgaaggcgcggcgtcctggccgactccggtgcagggaagccccaacagcggctcgtctggcttcagtaacggcagcggcgtcgaggtgagcctgtttgacctgctctccgacgtcgacctcgtggccaccggcgccggcgggagcgtgtcttcggacggtggcgtcgcgccgttgtggctgcagcctggccttgtctctgctgcgtggaactcctcttggtcggcgtcagaggccgtggtcgtcccgtcgccggcggacagggcggcgagggtcatgcggtaccgcgagaagcgcaagaaccgcaagttccacaagaccatccgctacgcctcccgcaaggcgtacgccgaggcgcggccgagggtcaagggccgcttcgtcaaacgccctgccgcggcggcgacggacgacggcaacacgagcgccgccgaggccgccaaattctggctctccttctccgacaacagcgtagggtttcacgttgcttcccatggagtcgtgccaagcttctagttctggaagggtgaaggtacttgaccgtggcaatggcgtctgcccagcttgagacgaaatccagcaaagtgcagatgccatgctgccatcctatcggcgccatggtcttcctgccgtgcccgtgatcctgtcgtgccgtcgttgcagtcaatattcattcatggtaaaaacccgccatcgacatttttaactgatgacgcgggttcttcgatcatccccattggtgaactactaggcgattaatgtatttcctcggtctcttgttagtttcaagtgctaatatgaataaagaatcatgtc

SEQ ID NO: 27 - DNA, 982 bp, Hordeum vulgare
ggcaaccagagagaagtgcgagctcctccctctcctccgacccgcgccgccgcctataacgaccacttcacgtggcctatccttctccccctttttgttcctcgcctaaaccaccacaagcatggaggccaagaagtcgccgcccacccctgcctccaccggatcggcggcggcggggaacggatacttcagctccgtcttctccgcgtcgcctgcggcaaatccaagagacgccaggcagatggacctgtacacgatgctgaacaagcagaaccccaaagggcagagcggtgggggcactgcagatggcaaatcccaaggaagccctgctaaaggtcgtgttgcttacaaagatggaaaacaattttacccaaacgagtcctcagagtcgccttattttggttcgtctgtgcattacggcggccgggacttctatgacagctctccacacaagcaggccaatgaatcatcgagaaattataaggaggataacacggatggctccctggctaccagaggtgattggtggcaaggttcactgtactactaaatactttgcagtggactctcctattgtgaacaaggaataaaaaggagcaggtcgagctggtaggctgtagagttgacatgagtcatcaggcataaaaagaagaagtcatagtggggctacatctgttctgtcggtgatggcagtatttagatgcatcagtcacctggacagatgtagacatatatatgtatttcccttttgtttgccctatgttacctgatttgagtgctgaagtgtaatgggactggcagggcagcagcaaaagcaggtcctacgaaacgttgctgctcttttgcaactgcaacggactggatcgcttgctgcatgctttatgtatccttgcccatggtgtgttttaggaatatttggatttgcacatctgtttcagtctagcatttgcttcctgagtgaatcatgatatgaacttgtgac

SEQ ID NO: 28 - DNA, 858 bp, Hordeum vulgare
cacacggccacaacccgactcaccaccgcgcctcttcctcctccctctcacccacccatggcgacggctatgatggctgcagccaccacctcctgctccccgcgccgagcgctcctcaagccagtggcctcctccagctccgcgccgccgcccaggccgcagccacggtccttcctcaagcagctcccggggctggctgcgacggcggcggcggcagccgtcgcctccgtgcccctcccggcgctggccgtggagatggagaaggcggcgctgttcgacttcaacctgacgctcccggcgatcacgatcgagttcctgctgctgatggtggcgctggacaagctctacttctcgccgctgggcaagttcatggacgagcgggacgccaagatccgcgcggagctcggcggcgtcaaggacgcgtccgaggaggtgcggcagctggaggagcaggcccaggccattctcaaggcggcgcgcgcggagatcgcggcggcgctcaacaagatgaagaaggagacgaccaaggagctggaggcgaagctcgacgagggccgccgccgcgtggaggccgagctcgtcgaggcgctcgcgagcctcgaggggcagaaggaggaggccatcaaggcgctggacgcgcagatcgtgtcactcagcgacgagatcgtcaagaaggtgctcccatccgcgtgaaaacactagtagatcacgcagcgcgcagcagccggcgcaatccccgtttcatagtaaagatttctagttcttgatgtgtaatgtatacgcccactgggctgcctcccctaagaatgtaatcgaatcaacatttctgtgatcacgtataaatgaatgacccttttg

SEQ ID NO: 29 - DNA, 1263 bp, Hordeum vulgare
aagcggagcgaagcgagccacagccaccggaaacgaaacgagacacacgccccacgccccacgccgttcgcccactccccgcccagccgttcccgtcgccacccttcgccgacgcgggggcaagagaagaagcggaaagagagaaagcgtcccccaccccgcgcggatcccgcgaccgggcccatgtccccctcgacactgctcgtccggccaccggcgccggcgaatccgtcccttccgcctcgtcggtgcgcgcccgtatcagcagcggcagcgacgctccgcacgtctcctgccgcctcctccgtggctcacttctctaggctgcgaaccaagtgcaggtttgctgcccccggtgtgagagaagattactcttctacgccaatcgatgtcgtagccgacgtgaaaacagagaagattgtagtcttgggaggaagtggatttgtcggttctgctatatgcagagctgcagtagctaaaggcattgaggttgtgagtctcagcaggtcaggaagaccgtcttactctgatccttgggctgatgaagttacttggctagcaggagatgttttctatgcaagatgggaggacgtactagtaggggctactgctgttgtgtctacccttggaggatttggtaatgaagaacagatgaaaaggataaatggtgaagcaaatgccatagcagtagacgctgcaaaagaatttgggatcccgaaatttattttgatctctgttcatgattacaaccttccatcctttctccttacctcgggctatttcactggtaagagaaaggctgaatctgaagtcctctccaaatacccatcctcaggtgttgtattgaggcctgggtttatttacggtaaaaggaaagtagatggctacgagataccgctcgacatcgtagggcaaccacttgagaagctactttcgtctgtcgaaaatttcaccaaaccattgagtgcattgcctggttcggacctggtcctcgcaccccctgtgaacgtggaagatgtcgcctacgccgtgatcaacgccgtcatagatgacagcttcttcggcgtgttcacaatcgagcagatcaaggaagcagcagccagtgcgagagtgtagagatctgcatatctggaagtaccttacggagttatgagggagcagtcatgttcttgcaaatcttccataatactagtggatagctcaatgccgaactcagtactgcaatgctgtgcttatatagagagtttaaatgcactaacgcgg

SEQ ID NO: 30 - DNA, 1829 bp, Hordeum vulgare
ctccgttaaaaactgagcaaaccctccctccccacaatccctctaacgaccccccgcccccgagctcgcgaatcacccgaagccgccgccatgggcgactacggcaacgcgatgatgcggaaccaggatgcgggcgtgcagacccgtgtgaaggcgcagagccgcgccaacctcctccagctcaagctcatcgggcagagccatccgacggggctgacgacgaacctgctgaagctgttcgagccacggcctccgctcgagcacaagccgccgctcgagaagcgcaagttgccagcttacactgggatgtcgcagtttgtatcgcggttcgcggagcctggtgacccggagtatgctccgcctgtccccacgtgcgagactagggctgaaaaaaaggatagaatccgccaacttaagcttgaggaaggtgcagctaaggttgctgaagagctccagaagtatgacccacaaaatgaccccaatgtcactggagatccatacaaaacactctttgttgcacgacttggctacgagacatccgagcagaaggttaaaagggactttgaagcttatgggcctattaaaagggtacgactcataactgaccaggtaacaaataagcctagaggatatgcattcgtagagtatgcgcacactcgggacatgaaaagtgcttacaagcaagctgacgggagaaaagtggataacaaaagggtgcttgttgacgtagagcgtggtagaactgttccaaattggcgtcctaggagattgggtggtggacttggatcaagcaggattggtggtgaagatgctgcccagaagcattctgctagagagcaacagaacgctgctgggcgccccagatcagaagagcctaggagggatgatcgttctgcagatcgggatcgcgagaaatctcgtgatagggtacgggaaagagatcgtgacgagaaaactcgtgaacgctcgcatgacagggctcgtgatcgtgatccaagggaagatagacaccaccatagagatcgtgagagaactcgtgatagggatcgagaaagggaccaggagagagaccgtgggcgtgaccgccgtgatagggataggcacaaggatcatggccgggatagagaccaggacagagacaggaaacgtgagcgctctcatggcagaggcagggaccgtgacagagattacgagcgtgcaagtcacgaacaggaccctggcagggaccgagattacaagcgtgcgcgccatgaacatgaacgtggtcacttgcaggcgagtgatgctgattatggtaatggtgagcctggctataaccagcatgagcaccacagaagtcatgaacagtatggttatggcctagatggacatgatcgctcaaagcgacatgagcattaccgtgatgattcacacagtaaaatggcaaccaaccatcaggggcaacctgaaaatgcagaacctgcagtccccgaggagggggaggcatatgaagaaggggactaccagcatatccaagcgggtgaatacaggaactaaaaacttgaaagctgtgtggtaaggcttattaatgcagtaaaaatatttgcatcagttttgctgttcccagtggttctctcgttgcttagggaggcagaagctttttcttgttggcacttccagtgttagcctacttgttttggtgtgttttgtttgttgtatgttatttgtaataatttgctggataatgcttgtggtttgtatgtgattttgaagccaatggccaatcaatgtgaacttgttacttgcctaatgttgctccagtttatgcttttttatgggtttcaacagtt

SEQ ID NO: 31 - DNA, 712 bp, Hordeum vulgare
gcactcattgcacagccataaaaaccacctagagacaaaccaaaaagaagggcagggaagttccatggccgggctgcagaggtcctcactgacattcaggaggtcaggatcatcaggcatggtctggggcgagaggctcatgtcggatgaacatagccagtggacctcaggggagccagaattcagggagctacggcactcccgcagcgtagggtccgtcggtgcgcagcgcaggcgcaacgacggcaccgagcatggcggccaggcattccggacacggcgggtagcccctgccatagatccaccatcgcccaaggttcctggctgcatcttctgtgggattttcaggaaggcaggaccttcgcagccatctaaggccagaaggtaccactagagtgatctgtgtgttcatcaaccatatgtgtgacagggttatcagggtcttgagcttgtgaagttcaggtccatcaagtatatgtagatggtagtagtcgatgatatgcttgtatagttgcatgctgttaaggtgctatgcatatttatctttttctcgatcttttgatagtttgttgatgtggccgtattcttgaatgaccacctcgtctggctttggggtgcatggtagaatttgtgcatctctgtagcatacatattgtatactaccctgtacacgaacatgatgctttcatatatttgtcgtttcgagctcact

SEQ ID NO: 32 - DNA, 1020 bp, Hordeum vulgare
ccaacaacaacggacacggagatgagcttagcacttctagggggctactcctccgccgaggacgaggaccccgccgccgccgagctcagcgactccggcgactcatcagccgaagaggccggatctgacggggacgagaagtccgctccaccgaagccggctgcaaagccccgcccccgcgtaaaccctagccccggagatggggactcctcgctgccctcggcgctagatgtcttcgccgagatctccggccccccggctttcctcaaccgcagagtggcccagcccgaggaggtcggggaggcgctcggcgtgctcgatcgccgctccaactccaagcagaggagaaagccgccacctcccggtgcggttgtggcggcgaaaccacagatggttgccatccgtgaacgagttagcagtgacgtgaagaatggtgccaatcctccagttgctgttctgtcggcgaaaccacagttggttgctggtcacgaacgagttagcagtgacatgaagaatggtggcaaccctccaggttctgttgatggaaagaggaaaataggcgctgcaaatcctggtccagaagatgctgccgagcttctaagaatgtgcctccaatgtggtataccaaagacctattcacacgcccaaggaatggtatgccctgtttgcaacgatagaccagtgcaggcaaaagaacccgagaagaagaagggttctgctgtcaaggacaaggagaaagtgaagaggatgagagggcaatcgtcacatgcatcgtggaagagcgagactgagatggctctgcggcaacagttcgactaattggtgtcagcaggactgctggtgcacccaatctgtaactgtacactaggtagaatacaatctctttgcctgagtaagcttgtgccactacatcgcggatagttcaagatttgtttcttgtatttgcagttccctgtggtacttgggtctgttttgtaagctgtattcgttaaaatgtttccagcaaagtcaggttcaagt

SEQ ID NO: 33 - DNA, 1088 bp, Hordeum vulgare
gcacgcacacgccacacgtgagggagccaagcaaggcggatagacgtacacacaaccatcaagatcggagcgagcggccatggggcggtcgccgtgctgcgagaaggcgcacacgaacaagggcgcgtggacgagggaggaggacgagcggctggtggcccacgtccgggcgcacggggaggggtgctggcgctcgctgcccagcgccgccggcctgctgcgctgcggcaagagctgccgcctcaggtggatcaactacctccgccccgacctcaagcgcggcaacttcagccgcgacgaggacgagctcatcgtcaagctccacagcctcctcggcaacaagtggtcgctcatcgccgcgcgcctgccggggaggacggacaacgagatcaagaactactggaacacgcacatccggaggaagctgctcggcagggggatcgaccccgtcacgcaccgccccgtcaccgacgccgccggcaccaccgtctcctttgtccacccagagccgcccaaggcggagccggtgacggaggagagcaagccgcccaggtgcccggacctcaacctggacctctgcatcagcctgccgttccaagaggttgaggaacggccgccggcgagagcatgcgcgaagccggtcaagatggagcagctgcagggcggcggcggcggcctctgcttccgctgcagcatcctacgagtgagaggagcggcgacggagtgcagctgcagcagcaacttcctgggcctaagggccggcatgctcgacttcagaagcctcgagatgaaatagaaatttgggaataattattccatcaaactttctgctgtaaattgttgctccctccctcctaccaagtttttatttagcttttaggaaaagatatactactcctactcctattagaaggtgaggaggagactggtattattaggtgatagaggatttgtagcgagatcctctctgccctcctcgctctgctcagtttcatgtaaattattactgctccactgatgaaatggaatggaatgaaataatacagtactgtctaacagtggtagatactaaattcagtgcggtttcc

SEQ ID NO: 34 - DNA, 1697 bp, Hordeum vulgare
agattagcgaactctggagccgtaaacgaacatcactgggcactcccgctccctcccgcacttgtctctctgcccgcgactgggcccccgtcgacccttcccgcccgccaaaccgcccgcgatccgagaacggcgcgcgccatggcggacagcaggccggcggcggcgccgctgctatcgccgcggaagaagccgtcggcggcgcagtacacccggagcgcgtcgcacgcgggggacgagctgcgcagcttccgggcctgcctccgctggatgtgcatcgaccacacggacgggccgcgctccgcgggctcctgggcggtcttcttcctgctcgccgtcgccgcgcccgccgcggtcgccctggcgctcccggccacggccccgccgcggccgctcgacgggcaggtgcaggtctccctcaccctggccgccacgctcgccttcctctccctctgctctctgctccgggtcggcctccgccgcctgctctgcatcgaccgcctccgccacgactcggacgaggtgcgcgccgggtacaccgcgcagctcaaccgctccttccgcgtcctcgcctgcttcctcgcgccatgctccctcgccgacgccgcctacaaggtctactggtactgggccgccgcgcccttccgctcgccatggtggaacgcggccgcatgcgcgctcgaggccgcctcctgggtctaccgcactgccgtcttcttcatgatctgcgtcctcttccgggtcatctgctacctgcaggtgctgcgcatggtcggcttcgcgagggagttcggcaggttcgccgacgtcgccgtcgttctcgagcaccaccgacggatcagggaccagctccgccggatcagccaccggtaccgtcggttcataatcttctgcctcgtgctcgtcaccgccagccagttctccgccctgctcgcaaccaccaggccacatgcgcggatcaatatcgccaccgccggcgagctcgcgctctgctctgtgagcctcgtggcggggctgctagtctgtctgcacagcgcggccaagatcacgcacaagacacaggccatcacgagcgtggcggcggcgtggcacgcggacgccaccatccacgccttcgacaacgacctggaggaccccgatcccgccctgcccgccgccaccgggtacctggcgccggccaacgcctaccgggtggcccccggcgaggagtccgacagctatggggacgacgacgacgccatgagcgagggctccatcgacgactccaagctcgtgccgttccaggtcaacaacatgagcttccagaagaggcaggcactggtgaactacctggagaacaaccgggcgggcatcacggtgtacggcttcgtcgtcgaccggacatggctgcacgcgctcttcatgatcgagttctcgctcgtcatgtggctgctggggaagacggtcggtatatcttgaaggagctgcgctgccatttgtttgatgctgtcgccgattctcccgacgtctgatgcaggggctcacctcggatgtacaaattgagcgcacatagttcagtacttcagtgcttcaccacgcataaaacacacacattgttttttgttcctcctcctaagtattagttgtgcagtgtttgaaaaaaaaaggtattacttgagcacgttgatttgatgaaaagaatatatatgtgaaaatat

SEQ ID NO: 35 - DNA, 1142 bp, Hordeum vulgare
ggtcacaacaccaaggcccaagccaaacaccatctccactctccacagccatggacgccgacgccgacacggtggtgttcgaggcaccggcgcacttccgcttctacaagagcggcaagatagagcgccttcaccggcctcccatcctcccagccggagtcgacgaggccaccggcgtcacgtccaaggacgtcgtcctcgacgcggacaccggcctctccgtgcgcctctaccttcccaagctccaggacccttccgcgaagctcccggtcctcgtctacttccacggcggctccttcctcatcgagtcggccgactcctccacgtaccacaactacgtcaacgccctcgccgcggcggccggcgtcctcgccgtgtccgtcgactaccgcctggccccggagcacccgctccccgctgcctacgacgactcctgggccgcgctccagtgggcggcgtcggcgcaggacgactggatccgcgagcacggcgacacggcccgcctgttcctcgccggcgacagcgcgggggccaacatcgtccacgacatgctcatgagggcggcttccaaccacagcagcccgagggtggagggcgcgatactgctgcacccgtggttcggcgggaccaagccggtcgagggggagcacccggccgcgtgcatggtcaccgggatgctctggtcctacgcgtgcccgggcgcggtgggcggcgccgacgacccgaggatcaacccgctggcgccgggcgcgccggcgctggagaggctcggctgcgtgaggatgctcgtgaccgccgggctggcggacgggctcgccgcgcggaaccgcgcgtaccacgacgccgtggccggcagcgcgtggggcggcaccgcggcgtggcacgggtccgatggggagggtcacgtgttcttcctcgagaagcccgggtgcgacaacgccaagcagctcatggaccgcgtcgtcgccttcatagccggtgcctgatagagagttggtctgcagatcatctccattgtcttcgagaggaacctgctctgcatcactgcttgttcgcttactgggtgaataaggtgcagtagtattatttgtgaataaataggtgatgtcgcctagatggaattcaagttttcttggagtatc

SEQ ID NO: 36 - DNA, 539 bp, Hordeum vulgare
aagcaacctgcactccccagtccccacctctctgattgacagcccaccttagcagctaagccagcctcgcatcccaacaatggcgtctcgcacagccgtggtggtcgtggccgtgaccgcgctgctgttcgcggcggcgtccgcgcaggagatggacatgggcatgccgccagcgccggccccggtcacgggcgcggccgctggggccgcggcctcggcgctggccgtggcctgctccgccgtgctgtccctgctcgtcgcgggcgggctcgcgcactaggcggcgaggaggtggcggtggactggtggtgcgtcgacgctcgtccggcgacggtcgcttcgcttcttgagctttagggggggtcagtagtaacgggtagtgatgggtcgtgttgtgttcgtctgagtggggtatgactctgttgcttacttctattcttttgtatcatacattgctgcgtgtattatttccgtctcgtgtgtcgtctcgtcgcgtcggttctatgatgaataaagtttggatggtgcttctattccta

SEQ ID NO: 37 - DNA, 445 bp, Hordeum vulgare
gcagaggggcagcttcaggcgcgggtgggtgagggcgagcggagccggccacggcctcgcgcggtatatgcgaccggggtcggccactgccctgcgcttccacggccaggcgtcgacacgggcgaagcgcagcgaacggccgggcgcggggcttggcgcggctcgggcgaggctgaccacggcttggcacgggcgggcgcgatcgagcgcagctcgacgatggcgcgaccgagtgcaccctgttgaagccgtagatcatgttaaacggcactccttgcatgtagctatacgtagcgcgagcgctactcctggatctcatgatcccctctcccaacggcctgcgtgcctaacatatgggagttagttagcccagctgttgtatataacactcacctgatgtaacagtgttcttcatctataatacaattcagcttggtatcacagc

SEQ ID NO: 38 - DNA, 554 bp, Hordeum vulgare
agaaacagaaggggccgtggggaacggaggagcgcggcggcggcggcaagggagaagcgatggcgaggggcgatagctgcttggcgcgcatcggcgccggagtcgcaatcggcggcgcggtcggcggagccgtcggtgctgtttatgggacttatgccgctatcagattgagggtccctgggttgctgaagatcagacacatcggacaagccactgtcggcagcgctgcagtattcgggcttttcctcggagctggaagcttgatacactgcgggaaaaattactaactcgcgtcaagtcacccctgcttttattaggttttaaaggattgtctgcgtaaagcatttgtttgatctttaaggaacattggagttctgctactatttactcggtcctagcttttgatatgtttgccttactgttgatgtggaaataaaatctttcgtcatctgtatgagaggtaggtggtgaaagcaggattcatgagagaaaacgttttgttgtattgaagtcatatgtcattctcatcagtaaaagaaatagaccattttctc

SEQ ID NO: 39 - DNA, 2259 bp, Hordeum vulgare
accagagagagagcaaaggggatcgggagtcagttatgtgccgccgcctgccgtgcaccgatcgcctccctcgcgctgtcgcaattgccgtcgaatgaggatccagtgctgcttgcggagaggcgacaaaataagcagctcccgcgctttgggagctgtagtccccaatcgaagcagcagctcttttgggagcggcggtccgcaagcaaccggcaatcgaagcaatcaagcggctccgctccgagctgcaaccggcaatcgaagcaatcaagcggctcctctccgagcagcagtcctcaatcgaagcggctcccttctttagcggcaatccggagtcaaagcagtccttcccggattacatacaatcagaaacaggccctttttcaaattcagtctccgagtttccattggtgtcgggaacccagcagctaatatatatctggccgggtacccgccaatcttcggaagagaccaattcttgtcgcggcaactcgtgagccttcatcagcttccaaattcacggtgaccaatccttctcgggcctcggcggatctacgagggagccatggggaaaggcaataaagttgataggctcagcgcgttgcctgatgacattctggtcgacattcttgaccgactcaatgtacccgaggctgcaagaaccagcatcctctcaagacggtggagtcagctctgcgccaagctctctcggcttataataagtgctctggacttcctgcccgagggtgtgtcacgcagcagtgccgacatctctgacgatgaattggttcggatcaatgaagctgtggttcaagcgacaaatagcgtactggcgcgcagaaatccaggtgaacacaccatcgaccttctgtctacgacgttccacttgagagatgatctccccatatccatggggcatgctgttggtcatgccatagcgacacactcggtcaagaatgccaaattttgtgttaggacaaggaaggatgacgccgctgaaattgatgatgatgaagaaatggtcatctgggcgagagaattcatgttgttctttgatgcctgtccaattgcatttggtggtctcactactctcaacataggcaatttcagatttggtgaatcagacatatccagcatcctcaccacttgcaagcggctgaagcatatgcacttgtacaattgtgactctggtgattgtagcactctgcaagttgaacatgctaatctcagtgagctttgtatcatggattgtcgtcttgagcaagtaaagctgaactggctccctcaactcacacggatagtctttgacggttggatagatttccaagatccactggttcttggtcatgttcctttgctcgagtctgtaagcctcacaaatattgctatcagtgtcaacaagatggtcaggttaagttggtttcttagcagtacctctgtacgagttctgaagttggggtttagttctgaaaagatttgggtgcagccagaatgtccaacgcaaggtctggcatctgtgttccgccaactaaggtttgtcaacctagttaaacttcctgaagggtatgatctcacctggacaatgtttattcttgaagctgcacccttactgaaggagctatacatgacagtctgggatgatttgtgttcaatggaattggacgaggagaagagaaaaaatggatcgtatagtgagaacaagggcgtagaatggggctcggccgcagctgatttccaacaccacagtttggtcacactcgtcatctttggctttgaatctgaagattatgctgttaattatgtcagacgtgttatggtggcggcagtcaatctagaggatgtgttcctctatagtaggttggagttggagtgtggcgactgccaggacaagaagcccactaggttcgcctggacgaaaaggcagaagatttcactgaagaagagaatcaccgcggggattgagtcgtttgccataatccactccaacaagacaatacgagctgaccatgaagcaaaactgttttacccacagtgctcacactttgacacaacaagtggttgaattaacggtgtactgtattatcaacagtggttgctttgaacttttgtaagtgttttgttagtaccttggttattaagagttatcattttcttttggccgtctgaactgtattgttggttgtgttattatgacgaaaggatgatgagtactgaatgattgaattcttataaagttataagaggggacattttggccaa

SEQ ID NO: 40 - DNA, 3978 bp, Hordeum vulgare
gattttgcaggatccgcttccgcatataatttccttctccgctggcggcggcggcggcggaatggcggcggaggagccgtgctgcatctcgcacgccttcgaccgcgccgcgcgccgggaccccgcccgactcgccgtagtccacgcagtggccaacggcgagcgccgcttcgcctgcggcgacctcctatccgccgtctcctcgctctcccgccgcatctccgccgcgcttcctcgcccttccaccgaccaccgcggctgctcggatcgacacgggggaggcgccggcgcgacgcatagggtggtggggttgtacgcctcgccgtcggcggagtacgtagccgccgtcctcgccgtgctcaggtgcggggaggcgttcctgccgctggacccctcgtggccggaggacagggtccggtcagctgtctctgcctctaatgcggcgctagtcgtgtcggcaggggtctcgaatgaagacgacgttcttaagggctgcccttgccctgttctgcgattcagtggagaaatccggcaagggttatatgatggagaggttgggattggtggagatgggcttgcctggccgtgcgagcgtcggaggccacgggagttctgctacgtgatgttcacgtccggttctaccggaagacccaaaggggtttgtggaacggagaaaggtctcctgaatcgctttttgtggatgcaaagaaggaatcctttgtgttcggacgatgtgttgttgtttaagacatctgtcagctttgttgaccatcttcaggagtttctttctgctgtgttgactagcacaacactggtcatcccccccattgattggagagctaatccaacatcattggccaccttgattaaggcatatcatatatcaaggatgactatagttccgtcgctgatggagatgatactacctaccctggagaaaaatatttcatgtggatataactctcttaagatcttgttatttagtggggagattctgtccttggtgctttggaagagagttcgtgaaattctgccagagaccactatcataaatttgtatggaacaacagaggtttctggtgactgcacattctttgattgcaaagatctgcctgcaattttagagcgtgaagaaataaccagtgtaccgattggatttcctatagcaaattgtgaagtttttcttatgacgcatgctgggatggcagatgaaggtgaaatttgtgtcagtggagcatgtttattcaatggttatttagctgaattttgtaggagtaatcacactgaaggcagtgaaggttcaacatactataaaacgggtgattatgctcgacggctgaaggctggtgaacttgttttccttgggagaaaggaccgtacggtcaaaatttatgggcagcgtttttcactagaggagatagaatccacattaaaggaacatcctaatgtcagtgatgctgcagttactttccaaagtaaagggtctccaaattacaaggcatacctggtgtttaggaataatgatgaaattgtgaaaggccgcccgcagtatagagaagtaaattcttctcaagatatcatggcatcaattcgaagttggctcattaagaaggttccaccagctatgattccaagcttctttcttccaatgaagtccttacctttgacttcttcaggaaaggttgactatttcaagttatcaagtttggagtgtgcattggaaccatgtgaaatggagcaaattgactctggaagtggtccagttaatccacatttagaagttattaaaaaggcattttgtgacgccctgcttgttgatgaagtttctgagtttgatgattttttcactttgggtggtaactcaatttctgccgctcatgcagcccacaagttggacattgacatgagactgctttatatctatccaaccccttctaagcttttgcatgctttagttatggagcataataattcagtttctcctactgatgagcctcaccctaagaagggattgaatggatctgcaagcatacagagactgtttgactcaattgctgcaaatacgaatgacagttttcatgaaggcaaagcacagataaatggaaagcgtgcacattatcacattgcagggagttatggaaatggaacagatggccagcttagcaaatttccattctctcctaatgatagataccaggcaagtgacctcaacttggatacatgcttgaaggacagaaacagtgtcatggggagccagtggatcctgaacttttgtttacaaaaaaagtggtctattgggcgtagcaacagatttatgcatgactatgaagggaagttgctacttgaagattgttgctcatatgtttcatgcaacaaaagaggttatcttcaggaactttggaacattcctttggattcatgtgttgatgcctcacctttgcttgtcctgaacaatgggatgatgaacatatttattgggtcccattcacatttatttctctgcattgatggttgcaatggttcagtgaggtggagtgtcaaattggaaggacgtgtggagtgttctgctgctataactggtgatttttcagaggttgtggttggatgttataaagggaaaatttactttcatgatatgttgactggtaaactgtcatggacagttcaaacagatggagaggtaaaaatgcaaccagttgttgacaggacaaagaatttaatatggtgtggctcttatgaccatcatttgtatgcactaaattacaaagatcgttcctgcgcttacaaagtatcttgtggtggaagcatatatggttctcctgctgtggacatggcacaaaacatgatctatgctggatgtaccagtggccttgtgactgcaatatcccttgaggttccatcattcaggatagtttggcaatatgaagctggggcaccaatgttcagttctcttgccttcgatcatcagagtggaaatgttatttgttgcttggtgaacggtctggtgattgcattgaactcgcatggtactgttgtctggaaggcaactgttggtggtcctatttttgctggtgcgtgtgtgtcatctgcccttccttctcaggcgctgataccttcccgtgatggaagtttatactcttttgatactgcatctggtgatcttctttggtcatatgacgccggcgacccaattactgcatctgcttttgtggatgaagtgttagcatcaacgccatctggatcatcagagagatttatttgtatctgcacaagctctgggaagatccgtgtccttgggattagaactgacgctgagcaggagaaagatggttactctgtgcaagagtttacagccatggatcttcctggagacatcttctcgtcgccattgatggtgggtgggcgcatctttgttggctgcagagatgatcggctacattgtctctcgatcgcctcacatccataatctatttcagacatatccaggcaaactgttttgcttagtggccaatagaagaactagtggtgatgatggcccgagcagtttgatgttttgaacaaaatcaacaaagaagaaatgcagaagaaactgttttgcttgggttccgaaggttggatttccatgccgtaaatagaacttgaagttctttggttaagtgcttgatattcagtatcacaatcacattacaaccttaattagtgctgtgctcagtgagtgtaatgggttctaaagcggaagcagagctataaccggcccttgctcctttgctgcggaaaatacaccttcaagcttggtccgtctctttttatgcatcagaattattggttttttgttagaagaaagatcaaaattgttggtcgagagcaacatgctggatgtgtacataagctgatgtatcgaagcagtgtagctgggtggcatgaaagatacaaaatgaatgcaggtaatcgatttgcgaactcaatggagatacacag

SEQ ID NO: 41 - DNA, 1204 bp, Hordeum vulgare
acacccttgccagctccagctcgcgacgccacctcacctgaccacatcggctgctagacgggcacgcgggctcaccgactccttccttctttcattcggctttgatctgtggctgggagctcacactttccgatctgagttcaggcttgacggcttgatcatggaaggatccactcccacgatcacaaggatcgctgtggtcaccggcgggagcaaggggatcgggctggaggcgtgcaagcagctggccggcagcggcatcacggtcgttctgacggccagggacgagacgaggggaacggcggcggtggagcagatcaaacggctgggccactcggatgtcattttccatcagttagacatcacggatgcttccagcatcgctcggctggcagatttcctcaagacccgtttcgggaagcttgacatcctggtgaataatgctgctaccgatgggatcgagcatgtcatcaacccggtttatggtttgattcccggcgatgaaacgttcaatggcatggatgcgggccagaggatggattggatgtggaccacttgtcgacagacgtacgaaactgcaaagcagggcctgcagacgaactactacggcacaaagcgggtgacggaggcgctcctgcccctgctccgatcctcatcggacggaagaatcgtcaatgtctcctccaacttcggattgctcagctttttcaggaacgaggagctgaagaaggagcttaacgacgtcgacagcctgacggaggagaggctggacgagctgctggccatgttcctgaaggacttcgaggccggcgcggtggaggcgcacgggtggccggccgagttctcggcgtacaaggtggccaaggccgccatgaacgcctactcgaggatcctggccaagaggcacccggagctgcgcgtcaactgcgcgcaccccggttacgtgaagacagacatcaccaggaactccgggatcctgacgccggaggagggcgctcggaacatcactggcgttgcactgctgccggaaggcgggccgaccggcaagtacttctccgaaggcgaggaggcatcgttcgtgtgaaaaaataaagcatctgtagcactactgttttgttgcgccaatctgtggtgggataataatctgtgagttgaagaataaagcaggtatgttcgtttggactacgcctgtgctcgaagatct

SEQ ID NO: 42 - DNA, 1113 bp, Hordeum vulgare
aaaatcaacgacacacactcccactcccacgctcccaagctgacacctaggtgccgcgccgccgggaccccagcctcgccgtctccggcggcgtgctcccagatccgactcgccggtttgtttccgttccgcgcggaatcgcctgacggaggcgggaggccagcgtcgtccgcagctgagtcgggatgggcggcaccagcaccagcaccttcgtcatcaggtggatcaacttcctcaccatgatactggcgatacttgtggtgggttttgggttctggatgagcacccacaatgacgagtgccgacggtcactcacgatccctgtcatggcccttggaggagtaatttttctcatatcgctggcgggattcgtgggtgcttggaagaacatttcctgcttgctttggacatatctaatcatgctgttcgtggtcctggtggcaatcatggtcttcacagtgcttgcgtttatcattacaaatactggaactggtcatgctgttgctgggtccaaatataaagagtatcgtcttcaggactacagctcttggttcgtcaaacagctcaatgacactgataaatggattcatctgagaagttgccttgtgaagtcggatgattgcaatagcttgtcgaaaagatataagactctaaaacaatacaagcttgctgatctgactcccattgagtctggctgttgccgcccaccagcggagtgtggatatccagctttgaatgcttccacttttgatttgagctatcatccggtgagcacaaacgtcgactgcaaactctacaaaaatgatcggtccctcaggtgctatgactgtaattcttgcaaagctggggttgcgcaatacatgaagacagagtggcgggtggttgccatcttcaatgtggtattgtttgttattttgtcattcgtatactttgttggctgctgcgcacgtcgacatgctgggggtagcgattctaaagttcctggaagatgactgtactttgaactttgaagtgaatcctctctatgattcacgtgtcacagcgagagttaactttgccgtcccttgtaataacattgttcattcaagttcagctgatgaaatggagtgccaa

SEQ ID NO: 43 - DNA, 1056 bp, Hordeum vulgare
aacagaccaaagcatatcctccgcgatggattcgctcccctcacctccataccttggatcggagagagggagaggaaagagaaaaacaaggggttagctaaaatggcaatggccacagcacggctaatccatccatgcttggtggtatccaagagcccaagaactgcaccaacacccttgctcctccacacccataagcccctgacctcatcgtttcacttcacgctccactccgtcgacgtctccaaggacgacaagccgctggacacggcgctcgagaccaaacaagaagatgcagccggcgtcggcgtcggcgacctgacgacgccactgccgggggagttggacgcggaggaggacgtgccgaagcttgacccccgccggttcgaggagcagttcgcggtgctgaacacgggggtgcacgagtgccggtcctgcggctacctgtacgaccaggccaagggagacccgtcctacccggtgcccccggggctgccgttcgccaaggtcccggacgattggcggtgcccgacgtgcggcgcggcgcagtccttcttcgacagcaagagcgtcgagatcgccgggttcgcgcagaaccagcagttcgggctcggcggcaactcgctcacctccggccagaagacgctactcatctacggaagcctccttgtcggcttcgccttcttcctctccggctacttcttgcaatgagtaccgagcgaggcatcatcctttgattcattccaggaggcttcttgcaattagtgaagaggagaaactaagtaaggctgttaccgggttaatcttgataagtactgtactaaatttgtgtgtatagatacctattgcttctgctaccaagagcccagagagagaggggcgatgtatagcagaggggaaatgggacatttgttttgaggtgctggctataatttccttgtggatgcagttcccggacaaatttcgactagaattgcttacagtggttaggcatgagtcccctctcgcaaggccaatgttgaatatttaagcatatttacattaaatataattcag

SEQ ID NO: 44 - DNA, 639 bp, Hordeum vulgare
gcgtccgcccgcggctccagaaaagatcccctccgcctccgaccctaggcaacaaggcagctcacatttcgctgctcaccgagccctcgaggcgcgctatccatggccacctactacccgtccggcgcttccgcgctcctgctccccgtcccgcgaacccgcgccgcctttccgcaggggtttcccggcccggcttccgggaggagctctccctgtgcggttgttcggcggcagcggaggggaaggggagcggtggtgggtgtcgtgcgagcatgcttcaatcctttcggggacgaacgcatcctccgggaggccctgaaggagccagttgcattcatgggtggtgtgtttgctggtctcttaaggcttgacctgaatgaggatcctctcaaggagtgggtaactcgaacggtagaggcttctggaatagctgaggagaacagtgccgaggaatcaaatgagggagctcaaaatgatggaccccagcaaattgagattgagtgaggtgcattagttgccttttgccctcctttacagccttacttgtaacttatcctgaatatttgtaatatctaagcagtaaaatgcttgcccatattttgggttcatagtacaggttcaagtcaaaacattagcaca

SEQ ID NO: 45 - DNA, 1422 bp, Hordeum vulgare
ggcaagccgtgcgttcgctcaaactcaagccgcggcgagcggaagcggtgggcgcgcgacggcggcggcggttggccctctcgagtcatggtgctactcgccaccctctcgcgcgatgccggagctcacccgtgccctgcgcaggaattccagggggaagcagggccgccgcgcccgcgcaggccgtccgcgttctacagctctgtgttcgcgcagatcgaagaggtcgggtgggggcagctggtgagcgccgcaggcgatgatggcgtgtcgtgcctcaccttccgcgtcatggatgagcagcgacggcaccatttactggagatcacactgcccatgaactacccgacatgccctccttcaattgccgcggatgttccttatctccccaaattacagtggtcaaaaagctcaagactgaaggatgttctctgccagttccaagagcacctgaaggtattgcaagattactggtctacaatggatggcattgacaaggccctttgggttgtcgatcctacaaagccgacatatgctatgtctcatcgtcgcatagctttgggtgatgattgctatattttactacacgttgatgcacagaagcccaactctttaccagagtgccgcttcctaggcacagatgggaaactggaaaggctgataaagaattggagaaaaaatcgtaaaagatggagtgctgacaaaaagttccatgaaaacctgtcaaccgtcctagattttgcactgccgcaacccccttctatgtgcatcaaagatgaccagcaagctgattgtgggatatgttacgccacgcatctgccagtcgacgacgaactcgggactcagagcgggtgcgcggcggactacaagtgcgaaaaccctagctgcagcagagccttccactcggtgtgcctgagagactggctgcgcaccattaccacaacaaggcagtcgtttgatgttctgttcgggaactgcccttattgcagcgagcctgttgctgtgaagagcaccgacagctgaacttgggtttggcattcacaaattgaggcgctgagatcagatcatatgtttttagacaatgaccttcaagcagaagcaggtaagattccaggtttcagacgggccaataaaaaggaaggggggagaaatcagagacatctaggttgatgcgtccgtcaggtttgtgctaaaggcaggtcgtcatgacctataccgtcatcaatggagctgcaagaggtcgaaattgctgttggtttctacgaaattggcgtccacttgttctagaggtgaaagaagtcaattgctgagcttctagagttgcaaattggtgtgtgttacatagaagtcaattgctgagcttctagagttgcaaattggtgtgtgctacatagatttggaacggtgaatgcgcaattgctg

SEQ ID NO: 46 - DNA, 907 bp, Hordeum vulgare
aacccacacacacagacacaggcacacactgacacgcaggcagcagcggcagcggaactaagcatgtggtcgggagcggcagccgcggtggcggcgcgcagcgtctccccgccgctgcacgcgccgacgtccctcaccgggcggcgcggcgcgggacggccgtcgacggtgtcggtgcgcgctggcggcgggctgatggacttcgtgggcggggacctggtgaagccggacctggggcggtggctggacgacgtggagaagcacaaggcgctggccatctacccgccgcacgagggcggctacgagggccgctacctcaaccgcctccgctaccagggctactacttcctcgacctctccgcgcgcggcctcggcgaccccgagtccaccctcaccaagatccaccccgtctgcccgcctagcctcgggaggcagccggtggcgaggtggtacttcccgccggaggtggactacaggctcagcctgctgcacccggacgccaaagggctcatcgtctgggtctacgaggccaaggttctgtccaaggccgagctgcagttcctggccatgctccccgacctccgccccaaagtcagggtgatcgcggaatgcggcaactggagaaaattcatctggaaaccgctgaagcaaatatcgggcctcgagcctgacccggacgccgaggaatgaggagccaccgtccggccggcagctgcctcgtctcatctctcgccttacactccattttcagcttcttcttttttgtgtactactaaaggaggacaatgatgtacatacgtatacatttgacatctgggctcagttaattccacaagacaatcatcaatcttgtaacacctttcaaacatacacatatccaacaaatcaaatcatatatgcaagctca

SEQ ID NO: 47 - DNA, 2043 bp, Hordeum vulgare
aaccccgcgagagaaacccagtggccacctcccaccatggcaccgcccgccatggcgttccaggcgctcgccttctcgcccctcccgctccacctccccgccacgcggcgccgggtacgcgtgctcgccgtggccgccgaccagacccctccgcccccgcaggcctccccctccgagccggccaacagcccgagccggctcctccgggagctcgcgcagcggaagaaggccgtctcgcccaagaagaagcacccgccgcggcggttcatcctcaagccgccgctcgacgacgagcgcctcacccagcggttcctcaacagcccgcagctgtcgctcaagtcgctcccgctcctctcctcctgcctcccctccgcgccgctctccgccgccgaccgcacctggatggacgagtacctcctcgaggccaagcaggcgctcggctacccgctcgccccctccgagacgctcggcgagggcgacgactgccccgcgcgccacttcgacgtcctcctctacctcgtcttccagcacctggacccctcctccgagcgcacgcggacgcgccacgtgcggaacggccactccaggctgtggtttcttggccagttcgtgctggagctcgccttctgcgagttcttcctgcagaggtaccccagagagtcccctgggccgatgcgggagcgggtgttcgcgctcatcgggaagaagatgctgcccaaatggatcaaggcggcgagcctgcataatttggtgtttccttatgacgatttggataagatgttacgcaaggacagggaaccgcccacgaaggctgtgttctgggcattatttggagccatatatttatgctttggaatgcctgaagtctatcgtgttctctttgaggcatttgggatggaccctgaagaagagagctgtcagccaaaactgcggcgtcaactggaagatgttgattatgtttcagtggagtttgaaaagagacaactcgcatggcaagatgttgctgcctaccggccaccagcggatgctctttttgctcatcctaggcttttccgagcatgtgtgccaccaggcatgcatcgtttcagaggaaacatttgggattttgataatagacccaaagtcatgaacatcctaggatatcccttgccggcgaatgataaaattccagaaattacagaagcaaggaatatagagcttggacttggcctccagctgtgcttcatgcatccctcaaagtataagtttgagcatccgagattttgttttgagcgtctggaatatgttggtcagaagattcaggatctagtattggcagagaggctgctcatgaagcatctcgacgcacctggcaggtggttgtcagagaagcataggaggttgttgatgaacaagtattgcgggcggtacctgcgggacaagcaccttcaccactacattatatacggggagactgtacaggacagattcgaacacaaccgccggctaagaaatccttccacgaccgccgtccagcaagcgatacacgggctctcatactgcgtctacggcaaacctgatgtgcggcgcttgatgttcgaggtatttgacttcgaacaggtccagccgaaagctgtatgaggaggatatgctccatgtcggtttgtgctgaactgatgaccggcgagaatgccagcgcttgaaggaaaaatgcagggtcgtcaaaatcctagcgcggatcagatcgcgctgttccgaagcctgagcccaaagccggaccgcggattaaagcaagcactgcccgtccagcctcttctggacccccacagctcttgtaacctgttgtcttgcgtgctagataggcagatgtactagagatgatgtaaaatcgaacgccgtagtttttcgaagttacagttttgagagctgactgtaaattccaatttgagcagaaacacaaacagctgcagcagcagccgcaggaagatatagagttatccgtgagaaacatgctttgtaatgttgtagccgaaaatgtgaatgcaacgtgtactgctcacgtgc

SEQ ID NO: 48 - DNA, 2037 bp, Hordeum vulgare
ccagatcttcctctactgctgctacctcgtttctcccccctctcccacacggcagcatcgtttacccaccaaactcctcacttcatccgtggaatctcgcccactttcccggctcagatccgagctcgtacgcgaaatggtgatcctttgtgctggccaccctgctccttcggttcattctgaatttctatctggatggctatcactcaacagctccagaaggccttaccgtttgagctcaaccggaaggaacatcagaaagcaaaacagacatcagcgggcgattaccttcgcaaaaagctcttcattacaagattcagtggcctctgtaaaaccatctcgtcttctgcccacagtagaaccaaaaacatttcccaatagtgtccctgatgagatgctatcaaaactcagattggaagaatctgatgcattttacatactagagctgtgcacaagtagagaacttagttcctctttgctagataagaactccgcgatcttagtctgcttaattgatgttgacggtgactccttgttacaaagagtaccagcaatctatggggaccaaccttcacatggcaccaaggcatcacaattcctcccctttcaaagtggttcagttgatatcattacctttaaaggtcccaaattgcagacaatcaaagaaatctggattggccttgaatcaggttcatggagattagatggtttaagtttgaaagtgatccatggagcacgggatacacctgaagatcttaagggaacacttgagctcaagttcagcggtttgcagtacacgttcgacaagctgagtgcgctgcttggtgaggagggagcttcagtagtggaagcaaggcctattgctgtcactgacctgtcaggaattagcatttctgaccttcaagagggacagctatcctcagcaaggacagcctcaagcattaaggaattgaaggaggatggactgagggagtacgctgatctcaaacaatccttgctgctttacgacatatctattgttataacaggtttctctgccttcactctggcttcgaatgatggggccgcctactcgttcctcgtcggcgggattggagggttcctgtatctattgctactccaaagatctgtggatgggttgccggcaattagttctacttcagaagtgagcagttcagagccctctgtgaatttcagtggcgtaagaaggccatggttgatattgtcgattgtaatggttgctggggctgttgcactgaagtacggtgctagtggtgacagctttgagctgactccaactgagctcttcgttggcgccgcagggttcctggcgaacaaggttgctgttcttctggcagcattcaaacccttgcaaagtaatttggagagtgacgatggatccgtggactgatcttcctgacaatattgctctgaatatactaccatgctttttagaagggtgtaaaatgtaacaagaagtagcgtttcatagtagctcgacagcattcaagatctgaagctcggtatcgaaagtgcaggggacaagctcaggggtagaatggaaaggtgtatgcttgtcacttgagcctcttggtaacttcattccatcagcatgcccaaccacagaagttcatctcgtagcatccgtttgagagtcaatcaagaacaaaaggtatggttaataaaatcataaaatacatttctggctatagtaatgctactcaaactcgaattgttcagcttagcctatgcaaactcgagtacttggctgcgctcaaaggcatgtagaccgtgacacctggagatgccagatacctcaaatggttcaaatattcattcaaatgagatggtttggttactaactccaaacttatgatagttttagcattaccatatgttatatcgctgtaaataaattaatcgactgtcccaggcagttgggctgctagatattacaatacaaatgtctgtatataaagtggagttatagtttgtctgctgaatgttcttatgattggaaatatagatgtattttca

SEQ ID NO: 49 - DNA, 1123 bp, Hordeum vulgare
agagcgccacgactcgagtagttgagcagtagcagccgctccccttgcctagaccccccgtctctcccctccctcctctccagccccagccccgccgcctacggcacgcacaaccgctccattcacgtgccctaatcctcggccgcagctctcctctccgtccgtccgcccccggaatggagcccaagaggtcctcgccccagccgcgcgcggcgacgactaagaagtcgcctccccgcgccgccgccgccgacgccgccggggccgactcgccgctcagcagcctgttccacccggcgtcgcacggggtaaacggcaaagagcaggacctgtacgccattcttttcaaagggcagaacggcaatgctcaggctagcatgacagatggtcaatcccagtggagtcctgctaaaagccgtacaacatacaccaaggataacaagtatgactcagttggcacgtcgtcttgttttggttcttctgtgcactatggcggccgagactattatggcagctctgcacctaagcaagccgcggaatacagtgattacaaggtggataagaaggatcctgtcgcagattctcatggcgattggtggcaaggctcgttttactactaagcaagtgcttggtgtcctctcccttgtcgaacaaggaaatcgaaggggggaaggtgttgtacctattttccttgatagcagttattataccttacatagtggagaagacattcgctcatcggtggtggcagtatttggacgcatcatcactcctgggcagatgctgtgtgtgtgccttttaccttcttgttgttccgtagcatgtgctttagctgtgaaatgtaatgaacttacaagaaccttaagagctaggtgtcaggttgcataaagggtcccagttccattccgcccaacctgggcggtctggtctccgactcctatacatattatcagacctgtcttgcttgcaccgtcggatcctctccccagaccagaagcgctggagaagcagagatcatttacattgtactactacaagtgtactgttggaatttcatataagtttggaaagtgttcttgtcaatataccctaaagatttggaaaggtacaactttattattcc

SEQ ID NO: 50 - DNA, 1718 bp, Hordeum vulgare
cccaaacctagcaacctaacggcgaagctctctagctttcggcggctatggaggacgacgacgactgtcctcccctcgccgtcgagctccctccgcagaggacctctcctctggttcccgcttcctcctccgcctccgcgccggtcggcgtcaccgtcatcaccggctacctcggcgccggcaagtccacgttagtcaactacattttgagtggacagcatgggaagagaatagcagtaatactgaacgagttcggagaggaaattggagtagaaagagcaatgatcaacgaggggcaaggtggtgcccttgttgaggagtgggtggagctagcaaatggatgcgtttgttgcactgtaaaacacagcctggttcaagcactcgagcaacttgtgcagactaaggagagaatggatcatattttattggagacaactggtttggctgatcctgcaccacttgtctccattctctggctggacgatcaattggagtcatcaatcagactagactctatcattacggttattgatgcaaaaaacttcaggcggcaaattgatgaacacacaaactcttcctcgttccctgaagcatttcaccaaatcgcattcgcggatgttgtgatattgaacaaaattgatttagtaaaagatgatctcgaggatttggaaaggcaaattcatgatgtcaatgagcttgttacagtggtgcggtctgtgcggtgccaggttgacttaaatacaatatttgatcgacaggcatatggtgtgaagaattcatcgcaactacaggagcttctggagtacagtaaatcagcaccacctaatagtcgtcatgataacagtatttccacgttgtgcattcatgaacaggatccagttaacttggctaaggtggaatcatggcttgaagatcttctttgggagaagaagtccaacatggatatatatcgttgcaaagggattttaaatatccataattcgaaccaacttcatacattacaggcagtaagggaagtctatgaggttgtgccggctcgagaatggtctgagacacaacctcgcatgaacaagatagttttcataggccgtgatttggatatcagtacccttcaagattcatttagtcgctgcaagcactgatcaccgaattatttgcacgtcaccatgtacctgtgtcattggatacttcacggaggctcacacggcctggactgagattaggggcgggggggtctcgtatggttcccggaagttttacattctgttgaacaatcttcagtagaggcgaagcagtttgcagtgcaagagagatcaagagacaactttgagctgctgctgtgaagctatgtgccacgggagcagctccctgatacactagaaaggcattttgctgagcatttgtatatgttcagtatagcgactgcaaccgtgttcgtgttcggtttcgcagagggaaaatgtatcaaaccgtaagaggatgtgacctaaatatggcgcagaaaatggaagatgcctctgaaactttttggttcttttttgggggcgcagctagctccctttccttatggaagggttttggttctagtgatatccaaactgatggttgcatgcagacaggggcttactggagatattgcttccataattcgttgcctcttgtgcttctagtcaccttgtaactgctatttcgagcttaattctgatactaattacctc

SEQ ID NO: 51 - DNA, 1139 bp, Hordeum vulgare
gggagcttctaccatacgcgaacagattcgaaacgagccgccagtcacgcgtccgctgtccttctccccccatttatttcgtgtcgctgcggcgctgtcgctcggtccgcttcccaatcccaatctcatcgccaggcaatcactctcgcccctccccaccagcgcgcgcgacggacatggctagcccgcagtgctgcgcgaacccaccgacgctcaaccccgccgccggcgagggcaaggtcgtcgacagcttcggcgggatcaaggcgtacgtcgccggcgcccaagagtccaaggccgccgtagttctcatctccgacgtcttcgggtttggagcgccgaatctgaggaagatagccgataaagttgctgcgtctggatatttcgttgtggtgccagatttcttgcatggggatccatatgtacctgaagacgctgacagaccaatagcagtgtggatcaaggagcataccgcgggaaaagcatttgaagaggcaaagcctgttatcgctgctctaaaggaacaaggagcgtctagtgttggggctgcaggttattgttggggtgcaaaggtagtcgcagagttagcgaaagctaatgagatccagacagccgttatgtcgcatccttcttttgttactgtcgatgatataaaagaggtgaaatgccccatcgctgtacttggagctgaaactgatgtgatgtccccaccagaattggtcaaggagttcgagcaggttctatcatctaactcagggattgctcactttgtcaagatcttccctggggtttctcatggatggaccgtgagatataatggcgaagatgcggctgctgtaaagagcgccgaggaggccctgacagacatgattgactggtttaacaagaacctcaagtgaacctgaattagcggccctccttttgtaataactaataagcctgtgtcattcttcacgagtcatcacgcgagcatccggggtttatgttatggtgtttgctctagccgatgcctataggacatgcgtctttgtctgtcgcaggcgtgctggttggtgtgtgattgctcattccggggtctgcttgtgctgaacactgaactattgtgctaaataaaatgtggtgcctgcagttttagagag

SEQ ID NO: 52 - DNA, 2571 bp, Hordeum vulgare
ctggtctggtttgatcggaccctttttcttttcttttctttgggcagcgatccttactcgtgctggttgggtcttggctgcaggggagggggatttggagattgggttggcgtcgccggggtcggagggaggaggggtttcgcccgccgccccaggccgccgggcgctcgagtcctgcctctccgggaagcgcctcgaccagtcgccgtcgccgtcgccgtcgcgggcggccaggcgccccgcgctagtcatgtccagctccgggaagcgcctcgaccagtcgccgtcgccctcgcgcccggtgctcctcatgtcccactccagcaaccgcctcgaccagccgcccggccgcccggctctggccatgtcccgctccagcaaccgcctcgaccagtcgccggcgtcgtccccgacgccggccaagggcccggcgctcgtcatgtccggctccagcaagcgcctggagcagtcgctcgcgtctccgtccccgtcgcctaaggccggcgccgccgcgccgcccgtgctggtgctctccaactccggcaagcggatggaccaggcgggccggaagaagtacgttaagcaggtcacgggacggcacaacgacacggagctccacctcgccgcgcagcgcggggacctcgacgccgtgcgccagatcatcgccgaaatcgacgcgcagatgaccggcaccggggaggagttcgacagcgaggtggcggagatccgcgccgccgtgctcaacgagcccaacgaggtcggggagaccgcgctgctcatcgcagctgagaaaggcttcatcgacgtcgtcgtcgagctgctcaaccactctgacaaggagagccttgccaggaagaacaaatcaggattcgatgctctgcacgtcgctgcaaaggaaggccacagagatattgtgaaggtactcctcgaccatgatccatctcttgggaagacgtttggccaatcaaatgtgactcctctgataactgcggcgattagaggccacctcgaggtagtgaaccttctgctggagcgagtttctgggttggttgaactatcaaaggcgaacggaaagaatgcattgcacttcgctgcccgtcaagggcatgttgaaatagtcaagtctttgctagtcagtgaagctcagcttgctcggaagactgataagaaaggacagaccgctttgcatatggcagttaaaggaacaagtgctgccgttgttagagcactcgtgaatgctgatccggccatagttatgctgcctgataaaaatggcaacttagctttgcatgttgccaccaggaagaaaagatcagagattgtgaacgagcttctgcttcttccggacatgaatgtgaatgcattgactagggatcgcaagactgcattcgacatagcagagggtcttccgttatcagaggagtctgcggatataaaggattgtttatcccgtgctggtgcagtgagagcaaatgatctgaatcagcctcgggatgagctgagaaaaacagtgactgagatcaagaaggacgtacacactcaacttgagcaagccagaaaaactaacaaaaatgttcatggcatagcaaaggagctgaggaaactccacagggaaggcatcaacaatgcaacaaactctgtcacagttgtggctgtgctcttcgccacagttgcatttgctgcgatattcacggtgccaggtggtaacgatgagaaaggtgtggcaatcgttgtgcatgcgttatccttcaaggtgttcttcatcttcaatgccatcgccttgttcacatcattagcagtagtggtggtccagataacacttgttaggggcgagacgaaagcagagaggcgagttgtggaggttatcaacaagttgatgtggctggcttcggtatgcaccacggtggcattcatatcctcctcttacatagtggtgggtcggcacttcaggtgggcggcgcttctggtgaccctcattggtggggtgatcatggctggcgtgctcggtacgatgacatactatgtggtgaagtccaagcgcacacgttcaattaggaagaaggtgaaatcaacaaggcggagcggctcaaactcatggaaccacaactcggagtcagattccgagatagaccggatatacgccatatgaggtgatctctccggtctatagatcctcggtctttttggcggtgccacacggcacggatgtaaaaagaatggcgggatggcactcagtataaacagctttgaccctccaggtgctgtgggtatatggggttttaccgtatacattccaataagctggtgttcctctatgggcaggagccaggagcagacggtacacggtcgtgttgtatacatcttctacagatagattgtgatcatcagaatatgcatgcagcctgtgctgtgctccctatgcatggctggctggccttcataaaatttctctcggccttcttttttctaccttttgttaatatgctgtggtagcagaatggtatgtgtacttagcactctgtaccttgtatttcatctgatagctgagaaggatctagaagcttctgtttt

SEQ ID NO: 53 - DNA, 2372 bp, Hordeum vulgare
gcccgcacggcaaataaacgcagagccgagagcggaaaaaggagagaaaattcctcaaatcgcgccgggcagtataagagcagccccccgccgtttccgccccgcatccaatccgtccatccatcctcaccgccgacgacaccgccggagacagcggccgagcactccatctcgagccagtgagtggcggcggaagggggaggcgagaagagctgtgggctgtggctggaggcggcggccagccaatgccgcggcgggcgcaggggtagggaggcggcgcatggggggagggaacggcatcgtcgacggcttccgccgcttgttccaccgccgcacgccctccggctccgtgctcggcagctccaaccagtcctccgccggcgaggactcctcggagctcgaggccgtcgaggacctggatctcgtgggcctccgccccatccgcgtccccaagcgcaagatgccgctccccgtcgagagccacaagaagaacataatggagaaagaattcttcactgagtacggagaggcaagccagtaccaaatccaagaagttgttggcaaagggagttatggagtggttgctgctgcaatagatacccgcaccggcgagcgggttgcgattaagaagatcaatgatgtgtttgagcatgtctcggatgccacacgcatcctccgtgaggtcaagctccttcggctgctccgtcatccggacgtggtagagatcaagcacataatgctccccccttctcggagggagttccaagatatatatgttgttttcgagctcatggagtcggatctccatcaggtcatcagagctaatgatgacctcacggcggagcattaccagtttttcctttaccagcttctccgcgctctcaagtacatccatggggctaatgtatttcatcgcgatctgaagcccaagaatatactggccaacgcagactgcaaactgaaaatttgtgactttggacttgcgcgtgtatcatttaatgatgctccttcagctatattttggacggattatgtagcaacaaggtggtacagagctcctgaattatgtggctcctttttctcgaaatacactcctgctattgatatttggagtattggatgtatatttgccgagcttctcactggacgaccactttttcctgggaagaatgttgtacaccagttagatataataacagatcttcttggaactccatcatcagaaaccttatctcggattcgaaacgagaaggccaggaggtacttaagttgcatgcgaaaaaaacatcctgtgcccttgactcagaaatttcctaatgctgatccgttggcggttcgcctactggggcgtttacttgcatttgatcctaaagaccggccttcagctgaagaggctttggcagacccatatttcgcatctcttgctaatgtggaacgtgagccttcaaggcatccaatttcgaaacttgagtttgagtttgagagacgaaaggtgacaaaagatgatgttagagaattgatctatcgagagattttggagtaccatccacaaatgctggaggagtacatgaaagggggagatcagattagcttcctctatccaagtggggttgaccgctttaagcggcagtttgcgcacctggaggagcattacagcaaaggagaacgaggttctccactgcaaagaaagcatgcctctttaccgaggcagagagtaggtgcatcgaacgacagtaataatgaacagcatattagtgatcaggagatgagtgcagagcctgatgcccatggtgcagtgagccctcaaaagccacaggatgcacccggtgttggtcagaatggtctgagccccaccagcttgagctcgcggacctacctcaagagcgcgagcattagtgcttccaagtgtgtcgttgtcaacccgaataaacagccagagtatgacgatgcgatctccgaggaaacggaaggggccgtcgacggactatccgagaaggtctccaagatgcatgcctagtgcagcgccgatgacggaagtcggcaccgcatttctcatttccgtcaggtacaccggatgctgatagcaaagcagtgcggtcctagggaagcactgcatacaagttggagattgtttagcgagtgtgtgatcctgccaagcatcgctgctgcacgcaggaactgttgccctgcatgggttgatgtatttttacactcaagattacagatgtaacaccgggattagttcctacacatatcatctatgcatgattgtaacgaacagagcaagacatctgaacgctgtcctgtttcgctgttgaacattcttaatatatcaacaagcgtcactgctgtgcatctattgggttcagcgt

SEQ ID NO: 54 - DNA, 786 bp, Hordeum vulgare
acgtgacgagcgtgaccaggcgctgggcttacgggccagcccatgtccgggcgtcatcccccggagagcaacgcgagccacccaaacggagggacctcgtccttcctgccgaaatgctggccgccaccgccgcctgccgcgcgccggcgcggccgctccccgccgcgcgacccggaagcagctacctcctcggtcgcgtccttctccccaagcggagagcgccggcggtgaggaggaggggacggagcgcggcggtgcggtgcgggctgctccccgtggacccgtgggctcccggcgtggactcccagagcatcgcgtcgcagctcttcgccgtgtcgctgttcccctacctggggttcctctacttcatgacccggtccaagacggcgcccgggctcacgctcttcggcttctacttcctcctcgccttcgtcggcgccaccatacctgctgggatatatgccaaagttcattacgggacctcgctgtcaaatgtggacctgctgcacgggacggcggaatccctcctcacactcaccaatctgttcatcgtgcttgggctgaggggagccctgaggaacttggataaagcagaggagagcagccctgaagctcctcgggacagcaaggagaagagttcagtataggtgcttgtaaattgttggaaaacctctgttttttagtgtgtgtagtgatgctgatgacattgtactgtagtgagtgtacatttcttctgctcaactagttgctgctgtaataagctgcacatgttggctttgtgcattt

SEQ ID NO: 55 - DNA, 719 bp, Hordeum vulgare
gtataccgccacctaattaaccagcccctcatcaatcacagagagacgaaagagatggcctccttctccaaacaggcggcactcttcttgctggcagcgctgctgctgtgcctcgtctgcactagagggcaagcagcaaggcctacaccaggatccagccactacaaatcacaggatgctggctccgccattttccacgagaaggttgctgcaggagccgagatggaaatggagcaggaagatcaggaggcggtgagaggatgcgagggaggggaagaagtggaggagtgcctgatgaggaggaccctcgtcgctcacaccgactacatctacacccaggggaagcacaactagatggtgtgctgaaaccctgaaactgctggtgcttaccaaggactccgtgaactgaaggccatacctggatgatcgcatggttaagcaggccctacttaagaagagaggcatttttcatgagctcgtcggtctgttctgcagtcccatgcatcgtctgtgaattacagctatagacctatagtcacccctttgtattttgcctgtttccttgttgttgttgttgttttgtcttttttgcgtggtctgtttccttgtttttaggtcatgtatctgtactggattcgaacttttatcatcatatatgtatttactgaatattttatctcttcatctatacactgatgaatactacagttatagctaac

SEQ ID NO: 56 - DNA, 676 bp, Hordeum vulgare
gcattgcacctgagcaatcgcagcatccacagcgcagaaatccgcagccatggcttcccagctctccgccatgacctccgtgccgcagttccacggcctcaggacctactcctcgcccaggtccatggcgacgctgccgtccttgaggaggaggaggtcccagggcatccgctgcgactacatcggctcctccaccaacctcatcatggtgacgacgacgaccctgatgctcttcgccgggcggttcgggctggcgccgtcggcgaacaggaaggcgacggcggggctcaagctggaggcgcgcgagtccgggctgcagacgggcgacccggccggtttcacgctcgccgacacgctcgcatgcggcgccgttggccacatcatgggcgtcggcatcgtgctcggcctcaagaacaccggcgtcctcgaccagatcatcggctagaataacccttccttttccctccatagctgttctgcatccatcgggcgctccatctagtggatcaactaatgctcccttcgtaatttgatcatgtgaatgtatgtgtatgcatctttgtttcagcgggacgtaccgccgcgccggtgtggcaactgcttcatcccatgcgttttttcaccatctatagtagactattactccctctgtaaattaacataaaaacatttaaat

SEQ ID NO: 57 - DNA, 2980 bp, Hordeum vulgare
gtggataaggagcacgggcggaattattacaaaacgcaggggttaatttgcaaaatcgaaacgtttttctaaatccactcacatagggactgcaggttgaatacataaaactgcagggacgtttttataaacgtgccgcaacgggtttttcgactgaaataatagccgttttagtattagaataaagatacaaggacaagagcaagtgtgattcaaagggataatcatctcaatcccgtagtacaaacttagcagcaattaatttgacatgatccctcggcccctcctgtcaggtatccctcgtgtgtttgcgccagaagtacgcacgaatctgtgtgaccattcgttgtcccgtccctttcgtcttcattcccccttgcaacctgcaccccaccagcaaaccgagctcctttccttttccaaatctccgtattaaactaacaatctgaaacccctagccccaagagcaagaaacctctgctcctcccagccagtggcttagcatcagattccctctctcagcctcagggcacagccaaaacagcagtgacagcacagggcggctgcgaagccagtcccactttttctcgatttattgctagttttctcgcttcccctttggtgcttgttcttgtttagttagttaaccgcccgtacccaccgccaatccccaggccgccgcctgctcttgccaaaccccaaccacccgcagcagtcagcaggacccgctttctcctgcctatctttgtctcttcggccttgggattgattgctaacggttcttgaaaattcttcctggaagcaagctctgttttagttttctcattcttctgctgccgtcttgccaagttcgtggggttggataacgttgcttgctcttgctctcgaaggggaggaactttccttcaggaagggattgagcagagtcttgggttgaccgggcttgtcatggagccattgactgggttccgggcctctgtctggagctgcttcaagtttttgcccttcttctgtggccttcttctcctggggatcatcaaaggtgttctgtttggcccatgggcctggtttattatggcgatcggaatatctgcactcgttctgggattatggcctatgcatgtgatttggacatactactgcatcatcagaaccaagctggtgggacctgttgtgaagctgctgcttcttatttctgtatctggggttttagtcatgtggctaatagttggcgtccttggaagtgtacttgctgggttagcatacggctttctagcaccagtaatggccacatttgatgcactcggtgaaggaaaagaaaggccactcgttcattgctttgtggatggaacatggagcactatcacaggaggctgtacagtagtcagggacatgaaagacatgctattacattcatatcttgcatatatggatgatctacggttccacgaacctcctggcggaaaaccatttgaaataagagtgcttgatattcctggcgcagtactcgctgctgcatgtggactcctaatggatgggataatgttcacagtaattgccttgtacaagttccctgtgatgcttttcaaaggatggaagcggcttattgaagatctagttggcagagaaggaccttttcttgagacagtgtgtgtgccatttgctggtctggctattcttctctggccatttgctgttttaggagccttcctagcctccatgatctccagtgttcctctaggcgcatatgctgccattgtggtttatcaggaatcatcgcttttcatgggactatcttatgcaatatcatcagtatccatcttcgatgagtatacaaatgatgtacttgacatggcaccaggatcttgctttcctaggtttgtataccggaagaatcaagcttccgtggaaagtggaccgctctcaaggcctgcctcattcagggataagcaagatggaaagaaagccccagcacggattacatcatttaagagtagctttgatgagttcaatccatttaagttgctagatcacctattcgaagagtgtcagcaccgtggcgaggctctggttgctgaaggagtgataacaccgaaagatattgaagaaacaaagtcaggcaaaggcggcagcggagtacttaatgttggtttgccagcatatgttattctcaatgcactcctacgatctgcaaaggctgattctaatggcctgcttctgagagatggctgtgaaataacatctgacaacaggcctaagaatacactatttgattggttctttgaccctctgatggtcatcaaggatcaaatcaaagccgagaattttacagaagaggaggaggcgtaccttcagaaacgcgtattgttgatcagcgacccgaagcgcctcaaggcgactcttccacatttgccatccctgaatgagcgaaaacaagcagaaatagacgcatttgctcggaggttgcaagggatcacaaagtcgatatcaaggtaccctacatccaagcgccgtttcgatgaccttgtcaaagcgctttccgaggagcttgagagggcaatgggcggcagccggtctgtcagaggatcacagtttcagaagctcaaaagcggccttgttagaatgcttagccagagatcgatggggaagacaacaagcatccgaggatatgatcaagaggcgcagctcaacagcaacgcaagcgctgcataatatttcaaaaaagcggtgaagagaagattgcgttgtccatatgtgtttcctcagttgttttcactaactttgtacatagagctgaccctggtgtatgggttgtatattgcaaacttgcaatgctccatgtttcagaaagcaaagttcgccttgttttttcccctcaaaaatacggattttattagctagccaactgagttacattatccatcaaaatggtgttacagtgaaactatgaggagtctccaactaaatttgagaatcactc

SEQ ID NO: 58 - DNA, 3998 bp, Hordeum vulgare
gggaagagagaaaaaagcccgcattttttatcgccggatcccccgtccccttcctcttcacccaccgcgccatctccaggaaccgtcgcggaggcgccgccgctcgtggagtcaggcccggccacgcccccgcagatctccgaccaacccctgattcgcggctgtgtcgccatggacggcggggagacccaggtcgtggacgacggagggacgccgccgctggggtctccggttagctccggcgacacgacccagagcgggggcgaggaggatggcaacggtctgcgattagggtctccagttagctccggcgacacgacgcagagcgggggcgaggaggacggcggcgtgctgtatggcgagacgcagccgctggacgaggacgacgaggagaccgaggcggttgaagaatttgagggggagggggaggagaggatgtctgatgacacacaggtggtggaggactcagaggatgatgccggtggcttcgctgggcagacacaggcagtagaggaggaagaggaagatggtggcagcacggaggatgaagccggtgatggtgtggtggaggactcagaggatgatgccggtggtgtcgctgggcagacacaggtagtagaggaggtggaagaggaagatggtggcagcacggaggatgaagccagtgatggggataggacccagttggttgaagaatgcgaggttgaggatggtgggagtggcgagacgcagttggccgaggaatgccaggaagaggagagagaaaatgatagcagcgacgatgaggctgctgttcaacgggggacgacccagttggttgaagattcggataaagagatgggtggtgatggtgatgatgagttgagccagggcactcaagtgcaaagtgacgacgagggcctgccaaataatgagggagatgtgaaggattatgccgaggattcggttgattctgatgcttccacggaagaagagggtgccacagtcaaaagtttggaacaagggaaaaggcatgcttcgaccaatggaacatttctccggacggaaattgtagacaactctacctcatgtaatgcgtcctttggtgattgcccaggtcgtaggattgatgacgggtcttttgggtatgtacagagccatgaaaaagatgggagtaaaagcaaaggcaggtgctcaacagcaaagaagctttttgctgacacaacgaacgaacagaaggaaatcaagagcaggtgttttagtggactaagctatctcggatcacaggagcctggtgagctatctcaagcaaatgctttggacgttgtggaggggttgatctcaattcatggcggcatatcgtctcaagaaccatcaccaaaaaaattagaaaaagcaaagccacctgtttcagttaagatgggaactttactattggctgagaaggttgaccggcgtagaagttccagtggaaaagcagaagtctttgcatgggtggatagtcgcgaggatgatggcggaggtgattttttcaggaaaaacaaggatatcttgttgcaccaatcagctggcagagggaaatcaaaaattcccaggccaaagaaatgctccacaaaaattgcacctcctgacaagaaaataatagaggggcgcaaaaggagaacgaggtccaaactttgtgagaagactgaaactttaccttcatcggattcgagactactcaaaagtgaggtgaagagtaagagggcttctggaaaaaggactgagaaaaagcttttgaaagacttggatgatcatctatcgactgccaaacctattgaaagacagcaggaaaaggtcagtgtggatttgcatgatgttggtcaggatactcaaatggctgttgaagctatagaagcactggcacaaagttcccctgctgaaaacttgtcagccagagttgaacctccagtgaagagagatctgagagttggatctaaagtagaaaaaggtaacccaaagagtggccctcctagaaagagaaccagcagcgtccaggaaggtgtcacgacacgttctaaaagaataaaagtaactgagatgaaccacaagcctcagaaaggacagggaggaatagaaatgcgacataatttagaagattgtgcaacaaagacgaaacataagcaggcaaagccagtaccacagaagaataaagttgcaaacattgttgatggaaatagttatgacagtacacctgttgttcgtcgaacaaggcacactggtagaaataacctctatgagtctcccgagttatgttctaataagaacttgaagaaggccactgttgcagatgtaagaaataatcatagcgaacatggacttgagagaccggtgattagtgagagaaccgcagaatatggttcagattctatgttcaaagaaaacacagaaattgcatgtgcaaataatgctcagggtcttcagccaagtactgatgcaagcatacagcataccagtgcaaatgttgctcagaaccttgaaccattaagagatgaaccaacaactcatgtcttccgcagagagccctcatctcaccccaaacagagaagaacacctactgcagtggtacaggcaaaggctcctgcagttaccgaggctgctacaggtcatgatatgcaaccagaagtgacaaggccatccaagaaaagacggatttttattaggagttcagaactgctaacgtatgcaaggagggagcgctccgattgcagatcaaattgtttgctgtctagtattctcacacaatcatcagctgcttctcctgttcttgattcttcatctggagttaacagcaaaacttctggtgttagtagctctgatcagcgacaaaagaaaccatctggtgttaaggatgcaggaaactcaccaaaatgtaactctccggtcccgtgtagtggcctgaaaacaccttctaaagtggtaagcaaattgtcacctactttcagtcctctaaatccatcaaaagcttcaagtaggagcctgttgaaaccctctattgccagagagctgctggagttagatcctgaaaatgctctaccaagtcgataccgaaaggattctagaagaaaagatatgaccagttgcagtattatttttagccatcatttggatgaggatgtgatcaagcgtcagaagaagatcttggcacgcttaggagcccatgaagcatattccgttgcagatgcaacacattttgtggcggatggtttttaccgcacaaagaatatgctagaggcagttacacgtggcaaactggtagtgacatcaatgtggcttgaaagttgtggagcagcaggctgttttgtaaacgataagaagtatattctgagggatgccaaaaaggaaaaggagatgggtttcagcatgcctatatcactggcctcagcttgcaagagtcctctgctgttggggaaaagagtgtttgtgacacaaaatgtgaagccaagtcgagaggtggtgactagcttggtttccgcatcttctgggcagccattggagaggatgggtaggtccataaggaaggaaaaggaagcagcagatgacctacttgtcatctcatgtgaagaggactatcaaacatgcgctcccctcgttgagaaaggcattgatgttttcgatgtggagcttctgctgaacggtatagtcacccagaagctcgattacgagaggcaccgccttttcttggaccgtgtgaagcagacccgctcgacgaggtggctgaaagacggcgcccacgggcagtttgtgcccgtatcaaagagttgataccataccagtgtaaatgtatggtgtgctgtggccgatgcctgttttatgcccatcctcaagttctagctctgtcgtgtgattaaaatctgtaatttgtagggtgtttatatgtgtctctgttgctttaaacctctgtttgcatgcatcttggtcacgcttgcagctgatcatgagttatgatggccagtttctaatggctgctttgatcctcc

SEQ ID NO: 59 - DNA, 1752 bp, Hordeum vulgare
gctctgattttgtcggcggcaagggatggcggcgtgggcggagcagctgcagcgcgagctcgccggccgcggcctcgccgtcgcctccgttccagggaagggccgcggcctcgtcgccgcccgcagcttcttccccggggaggtcattatttgccaggaaccctacgcttctacgcccaacaggatctcggttggatcgagctgcgaccactgcttcgcctccggcaacctgaggaagtgctcggtttgtcgagtagcttggtactgcgggagcgcgtgccagaaagaagaatggaagctgcatcaacttgagtgtcaagccatctcagcgctcacagaggaaaggaagaagatgcttactcctacaatccgtttgatggtgcaacttatactaagaagaaaactgcaaagcgaaaaggccattgcatcttcagcaacagataactacaatctagtggatgcgttggagtcccacatctcgaaggttgatgataatcagttggtcctctatgctcaaatggccaatcttgtgcagctgattctcccttcaattgaacttgatcttaaggaaattgcacatactttttctaagtttgcctgcaatgctcataccatatgtgatcctgaattgaggccccttgggactggactgtttcctgctatatcaattattaaccacagttgtgtaccgaatgcagttttgctatttgagggtcggactgcatatgtgcgcgcattgcaacccttgagtagcaatactgaggtatcaataagttacatcgaaactgcagcaaccactttgaagagacacaatgatctcaagcagtacttcttcacctgcacatgtccccgatgtattaaggattctgaggaagatgatctcctggagggatacagatgcaaggaccaaaagtgtgatggctttctgctgcctgactcgggaaagaaggcttatacatgccagaaatgtagcatttctagagatgaagaggaggtaaagaaggtgtcaagtgaaatattactgttgtctgacaaagcttcttcgcttctttcatctggaaataatagtgaagcaggttcagtgtacaagatcattgagcaactagaacagaagcattaccattctttctcgatcactttgcttcacacacgtgaaacactcctgaagatatatatggagttgcaagattggcagactgcattgatgtattgcagattgactattccagtttatgaaagagtttacccaccttttcatccaatggtcggactgcaattctatacttgcggaaagctcgaatggttgcttgagtacacggaggacgctctgaaattgttaactagggcagcagatgtacttcggataacacacggcacacaatcccagttcatgaaagagctatttggtaagctggaggaagcgagggctgaagtttcatttcggctgtcgtctggagaggagcaaatttcatgagaaggcacaactcaccgcgatggcagatatggatcgtcaatctcaggacagcggtatagggtactactaaggatagcccattagcaccctgcagacgatgcctgaagatgatacaaagtataccgtggtaacaatgagattgaaatccaatctttcgtagagggagggtgatggggacaagggtggttaaacggatcgcataaacacgctctacaaaccgcatgcctttgtctgatgtaacatggataaggtgttgagtttaatgatgtagcattatt

SEQ ID NO: 60 - DNA, 1687 bp, Hordeum vulgare
ataaaagccgcctcccctcgccgttgccggacactgccaaaaagcaggggccgccaacctcccctccgctctgctctgctctgttcgccattgtcgtccggtgaagcaatggcgcgctgtggtgtcgccgttctcttgccgatcctgctggcctgtgtcgcggcgtcggctgccgcgggcggtgcggatcggcagcaccggcgggggagcggggcgtcggcgcggctgcagctggtgcccgccgctccgggcgcgtcgctggcagagcgcgcgcaggacgaccggcaccggcacgcctacatctccgcgaggctggcgtcgtcgtcgtcgtcgtcaagccggcgccgcgcggccgagacgtcgaccgccccgatgcccgaggcgtcggcgttcgcgatgccgctgacgtcgggcgcgtacacgggcacggggcagtacttcgtgcagttccgcgtgggcacccccgcgcagcccttcgtgctcgtcgccgacaccggcagcgacctcacctgggtcaagtgccgcgggcgccgcgcgtcctcgccggacgcgtctccgttagcgtcgccgcgcgtgtttcggccggccaactccaagtcgtgggcgcccatcccgtgctcctccgacacgtgcaagtcctacgtccccttctccctcgccaactgctccgccggcaccaccccgcccgccccctgcggctacgactacaggtacaaggacaagtcgtcggcccgcggcgtggtgggcacggacgcggcgaccatcgcgctgtccggctccggctcggacaggaaggcgaagctgcaggaggtggtgctgggctgcaccacctcctacgacggccagagcttccagtcctcggacggcgtgctcagcctcggcaacagcaacatctcattcgcctcccgcgctgccgcgcgcttcgggggccgcttctcatactgcctcgtcgaccacctcgccccgcgcaacgccaccagctacctcacgttcggccccgttggcgccgcgcattcgccgtccaggacgccgctgctgctcgacgcccaggtggccccgttctacgccgtcacggtcgacgccgtgtccgtcgccgggaaggcgctcaacatccctgccgaggtgtgggacgtcaagaagaacgggggtgccatcctcgactccggcaccagcctcaccatcctcgccaccccggcgtacaaggcggtggtggctgcgctgagcaagcagctggccagagtgccgcgggtgaccatggacccgttcgagtactgctacaactggacggccacgagaaggccgccggccgtcccgaggctggaggtgcggttcgccgggtcggcgcggcttcggccgccgaccaagagctacgtgatcgacgcggcgcccggcgtcaagtgcatcgggctgcaggagggcgtgtggcccggggtgtccgtcatcggcaacatcctgcagcaggagcacctctgggagttcgacctcgccaaccgctggcttaggtttcaggagagccgttgtgcacattaattaattaattaggcagcacttagtggtcatttcttctggttccgttttccttgtttcccgtaagggtctcgctgattctgtaaggctctctgtcataagcaagcgttaatgaaatgcatgggatgaaggtactatatgatactccctccgttcctaa

SEQ ID NO: 61 - DNA, 1369 bp, Hordeum vulgare
acaccgtttcccccaaatctcactcctggtgctactcccgttcttccgccatagccatggatgacgccgcgaacgccacccagacctccgccacctcttcggtggccgccgtagccgcggcggcccagcaccagcagctccagcgccagctctttctcatgcagcaggctcaggctcaggcccaggcccagccccatccgcaggcgcagcagctgtcgcagcaggccatgtcccgcttcccctccaacatcgatgcccacctccgccccctcggaccgcaccgcttccagcagccagcgtcggcgccatcgcagctccagaccccaccccagccgcactcgcaggggcagccgtccccgcagcaatcggcgcaggctagggtccggagccccgaggtggagatggcgcttcaggacgccatgcgggtctgcaacccggatatcaagacgcctttccattctctcgaggacgccgttagcaggttattgccttaccatgttgttgctgactacgaggctgaagaagatgacaggatccttgacagcgatgcaactggccagattccctctcgtcttcagcaatgggatcataacattctggtaaaaattgctgagttcacaacaacttttgagaagcaagtgttggcatacaacataatgaccaagaaaagggccatcggtgagtttcggtcggaggagcgactcatgctagagcaggctttgttacaggaggagaagcaggcttcgatggaactaagagcagagatagaatctagggagaaagcaggccgtgaagctgctgaagctaagatgcgtatggcgatggttgagcatgctcgagtggaagcccaaccacaccctgaggtgattggtcatggccctttgagggccaattctgctgcttcccaaggcgatgatggtcctagtcatgacatggcacaagaacatgttgaagatggatgggaaaacactcaaagggatgatgatgatccatccgaggatttcctcaatgatgagaatgagccagataatgggaactctgatatgcaagaggagtggcggcgatcgggggaatttgatctaaactcgaggtaagacagcgagaggaatggtgttgatggtgacaatctgattgaactctaggtaagacaggtgtactcaacttgagataaggcttgaggatgcatcggctggtgcctggtaacttgtctctagttctttgattatatatgtttttaagataacttatcctgtcattgtggttgtaaacacacaatttaaaactactgtttagctactcttgtgttcaaacttagaatgttgagatggcctctgtatgttgtaaagctaacttctaaatgggtttccac

SEQ ID NO: 62 - DNA, 3167 bp, Hordeum vulgare
aaatcgatcgtcgtggggagcagtcgcacgcggtgaggccggcgccactcccagccccccgactccaaaaccccccacttccccgcgaatcccccacctgaaatcgccccagccatggccgccgccgccgtccggagaaacgtcgcttcctcgccctccggagccgcccgtcttcgccaagccttgacggtgtagggagaggtgaaggagggggcaggtaagtgtgggagcgaatgggggcgattggaggcgacgaatccgtgcagtgggacaagatgaatggagctgaggtggtgaacggcggtggaagtggcgcaggaagcctggataggatacaggtcttggtgagggtgagacctctgagtgacaaggagattgcaaggggtgagcctgcggagtgggagtgcatcaatgacaccaccatcatgtttcggagtaccttcccggatcgacccacagctccaaccgcatacacatttgacagggtatttcattctgagtgcagtacgaaagaagtctaccaggaaggggtcaaggaagttgccctctctgtagttggtggcattaactcaagtgttttcgcgtatgggcaaacaagtagtgggaaaacatatactatgactggagtgacagagtgcacagtagcagatatatatgattatattaacaagcatgaggagagagcatttgtgttgaagttctcagcaattgaaatatataatgaagttgttagggatcttctgagtgcagaaaatactcctcttagactttgggatgatgcagagaaaggcacctacgtggagaatcttatggaggttatattaagggactggaaccacctcaagggacttatttctactgttgaaagttctgctcgtgaattcttaggaaaggacaagtcaactacccttgtggctagtgtgaactttgttgatctggcaggaagtgagcgtgcatctcaggctatgtcagctggcacaaggctgaaagaaggttgccacattaataaaagtttgctttcccttggcaccgtcattaggaagctaagcatgggtagcaatgcacacataccgtatagagattccaagcttacacggatattacaaccttctttgggaggcaatgcaagaactgcgattatttgtacactcagccctgcgacaagtcacattgagcaatcaagaaatacactgtttttcgggagttgtgcaaaggacgtagttacaaatgctcaggttaatgtggtcatgtctgataaaacactagttaagcatttgcaaaaggaagttgctagactggagagtgagttgcggcatccagtttcatcaaactctagtctggaagcacaggtgaaggaaaaggacaaccaaatcagaaagatggagaaagaaataaaagaactgaagacgcaacgtgatttggcccagtccaggttgcaggatttgctgcaagttgttggtgatcgtgatccaaagcaccaggtctcgggaaagcgttcaatcagaagtcctccgtctgttggaatgcccccaagcgctagcagagatgacagttctcagatctctcatgatgattcagagcattacaaggaagtgcgatgtattgagacaattgaaactggaggaaatgaacgtttgtctttgtcagctggtgaaagtaccagcccacaagattcaaataggaattcgagcatgcgtggtaatgattcaaataggaattcgagcatgcgtggtaatgattcaacagcttcagtgaattcaaggcgccttggtgaaactcctattaccttggagcaacatttggagaacatcagaaggccttttatcactaaagatctaggatcttcaacccgcaatccgtcaagttgtagagtaattggtagaagcaggagctgtagatcactaacagggtccactttacttgatgagatggagttggaggattgcacaccagtaaacagaagtttggtaattttcccaggaagacctgaagagtaccagagaagaggatctgcattaaactatgatgcagggagtgagactccttcaagggcaggatctgaaattagtacttcgaagggagctagcaaggcaggtgatgcagaatttaccggtataggtgaatttgttgctgaacttaaggagatggctcaagttcattatcagaaacagttaggtgaccagagtgcgaatggaaagagcgtcggattagacccaatgatggatgctttgcaatcaccttctagatggccattggaattcgagaggaaacagcaggagatcatcgagctctggcacgcttgcagcatttcgttggtccacaggacatactttttcttgctcttcaaaggagaatcagccgactcgatttacatggaagtggagcttcggaggctgttgttcctcagagacacctactccaggggaagcacccccagcaacgtggtcgtaggcagcctcagttcttcccctgtcgcgagcgccaagaagctgcagcgcgagagggagatgctggcgaggcagatgcagaagcggttctccgtggaggagaggaaccacatgtacaccaagtggagcgtcccgctggactccaagaagaggaagctgcaggtggctcggcggctgtggacggagagcagggacctggagcacgtgagggagagcgcgtccctggtggccaagctgatcgggctacaggagcccgggcaggtcctgagggagatgttcgggctcagcttcgcgccgcagcagccccccacccggcgctcctccaacggctggagatatgggatcccctcgtttggttgattgaattggttggttgatcgggtccgtgacggcacgaggcgagaagatgacaggatgatgcggctgaccagaagatctttttttctttctctggtggttttatgtcttggggtgttgcctgttctgattttccatagggtatcaggacacgcgcatgcgttgggggtttgatcttggtgtagggcaacccggtttggtgcgcggtttctacgtaggcgccgccggtctttttccggtctgattgctaacattattaacgtgtaccactgcgtatccaaacgcacgcccttgtgttaacgtgttgttgcaattcccacggtttgcaccactcatctgtaagaaatggttgttccgctgtgt

SEQ ID NO: 63 - DNA, 1464 bp, Hordeum vulgare
gacaaacaaaatcaggccatggaaatcccccacgccaccaactctcgcccgctccgctccaccaatggccgccgccgccgccgccgccgcggccacgaggaaggaccgcccgccacatcgcctcaggtcgccgtccagggtggcggcggacttcgccatgggcggcgcggcggcggtggtggccaagacgggggcggcgccggtggagcgcgtcaagctgctgttgcagaaccaggccgagatgctgcgccggggcgccctcacgcggccctaccggggcatcgccgacgccttcgcccgcgtcctccgcgaggagggccccgccgctctctggcgcgggaaccaggccaacgtcatccgatacttccccacccaggcctgcaactttgcattcaaaggctactttaagagtttcttcggctatgacaaggagaaagatgggaaatggaaatggctagctggaaatgtagcatgcggcagtgctgcaggagctacaacatcgtctctgctataccatttggattatgcgcggacgcggctagccactgacgcgattgaatctcgagctaacaaacgtcagttcagggggttgctagatgtctacaggaagacacttgcaactgatggtattcgtggattgtaccgaggcttcaatgtgtctattgttggcatcactctatatcggggtctttattttggcatctatgacaccatgaaacctatcgtactagtagggccattggagggaaatttcctggccagttttgccttgggatggacaataactacattctctggggcctgcgcctatccatttgatacactccggcgaagaatgatgttaacttcagggcagccattcaaatacagtagtgccttccatgccgcaaaacagatagtttccaccgaagggttcttcactctattcagaggggtcggtgcaaatatcctgtcgggaatggcaggagctggagttcttgctggatatgaccagctccaacggtttgcaggtcggcatgattacaaaattgagaacaagatgaaaggagccttgaaatgatgtgcatatgatggatctgcatgtgcctgggcagatccttgggttttcaggttgcgtgctggccagatgggatgtggtgtgtgagctacaattaccgggctcatggagcagaacttgaaatgcctgcaagagttaatgtgaatgaattgatcagcacagtaacatttcctggaggtgaatcttcccaggacaagagatggcatcagggtgcaatagatgattaacgactagatcttattcttgaagtgtaaattaatatggtttcgaaagctgatgtccccacgtacactattaatgtaaactgtaaatagtactgtaaagactaaagagtttagggcctttttggttcaaagaaatttcataccttgtgtcaggtttggtccatttatcgatacctaaaacat

SEQ ID NO: 64 - DNA, 1230 bp, Brachypodium distachyon
ggataacaatttcacacaggaaacagctatgaccatgattacgccaagctatttaggtgacactatagaatactcaagctatgcatcaagcttggtaccgagctcggatccactagtaacggccgccagtgtgctggaattcgccctttcatacacatacgatttaggtgacactatagagcggccgcctgcaggaaagtggcatttgtccctactctctacccccgtcactcgaggaagaaaggagtggtctccgttggccgcgcgctatgggcatcggagcactgcagccggcggcggccatggccccggccgccactgcctcgaacgcagccccccgaatccaccatcgtccgtggacgcgcgctgccgcccctaggactctggtctgcaacgcgggatcaggttcttctaacaccggcgctccgccgcagccgcggacgacgaggggccgcttcgccgcgaccacggcggccggggcggctccggacgccgtgacgtactcctccagcatagacaccgacatgcccctctacgagccccccggggtgtcgttcgacgagtacctcgaggaccggccccgcgtgttccgcgccatgttccccgacgagggccggagccagcggctgggcgacgaccactggagggtccggatgctgccgctcgagttcctcctcatcaccgtgcaccccgtcgtcgtcatgcagctccgcaaccgcggccgcgcgctccacctccgcatcacggagtgggagctgagggggctggatagcggctacacgccggcgagcttcgacctgggggtgcggggctcgctctacgccgacaggtcgggcgggggatcccggctcaggggccacctcgagatctccatcaccgccgtcctcccgccgccgctgcggctcgtgccggacggcgtcctgcgaggcgtcgccgagtcggttctgtcgacgctggccgagaagatgaagcgggatgtggacgtcggcctcgtcgccgacttccggatgttccggatggagaaggcggcttccagagccaccggaacggctgtcgccagagcagagtagtagcagacagagaaagcctgaaggctcgtcaagttttcttctgaccaaaagtttgttttcctccggcggtttgagaaatgcatctttgtatagagcatggattggtactactacgtttttcccggcagcagcgaatcttaaaccgaaatgcaaggtctct

SEQ ID NO: 65 - DNA, 1308 bp, Brachypodium distachyon
aagcgacccccaaagcggccagcaagcctcctccgctcacactgacacacaaacaccacaaaggcgtgcacgcaatgaggcccttcctgctcacgccgggcgcccggctcgcgtcggccccctcgccgtcaacgctctcgcgcctgctcctcccactccacctacaaaaccgccatgcccacgcctccccctccccctccctccacgcgcgcaccaaccgctcctcgccgcctcttcgccgccgcagcggtcgcttcttcgcctcctccgcctcgtcctctcagatggcggcgcctgccgatgccccgggcggatccgcggacgcgtttgaggtgatccgcgctcaccaggtaaaagctgctcggcttcctcctattgaagaaatacgaaccattctcgaccggagtgtcaggggtgttctggccacccattcccaggaacatgtaggttatccatcgggttcaatggttgattttgcttgcgatcaagatggttcccccatattagcagtgagcagtttagcaggtcactcgaagaatctttctggaagttctaaatgctcacttctggttgccaaagacccagaggacagaacagatactgtaatcactgtatatggtgatgcgacacctgtttcagatgaagaaaaagatgcagtgagaagcgcgtacttacggagacaccctgaggcattttgggttgactttggtgacttccgttttctgcacatcaaaccaaaagctgtgcgttatgtatctggggttgcaacagctatccttggctctggagaatttagtgctgctgagttcaaggaagcaaaagtggatcctatatctcaattttccactcctattacaagccacatgaataaggatcatgctgatgataccaagctcattgtgcaacattcaaccagtgttatggtggattttgcttctatgctggatgtcgatagccttggtattaatgtgaaggctggttatgatggaagtgttctgaagctgcgtatccccttccctaggcgtgcacaggacagaaaggatgtgaagacacttattgtggaaatgctacaggccgcaaaagcctcctcctcacatgctgaatgacctgttttctcggatggtggtggctttgttcatgtaaatgaaaaaagaagaagcctaaatcaatgtcgttgaagattgatccacacagaattccattgtttcatgcatcagcgaaccattgtaacaatgaacagtccacttgaacttcgtaagtgaatgcaaagcgatttgtatatttttttaatgaaccgttttgccccca

SEQ ID NO: 66 - DNA, 981 bp, Brachypodium distachyon
aaggacaaggaagaaaaccaccagcttcactggctcaacaccggcggccacccctcatggcgacctccacctgccacctaccacctctcctccctggccccgcctccccgaaccatctccacctccgatcctcccctcccccgttcactcgccacctccgcaaccctactccggttcgtctcctccgcgcagcccgccgccgccatcccgacgccgtcgtcgtcgtcccggacgcccgtccctgggtcggcgatctatccggatccgcttcctaccgggacggcagcgaggaagatggagacgcggaggaggaggacgaggaggaggaggacgaccgcagcctggacctcctggcccggttcctgcaatcggtgttcaggaaggcctcccgccgcgcgcggcgcgccgccaggtccgtgctgccgccctccgtccccgctgagctggtaaaattctcggtcaatggtgtgctggttctcacgttcttgtggatcctcaaggggcttcttgaggtggtctgcacatttggaagcatggtgtttataagcatacttcttgttcgaggaatatggtctggagtaacttacatcagagaaaaccgatacagttatattcaacagctcaacgatgaaggcaaccggtggagcacagtacaaactgccggttgatcatttcctttccgtcttgccattatacagcacagctgcgcgagaatggaaggaaccccatgtgttatgtacaaataagtggttccgttcttcctctgggcgtatacaggagggatgcttgagttcagcaggattaatgagaacagccaaatggtgctgcagaatgttactagcagtagtttgcgtttatgcatggcccataccagcagatgtagaaagactcatgtttgttgtatgaaaggtggtgcaaaatcctttcgataattagtacggtcgtttagggcacttaaaattcatttggccttcacagaaa

SEQ ID NO: 67 - DNA, 1572 bp, Brachypodium distachyon
ggttaatcaaatctatctatccatcccatcccatcccactacagaaaaagcctctgctcttgtgtctcgcgagatttagattcacatcgcagcacaagatctcctctcttctcctatgcacaagcaaaagatttgctcttgtgagacacagaattcatggaggtgcaggccccatgtactttcacctgctcctacacccactgttccatcggattcgcccctcgggctcgcctccgctgcatcaccaggatccgtgccgcagctcatgatcagcagggcgtcggcgacgaccaaccacgccggactagtcgcctcgccgccgatggacccatacctgctgccgtcgctgctgctgccgcacaaggtcccagcagcagcagcagcagcgtattcggcgccagggacgcggagcttgccatgtgggagaagctaggagcgctcgtcaggctcagctacggcattggaatctacgcggccatggcgctcgccgggagattcatatgccacattgccgggatcgattccacgggtggattccatccgtccctcaccgctctcgtggagggcctcggatatgcatctcccccaatcatggtgctgctcttcatcctcgacgatgaggttgtcaagtattcacctcatgcgcgtgccatcagagacgtcgaggacgaggagctccgcaccttcttcctcggcatgtcgccatggcagttcattctcatcgtcgccgcgagctccgtcggtgaggaactcttctatcgggctgctcttcagggggcactggctgatatatttctcagaggcacagagctcatgaaagatgctcgaggaattgtatccctgagcggcatggtgcctcctttcgttccttttgctcaaacgtttgcagcagccatcactgcggccctcacaggatccctctattaccttgctaccgccccaaaagaccctacctatgtggtcacaccagtaatgcgttctcacaacggccgggagaatatcaagaaactatttgcagcctggtacgaaaggaggcagatgaggaagatatactcccctcttctagaaggaatcctggctttctaccttggctttgaatggatccagacggacaacattctagcacctatgatcacccacggcatatactccaccgtggttcttggccatgggctatggaaaatccaagaccacaggagaaggttacgacaaaggattcaggaaattagacaaagtggctcagacacacaccaatagtccaatagctcatagctagctaggtgaacaagttttgatccacttaattagtctatgatatactactgtagtagctagctatacataggtagagaggatagtacgccaagctgtgcatacacacacgaacgatcggggtgcatcagcatatgtacggtcgagtctatatatacttggtgtgtacctatatatgttaattagtgtatatatacactagatacgtacttaattgtatcaacaatttatttgtggctagcttgttaagcctctgaaacagcgctagctcgaaattaatgtgaaaccatacctgcatct

SEQ ID NO: 68 - DNA, 4365 bp, Brachypodium distachyon
tcgcttgcctgattcgttcgtggtccctctccggtggggggctgtggtggtgctgaggcggcggagcggaggcccggagcgagattgtttgtgcccgctctcccccaaccccgactccggcgaccactgaatcaggagggggaggaggaggatgttggttagatttggcgtgatcttatcccgaggggggcgcgcggttctggcggggtaggttttgggcggcaggcgatggaagggacgacggcggcggtggttggcggcgacggcgcggcgggggatgcgcagattaagggcggtaaggagaatgggcagcaggcgctgcagctgcagcggccgctgcagccgtcggggggcagcgaggcgctcgagatgccccccacgccgctgccgatcgcgcgggaccttgactggtccgagcatttctccttcttcaactcggcgggcgggttcactgacggcgcgagggggttggcgagcacgggcctgtcgaattccgtgtcgaggccggacagcgtgacccagtgctgcttggaaggcacggacgagagggtggaggagctcacggtggggaattgcatcagctctgatgctcagcctcacgcctctgctggtggaagctcgagcggcggggagaggcctgctgttgtgaggggcctgtggggcaatttcacgcggatggcatggaggtctagtgatgtggccagcagggaaaacttagcagcgggtcgtggcgacattgcgaacttgaggactggtgatgtggctagcagggaaactttggcagtgaaccttggcaacaatatgatctctcagaacaacttgaggactggcaatgtggctagcagggaaaatttggcggcgaaccttgccaacagtataatcgctcagaacaacttgaggactgccgatatggttagcagggaaaatttggctgcgaaccttggcaacagtatgatctctcagagcattgatgcttcgggcaaggaaatgccattcagtcgtggtgacaatgctaatagcgagttcaatatgtcatttggtaatcagcagcagcctattccgtcttcacggctgaatcaaaccgagcaacgatttgaaagagagaatggtctgaaagtgagtagtttctcaaatagaattattgatcagatgaggaataaaactgccacaccttcatctggggttcaggggtttccatttaagactgcgtcgaagggtaaaggggttacctaccaaagtgcacgtgaggagatacaagcacaagctaatgtaagacctagagtccctatggataggatttctaagattcctagctcaacacacaattctatggccagattggatggtgcatttttcaacggtggtggaaatgcttctgaatctcaaaatgagggaacaagcctgagggaactaattaggcccacaggccaagtgacgagcaagtttgagaaaatgcagttgttcaagcagatccttgatcatgtagacaaatctcatgcacggggtttaactttgcaacatgtacgcccttcatattttatagtctcacctccaaaccaagtaaaatataccggctcttatgctacacaagatttatcagccccagccaaaccggatattgccacagatgacatgttcaataggaaacgacgcttcgatcagaaaaatgcgcaccaagagtttaatggcaatggaaatccaaattcaatcctaaagtatcaaaaggtcggtgatcaaggttctgttgccgtcaggcgaccgacacatacctttcggactgaccacagagggggcaaccaaagtgaagatgttgatcctggtgcttccggacagggaaattctagttgcaccgtcagaggacgttttaacttcggcgaaccttactatggcaatggcaataatgcatcttatgcccaacgtttatccaattacggcaaccaagaatcggtacttgatttgaggttgctagaagatagctggtatagaagcccagaagagctcagtcaactgaaaggcacattcccatcaaacatctacagccttggggttattctatttgagctcttttgctgttgtgaaacatgggagctgcattgtgctgcaatgtcagatcttcgccatcggatcctgcctccaaattttctttcagaaagtcctagggaggctgggttctgtctttggctactgcatccagatcctcgttctcgaccaaaggcaagagacattctaggatgtgacttgataaatgagggtcgggatttgtcgttgttagataataaggtaccagctgctgtcaatgaggaggacacagaatctggtttattactgaatttcttgtctcaactgaaagaagaaaaagaaatgcaggctagcaagttatcagcagatcttgcaggcttacaaacagatattgcagaggttgagagaagacattcgctgaggaatgggttcagtttagaggacatgggagtactggcaagttctaatgatttgccaggcacttcttcagatgccctgagagggggatcgttgtcaggtttgctaccaccaatatgcaggtcaagcatatatgagcagagggtgatgaggaatttggagcaacttgaaaatgcatattactctatgaggtccaccattgacacgtctgagactaatgtaattaaacgttcggataatgatgctttgagggtgcgtgacaacttttaccaacttcatggtgatactgatgccatgaatgagcaaacagaccgccttggatgcttttttgatggtttgtgcaaatatgcccggcatagtaggtttgaagtacgaggaattttaaagaatgcagatatacttaactcaccaaatgtgatctgttccttgagttttgaccgtgatgaagaatattttgctgctgctggggtttcaaagaaaattaaaatattcgaatttgatgctcttttaaatgatcgtgttgatattcattatcctttaatagagatgcctagcaagtccaagcttagttgtgtctgttggaacagctatataaagaactacttggcatcaacagactatgacggcactgttcagctatgggatgcaagcactggtcaaggattcacgcagtttacagagcacaggaaacgagcttggtctgtgagtttctcagaggtggatccaactaaattggcaagcgggagcgatgattgttgcgttaaagtttggagtattaaccagaaaaattgtgttgacacaatcagaaatgtcgccaacgtatgctgtgtacagttctccccatactcctcccgtatgttagcttttggctcagctgattacaagacatactgttatgatctgaggcatacgagaatcccatggtgtaccatttccggacatgggaaagctgtcagctatgtaagattcttggatccagaaacacttatctctgcatcaactgacaataccttgaagatatgggatctcaaccggactaattccagtggattatctagtagtgcctgcagtctgacattgagtggccataccaatgagaagaattttgtaggcttatctgttcatgatggatacataacatgtggttctgaaaacaatgaagtatattcttactacaaaacctttcccatgccaataacttctcataagtttggttctattgacccgataaccggtcaagagacgaacgatgataatcagcaatttgtatccagtgtttgctggagagggaggtcaaatatggtggtagctgcgaactctagtggcagcattaaagtgcttgagctagtctaaacaagctgctgagaattttacagaatgagaaagtctgatcatacagtttccttgctgtttttaactcttaagcctcttagatggctgtatatcgtctcgagcattctgccttctgaatggacaactaagcgtcaacatatatcaaggcctaggttccgttcagccatcgcggcggtcgaaacatgcagctgtccaattcaagcgacctaagagacctactttgatgtttgctcgaaactccgaagcgaattgttcaaagggtatgaaatatcctagctagctattcttgggaggtaaactctgtttgtaacgcactttgacgtagtactagccagcatctcaaggagggtctagggggtggggtctgtacagatttaggggcccggaagggccgatgtataatatatatcttcaaacctggtgtacttttgagctaaagagccgcatgatatgtttggtcagtacatatccaatgggaatcaactcggtatgcaatgactaacagtctagtatgacccctaaaaaaacagtccagtatgatgcaattaatcttgcatttgatgtgtgtgactcagt

SEQ ID NO: 69 - DNA, 1516 bp, Brachypodium distachyon
gcggccgcctgcaggaaaactctctctccgtcccactgaaagtctgaaacgtggcgagccacctcgccgccgccgccgccgtgctcttcgctccgcaccgcccgcggcctcctcttccccttcccggcctgcgtgagcgagcggtggagtctggtcttcactgtcactcgcgatggcgcggcctcgggcggggcctcacccatccagcctcgtggcgttgctcctttccgccctcctactcctcctcgcccgcgacggcgcggccaggggtggcggcggcaggggcagctcggtgtacccggcgtccgtggtgtacccgcaccactcccgccagatctcctggaaacccagggtgttcctctaccagcacttcctcagcgacgacgaggccaaccatctcctgtccctcgcgagggcggagctcaagaggtcggcggttgctgataacacgtcgggcaagagcacgctcagcgaggtccgcaccagctacggcaccttcatcagtaagggcaaggatccaattgttgctggtatagaagataaaattgctgcatggacatttcttccaaaagagaacggagaagatatgcaagttctaaggtataagcgtggggagaaagatgaaccgcaatttgatttcttcaccgacactgtaaatactgtacgtggtggacatcgcgtagctactgtacttttgtacttaacagatgtcgcagaaggaggggaaacagttttccccttagctaaggactttacagacacaggtttgcatgataaggatacaaccttgtcagaatgtgcacagaaaggcattgcagtgaaaccgcgaaaaggggacgcccttctgttcttcaaccttcgcccagacgctgcaacggaccccttgagcctccatggagggtgcacagtcatcaagggagagaaatggactgccacaaaatggatccgtgtagcctcattcgacaaggtctatcatatgccaggcaattgcagcgacaacaacgacagctgcgtgagatgggcagcgctcggagagtgcataaagaacccaccgtacatgattggaaccgcggcattgcccggtcattgtaggaggagctgcaacgtgtgctagcgatttagcattgcatggggaaacagaatcgacggtaactggcttgttgttcaatcaggtccatacatgagcaacgatagctgtttaacctgagtttgttcatgaggtttggcactacaaattgcaccagtattttgttgttccctgacggactacttggttcctggttaccatgtttattgatcaatggtaacctggctggaatcagagggcgaacaacctttgttaattagtgctcataatttatggtaggcaggcagagatcagtaagcttccagtgccgaagttgtccttttcggctgtagactgtagtagagagtttagagactgcaatctttttcacttttgcggtgtatagctagctcaaatgtgttcctggattcaatattaaacctctccaaa

SEQ ID NO: 70 - DNA, 959 bp, Brachypodium distachyon
tcagcagagacgcaaacaatctgttccgtttttccctgctcctactctcctctgctggttgccaccgctctccagctcccggccatctcaagctagctcaaacacgcaacggagatacagtaaaagaggacggattgagaacaggaagatggaggtggagatgcagctggacgacgacgtcttcttcgcggagctcagcaagcggatttcgctcctcatcaccgacgacgacgaggccgatttcggctccgcgcagttccccgcctctctgcccgttccgggtttctccatggcgccccatgtgccgcagggggcttcgatgttggcgccaccggcctacacgttgttccaccacgccgccagctacggcgccgccgccgccaacaacaacaacaatagcgccgccggtgacattggcagagcgtggcagcagcaacaacaacaacagtgcggcagcaagggcaccggcgtgttcatcccccggtccacgtccggctcggcgcactctaaaaggaagggcagaaactggagcggcggatccaaggctgccgcccacaaggcgcgggcggcggcggcagcgcagacggaggccgccgctgtcgcagcaggcacgtccgcaaagagacgtgcctgattgtgactagctactcataaaatgatcaagaaggcaaaaaaaaaaaagcaaccgattaactagctccaggtgcagagagttctctaagggattggattaattaattaatatgcttaattatgtagcattattacattattatatgggtaaataaacattgttgctcccagggttaagtgtgtaatgtaagagccctagggaggcaggggaggaggagccgggagcaccacactaataagctgtttttagagagtactgcccctcccaaattgaactgtatgtatagtatgctgtcgtccatgtggtgctgccgtggttttcttgg

SEQ ID NO: 71 - DNA, 1119 bp, Brachypodium distachyon
aagtgtaagagactaagagggaggataggacgagatgttttttcagaggaggaattcaaagaaagtgaaggacaccgatggatcatcaccgaagaaggacaaagatggccgtgggaagaatgatttcttcgatcgcgccaagggtgcttttacaggaagcctcaagtcagccaagaatgacgctcaagggagagcggaaaaggttcaagcagatgtgaaggctggctttgaaacaatcttggagaagggatcaggcattctcgagaaagcgaaagaggatgttggaggtcactcagaatcagaagccagccgctcaaaggaactaggtcaaggaagtgaagaacaaggaaaggaggacatggaagctttcaattcaatgctcgacaaggtgaaaactcacccagatgtgatggacaaggtccattcggtcctcgacaaagtgaaaaaacacccagaagtgatagaaaaggttgcggaggttttacatctgggaaaacatgaatccaaagagaaagaagctgctgaggtcaaggagaaaacaaaaggcgagaaaacacaggacgctgacgagggcgcctctggcgataagaccaaaagctcaaacatcctagaggaggctgtggaagaaattcaggctgtctttgcagcggtgcagcagcaagatacagatgaaactgagattccagttgaggctgctgccgaaaccggaactccagctgaaggagaacagcccgaggaagcaaagcgggaggtggagaaagacgacccgaagaagcgaatcgatttcctcgggttcttcgccatgctgtttgagaggttctgctcccctgctgccaagaagaaagactagggtgtggcagttcagctgtggattaattctgccttttttgtgttctttgaaattgaatggtctgcttgggagggtgtggatggtgtacagtttgcagctgtgtattctcttcagagttgtttgtttttggatttgtccttgatgtttgatgaatgcagaaaaatagtgttttattttgtgtaactcttgttacttatggatttgatccaatttatgtgaatgaaaaaaacaattgaatttatataagaaccttccaccgtatcaaaaac

SEQ ID NO: 72 - DNA, 654 bp, Brachypodium distachyon
gcgagcccagacctgagtcagacacactctccagcaccggcagagcaaagcacaacaacaacaatggccaccatcagcgccgccgcggcgaccaccgtcgtcgcccgtgccgtgaccacccggccgcaggctctagggctgccacagctgagggcgaggagcgagagggtgaggtgcagctactccaaggacgccaaggaggcgaccccgaccaccagcgtgcgcggcgccggcgcgtccctgctcgcggcggcgggcgcggtgaccgcgtccgcggcgccggcgctggcgctcgtggacgaccggatgtccacggagggcaccgggctgagcctcggcctgagcaacaacctgctggggtggatcctcctgggtgtcttcggcctcatctggtccctctacactgtctacacctctggcctcgacgaggacgaggagtccggtggcctctcgctctaaagctagccttcctcgttcccatgtaataatccccgtgtgagcatggcgatgattggtgtgatgtaattccagacatggatatttgtatttaagtgtttccattctgagaaatgtttaggcggtcagatgaagtgcttgcatccctggatatgtatcgtgcatctagcagttaatcggattgaaacggtaaaggac

SEQ ID NO: 73 - DNA, 1969 bp, Brachypodium distachyon
acgcgcgaggcgaagggcgcgcgcgcacgctccttcttctagtcctacccaatccaccggtccacccccgcccgcccgacccctccccccgcgtcgcctccaaaccctagtggcgcgtccctcaactcaagcccaccaccatggaggccgtcgccggcgatgagacggtcggcgagctattgcgcgccgcggcggcgctggtgcccgctgagcactacgccatcgcggcccttgttgccttttcggtcttcgcgtaccgcttcctggagctccacgtcatcggcgacctcctccgcggcctccgtggcggccgcgtcgagctcgtcttccaccccgcttccgagatctaccactgcgtcgcctccaagtgccgctccctccatggcaggtacctggcgacgccctggcttgcaagcccgcatctgcagacattgttcctggggatttctgggaggccaccttcattcacctacaagaggcagttgtacacagttcgtgatggtggaacagttgctttggattggctgctggctaatttggaggatgggatcatttctcaagatgcttcaacaccccttgtagttgtggtccctggattaactagcgattctgatgctgcttatgtaaaacacttggtgcattccatggcgagaaaagggtggaatgttgttgtaagcaaccacaggggtcttggtggtgtgtccattacatcagattacttctacaatggtggatggacagaagatgtccgagaaattgttaattatctccaccagaagtatccagaggctccgatgttctgtgttggtacaagcataggtgccaatattctggtcaagtatcttggggaagaaggtgagaatactcctgtggctggtgctgcatctatttgttctccatgggatctagtggtttgtgaccgatttatttcccgtaagcttgtgcagcggttatatgacaaagcccttgcatttggtctaaagggctatgcagagctacatcaacctatcatggctcgacttgcaaattgggaaggtattaaaaagtcacgctctatccgggaatttgaccaccatgccacttgtgttgttgcaaaatacgagactgtggatacctactaccgtcggtgcagtagtgctagttatgttggtaatgtgtcagttcccttgctttgcgtcagtgccttggatgaccccctctgcacaagagaggcaatcccttgggacgaatgcagagccaacaagaacattgttttggcaactactccgaatggtggccatctcgcattttttcaaggattaactgctggaagactatggtgggtcggagctgtgtctgagttcctctgtgcgctgcatgacagctcttgcatgcatcggcaaaaggcaggagatcatgttttgcagtcgtcgctggagtcgtccattgataagagcccatatgtcagcatcatgggagatggaatggtagctccagtgacaaatgatggctctgataatgacgagcccccatctaaccagattgataatggattaaaactgaataatggggtgaacgattcacaacaagatgaaaaagatcataaaagctgcatatcagtagatgaaacgcctgccaaaacccctgcagggtctgcaaaacagcaaggagaggaacactacgctaataagatccatgatgccattgatcccgttaggagatccataaaccaactctctcgttaccaaggaaagtcagtcggtttgcttgcatacatcgcttttgtaacatcatggccgctccttggctccctagctctcatcgtgtttaggaaaaagttcaggaaacctttgtctgctaaattgtaaagtgaacttgctcgtttggtctacacttttattttatttgcatggcctgtgcagccacttaatttcacctagctcttcacagcactctctctctctatatatatgatctagcatcttccttc

SEQ ID NO: 74 - DNA, 1631 bp, Brachypodium distachyon
tattcgtggcaaaggggaatgttgcttctttggggaggcattgtggcaataggcagctaacttgataaatcaaacaattcagggctacgttgttgtggcgtagttacatctgacgaagaggttacttttcctttgattcggtgttatcagcaatccatatacgggagaaacaacaaccaagaataaagtgatcatggagcacgtgattggagggaagtttaagcttgggagaaagattgggagtgggtcatttggggagctataccttggtattaatatacagaacggagaggaagtgggaattaagttggaacctgtgaaatcaaaacatccgcagctgcactatgaatcaaaagtttatatgttgatgcagggtggaaatggcatcccacatcttaagtggtatggcgtcgagggggagtacaatgttatggtgatcgaccttcttggcccaagcttggaagacttgtttaactcttgcaacaggaaatttactatgaaaacagtccttatgcttgctgatcaactaataacccgagtggaatacatgcattccaagggatttcttcaccgtgacatcaagccagacaacttccttatgggcttaggacggaaagctaatcaggtatatataattgactatgggcttgctaagaaatacaaggatctccagactcataaacacatcccctacagggaaaataaaaatctgacgggaactgcacgctatgctagtgtgaatactcaccttggaatagaacaaagcaggagagatgatctggagtctgttggctatctcctactgtattttttgagaggaagtctcccgtggcagggtcttaaagctggcactaagaaacaaaagtatgacagaatcagtgaaaagaaaatgcttaccgcagcagaggttctgtgcaaatcttatccgtcggagttcatctcatatttccactattgccgctccctgcgatttgaagacagaccggattactcttatttgaagaaactctttcgggatgtatttattcgtgaaggatatcaatttgactatgtatttgactggactgcactcaagtatcctcatatgagctccaataacaagcttgttcggcaaccgagtggaagaatggctggagttgggccatctgtggaaaggacagacagatcttcagtaggacaagatatccgggacagatttactggtgctgttgaggctttcgcgagaagaaactcaggtaatggtcgccatggagaccattcaaggcacaagagcctcgcagagtccttcatgtcgtctagagaagctgttgctgattcggagaaaacgcacatcttgtcccggacagggagctcgtcgaagatgaccatcaccccgtccagccggccgacttcttcgggggacttgaccagccggttggtctcgggcagtggcagcagcaaccacccgtcgtcgtccaccgtccagaggctccaccactccggcggaggcagcaccgctgagaacggctcgtcgtcgcccaccgcccggaacgcgcaaggggggagagccggtggccggcgggacagccacgcggcgctccggagcttcgagcgcctcgccatcagcgccgagaggaggaagtgatcgcgct

SEQ ID NO: 75 - DNA, 1768 bp, Brachypodium distachyon
ccgtagccgactagcccaatcgcggctggactcgcctctgggagttggattggcggatggttgcgaaccaggaggcggcggccacagaatcagcgccggcggcgacggtggacgcgatgcggctggcgtcgcggtggcggtccccggcggagtgggaggccgcggcggcggcgctggaggccgagcccttgccgtcccagctcaacaccgacaacagctcgggcctcttcgcggtcgtgtccatcgacaagatgtccgtcaagtaccttggcgtcaaccaccacggccatgatgtcggggtcgtgcaggccgactgcccggcccccacccaccgagccgtctactacttcgagatgaccgtggtgaacgctggcctcaaggggcagacctccattgggttcaccaccgagagcttcaagatgcggcgccaacctggctgggaatctcaaagttgtggataccatggcgatgatggctatctttaccggggtccagggaaaagcgagtcttttggtcccaaattcacatctagtgacataattggtgctggcatcaactacatatcacaagaatttttcctcacaaaaaatggatctctggttggaggatttccaaaagatattaaaggcccactatatcctactgttgcagttcatagcccgggtgaagaattgacagtaaactttggaaaagaacagttctgttttgacattgagggttatattctcgaggagaaaatgaagcaacaatcagttagtgacaaattgtacttgcaaccagacatcagtcactggattgttcgttcatatctcctacattatggctaccaagatacactaaattctcttgatatggcaagtgaaactgatcctccggccaatcaccaaaatggttatggggaaccgcctgaaatgtacggtcttagccacagaaaaatgttgcgtcagcttatcatgaatggggatatcgattctgcattcaaaagactagaagagtggtatccacaggtcataaaggacaaaacatcagttatttgcttcttactccattctcaaagattcattgaatacatcagggctgagcacctggaggatgctgtaaaatacgctcgtgctaacctcgccaacttcttgacacacaaagcttttgaggggttgctgaaggagagtgtggccctgcttgcttatgagaagccttctgaatcttgcattggatatttgctggactctccgcagcgtgaatttgtagcagatgcagtgaatgctgccgtcctgtcgacgaatcccagcatgaaggaccctgagagctgcctttactcgtgcctcgagaagttactgaggcagctcacggtatgcagctctgagctacgcgtgttcaacaacgatcaaggggatgcgttcctacttcataaagaagtgcagacctgcgaaagatccaggcgttcctaggcacatcaaattgggcatctgagcagtgaactccaaattgaattccccgtccttcttggagttggaagcaaagaaggatcgcctggaatggtacggtggacaatgccatgagcaaacacacgttcttcccttgaggtcctgcagcattccccgaacctccatgaggtggacgggatttcacacagccactgtagctgaaacatttgtgcttccaggagttcctcccgtgtaatcagaaaacttagattgacacatggtcttaaacccccccagtgtttcaaaaactctggtggctatgtgcagttagacactgaatgttc

SEQ ID NO: 76 - DNA, 2732 bp, Brachypodium distachyon
ttagccagaattgaatttatttactttagagaaggaaaaaaaaaaggaagaaaggaaggaggggcagcgacacaataaaagcggaaggagaaaaccaggggaggtaggggaaggaagagacacaaatccaaaaaaacttggacacccaaggccaagacggagagagacaaggcgggccatgtggaagccatgggcggtcgccgctcgggcgtcgtgacacctgctcccctcgcgtcgccatgcccacgcccacgcccacgcccccttgcctgccgatgacgcccgtgccgtgccgccgccgcaatgcgcctcaaaaaccctcatcctcatcttcttgatccgtgaggcgaccgcgggcttcctcgtttcttgatccgagggcgcggggaggccatggcggaggcggcggcctcgccggcgcagccgaagctgctctacattgccgtggccgacggcggcgggcggcgggcgttccgctacacgcgccccgtgctgcagagcaccctccagctcatgggctgcaaggctcgccacgccttcaagattagcaagagagtattcaatatgatgaagggtgaattcttggacacatcgaagttggatagggctgttaaagaaggaaattcccctggccttgacatcggggaagatgccaagatgttgaacccagaaacttcagacgcaagtagtaatagcgttccctttgaattgtacaagacccagacaacgattattgtttcaagagaaaagtttctaaatgttgtgtgtgatgcgctctcttcgtacaaatatgttggaccaaaccagaaggctgacttgcttcttgcttgcagaattaaggagagaaaggaatcagtgacagtactcttatgtgggaccagcgggtgcggcaagtccactctatcatctttgttgggtagtagattgggcatcacaacagtagtttctactgattccatacgtcatatgatgagaagctttgcagatgaaaagcaaaatcctcttctttatgcgtcaacctaccatgctggtgaatacttggaccctattgcagtttctcagtcaaaggcaaaacgccaggcaaagaagctcgatatggtttctcgtcctagtacccttgaaggcaaagatgacatttcagatgttcaatcccgtcatggagcctcagaattacctcctagaactgagttgattggcaacaagcaaatggcaatagaagggttcaaggcgcaaagtgagatggttattgacagcctggacagattaattacatcttgggaagagcggaaagaatctgttattgtagaaggagttcacttgagcctgaattttgtgatgggcctgatgaagaaacatccttccataataccatttatggtatacattgcaaatgaggagaaacacatggagcgattcgctgtacgtgcaaagtacatgacattggatccagcaaagaacagatacatcaaatacatccgaaatatcagggctattcaggaatatctttgcaaccgagcggacaagcatctggtgcccaagattaacaatactaatgttgaccagagtgtggcggctatacatgccacggtcttcagctgtcttcgccggcgagaagctggggagcagttgtatgattccaacacaaacactgtttctgtagtggatgaggaatacaggaaccagcgtgcagctaactccttgggttcaaagggcatgtttcagttcattcaaaggaaggggtcttcgaggaatctgatggctctccttaaccctgatggttccgtcactaaggcttggcatgtagatacaagcgatgccaatggaaatggtagtacaagtagtgagaaatcagtcagaaatcatatggttaacccatcacaaattgggaaggcagagtcggttaatctccaatttggttctttcggaatcagtgcatggttgagtgatataggtggcaccagtcatgctggaagtgtagatgacctaagggctgatggcatcgagacggccagtagatacttctcgtcatgctgcagttccccaaagacgtcagattgtgcttccaaagagcatatggaagattattcagtctatggtagtgaagaagaagctgatgatccacctgatgctgaaactgatgatgatctgactgacgaagagagagacgttcatgagattgaagctggctccgtagacgaacattccaccaagtctgacgaggaatacgacgatctagccatgcaggatgtgatggagaacggtaacagctctgatgatgagcaagctgcgggctctggcaacaggagctcagcccttgaggagagcatccttggagcagccgatggagatgatgccatggcgggaaggtaccaccacaacctggagctcttcttcaagatgtccaaggaagtagccgccacagagatgccgtgtgcgtaacgccgctgctctccgccaactatgtgaagttcagtggacattaccacggtgcattgttcaccggcggtggtgctctccgccaactatgtgaagttctgtttgcagaattgcagtaggagtctactcgtttgctgtacccaaatgagtttatattggtggtgtgtgactgttagagatgaggatctgatgcttctcaaagattacatattatatatagggaatctggggcttgcccttacatgaaactggaaataatgaaaagtgtttttttctttcgaggaggtaataatgag

SEQ ID NO: 77 - DNA, 1435 bp, Brachypodium distachyon
tccacagctgtttctcttttccttgctctcttccccataaaaacctccgctccggaacaaaaaaagctttgcggaatccctaccctgctcctcctctctctctatctcttcctcctcctgggttttcgttcttggaggtgttttggaggcggccgccgggcatggacgtgcgccgccaaccgaatgtcgcggcggcggcggcggcggctgctgctgctaccctgggtgatttgttcccccaccagcctgccatggatagtggagacaacaacacagaatggctctccatctatttagaggactgcttgtccactcaccctgtttccgcagaacaggcaagtcaaggtgctgtaaaacagaaattaccaccgccttcatcttccaatgccagaaggaagaaaaggagcctggcctctgttataagagacgaagaagagcactgtttcactgtgtttgtggaaccaccactactcctacctgatcagaagcattggctagcagagagtgagctcatcctcccgaagaaagacaaagaccaagaacttgttcaacaacaagaacaagaacatgaggaagaaaagaagcgcaatgcaagtgcagaaatgctgttccagcaagagcagatgctggtgtgtagctattgtttatccaaccaaacaccacagtggtgggatggtccatcaggggtattgtgcaatgcatgtggcctgaggttacaggcagggaatgagttcagttccatggagcgctgcggccaagaaatcagcaaagaacaagaacaaggaaagcggcaggagaagaggaggatcaagaggccagcatatattgatgaggagctcccgcaaaagaagaggaccaagaagactacatacgtgaatgaggagcttccaccggaggagccagtgcagaggtgcacccattgcatgtcgcacaagacaccacagtggagaacgggtcctttggggcctaagaccctatgcaacgcgtgtggcgtgaggtacaagtctggcaggctgctgcctgagtataggcctgccaatagtccaactttctcgagttacatgcactccaattctcacaagaaggtcatgcagatgaggaagagtgttgaacactcagggcagtaaactgccggaggggatcatctcctggatctgtcgctgtcaggtttagaggctccggttgaacactcagggcagtgaactgctggaggggatcatcacctgtcaggttttagaagctttggttgtaggtcttgtaggagatgagagaaatgaatgcaaaatctgtttaggccccagttcaaactctttgttagctctagcagtcttctgctccagagatcatttctctagttattttagatcatcgattcattaccaatggttggttgctacaatattatgctgccgttatcttacaatgttattctatg

SEQ ID NO: 78 - DNA, 1772 bp, Brachypodium distachyon
agtggagtggtggttgctttaccgagttcttgattcggatccaagtatggggagcgattgacaaccctggagggctagtctcgatttttagaaggcaagattttgctgttgtttggtgatttggtggatttctggttggtgttcgcaattttgggcgtggtttttctgggtaaagattttggatcccttgttggtcgtagtaccatgattccgttaagcactgaaattttgaggcgggttctgcagaagagctatttttaatgggacttcttttcacaattctgtgaactggaagaagaaactttcctaataggagcagatttttttgtggccaagaagctttcgcttgtatctgtttcaagaaaagatttgggttttctttctgaggtatttttgttggtttcgttttaaaacattaacttggcagatccaggaaacacagagttttcattgattctgctccaattttttatcttcccgaaagaatcgcaaagcttcaaaaggagcaacaaatttttttggtcatgtccatggcgctgggccgattcacccattggttgtggcccggtagctcggcgcgtgtggccagccacgagctccccagcacggccctgatgagctcctccttcccggacttcccctccgggttccgggagccggacactgtctccttctccactgccggtggcggccgccgtacgcggcagaggcgggtcaggaaccggcggcgcagccgcggggagccgagggttgacagggagtacgacatggtcatcgtgccgtccgacggcggcgggtgcctgtccgggacggagtccgacgattccgattggtccatcggctggctggagccgcaggcgccggagatgcagacggacggtgaccccgagacctgcttcgccgtcctcgttccctgctaccgccacggccgcgcccaggagcccgcggtgcctgagggccgcttccttggcgccggtgctctcgccgacggtggcctctctgatggaaagaattttgtagaacagtggctttcctccctccagaattgatatctggaatctattcaagctactctgtacataatatcgctcagtatcattctaatattttatcgatgaaggaagacatcagaaccatcccgaaaaaaaaggcaaaactaaaacaaagaaaaaagagcagtgggattttgaagcatcactgaacgggtatgtctttccggaggttttccaaggctaactgtactctatgcaatgcaatgcaaatgctgaacgatacaatcgtgctacgtctcctagaagaagatacattccttctcgatatgtgctagcctatggtgacattgcagataaagtttacggttccatcgttaattttgtcccacttgaattctggacctagacctggtctgctactgtcctggtaccatgtgttgtgtatatagtatcagtgaagctgcaaatgtgcagttcttcagcgtgtgcctgtgttttgatgcagattgaaacatatgactggctcaagtggattcgaatgtatattaaaattttgtgttctatggatcaggctcttcgctcagcatctttgatgatgttaattatgttggttctgacttctgagtgatgagcactgtgtaagcatcggattcagtctagcactgaagaatgatatctctgcagcgacctgatcacttgaaatcctgggatggggactggagatattgaatggcttggcattggcaatgatctgatggaggtgcaagaaagggattgtgt

SEQ ID NO: 79 - DNA, 1792 bp, Brachypodium distachyon
tcggcattgcagggccagggcgtcagcctcatcatcatatattgcggcgccggcgcgtcatgtcgcatcatcttcacctgcgtggctcggttcctccgctgtccttccgcggtggactggacgctcgcttttcgcccggtgtgccctggcatttcgctagcagcagcagcaacgtcggcgtggctgcagcatcgtctgcacgaaccctccggccgccgcagcacagggcgaaggtgatggcgaaggaggccggggagcaggagacggcggcgctcggctgggcggcgagggacgcctccggtgtcctctccccgttcgacttctccagaagggctcagaaagacgacgatgtgacgatcaaggtgctctactgcgggatctgtcacactgatctctacatcatcaagaacgaatggggcaacgccatgtaccccgttgttcccgggcacgagatcctgggcgtggtgacggacgtgggcagcggcgtgaccaagttcaaggccggcgagaccgtgggcgtgggctacttcgtcgggtcgtgccgctcctgcgaatcctgcggcaacgggtacgagaactactgctacggcatggtgctcacctccaacggcatcgacgccgagcacggcggcgccgtcacccaggggggcttctccgacgtgatcgtcgtgaacgaggactacgtggtccgcgtcccggacgggctgccactggacaaagccgcgccgctgctctgcgcgggcgtcacggtgtacagccccatgatgcgcttcggcctgaacgcgccagggaagcacctgggcgtcgtgggcctcgggggcctcggccacgtggccgtcaagttcggcaaggcgttcggcatgaaggtcaccgtgatcagcacctcgccggggaagcgcgaggaggcgatcgagaagctcggcgccgacgacttcctggtgagccgggaccccgggcagatgcaggcggcgttcgggaccatggacggcatcctggacacggtgtcggcgtggcacccgatctcgccgctgttcgcgctgatgaagcccatgggccagatggtgttcgtgggcgggccgaccaagccgctggagctgccggcggtcgcgatcgtgccgggcggcaagggcatcgccgggaactgcgtcggcgggatgagggactgccaggccatgctggacttcgcggggaagcacggcatcaccgccgaggtggaggtcatcaagatggactacgtcaacacggcgctggagcggctccagaagaacgacgtccgctaccgcttcgtcattgacgtcgccggcagcctcggcaccaccgcgtagctaggccgggtcgcgcacgagagcccgttgcccctctcggccatttgtatgttgttttcagtgcaccacagaggttcaggtacaatctctctatgcattccttctttagtagtatcgtgtctaataaaggagtagtgttattgggagtagagatgtgagagagacctaatgattaatttgcaagttgatttgtgcagagaaacggtattcactactgtaagagattgttctcttctctaaaaggattgttctcttctctcgttaactatgtggcgcatagataaaacactgccgtggatgattaagagaagatgtcacatatagagacctaagttttctttttccttttttgaaatcgaaagacctaagttgttagaaggaggatgatctattctaacttgttataattttcagatgtaaactttgagacttgtgcgatgtttgagatttgaataatggcatggttg

SEQ ID NO: 80 - DNA, 691 bp, Brachypodium distachyon
gaaagtcgccagaaaagcgagaaggaaagcaacgagccgagaagattccgcggaaggagagttggtggaggagggtttgctgcgttgcggccatggagaacctggcgatgctgtggggggtcatcgggccgggcgtagccggcgcgctcttcggcgccggctggtggttctgggtcgacgccgtcgtctgcagcgccgtccaggtctccttcatccactacctccccgggatcttcgcgtcgctggctgcgctcatgttcaattgcgtgaacaaggaggacatcgggaatgattattactcctcctatggggacgattccgagtggagggtgaagctttggctttttgtcgcatatgttgtttctttcgtctgcctagctggatcagttggtttgttggtgcaagatgcattgacagacaagggtccttccgtgtggactggtgttgctggtgttctgcaatgtgttttcgtattgataagtgggttgacatattggacgtgccactctgaggagtaaggtcaaaatattgtgagcagacttggaaggttggtcataatgttgcaaggtcgtcttctctacaactgttgtcttgtgtaaattatgttcgttttaggatgggaagatcggtgtttcatgtgtgcataactgactgctttctgaaattatcgttagcattggtacatgtttat

SEQ ID NO: 81 - DNA, 5053 bp, Brachypodium distachyon
acagccgccaccgttccgcgccgacgcctgacaccccaaactgccaactccacccagcgcctctcacgcacgccgcctccatcgccgtcactccctcacctcgcgttgcagccgccgcacaccttctcctctgctattcgagcaccgtggcccgccgccggtgcagaagaaggagacagctgccgcggcgctgcccgccgcctgcctcttaaatctccctcccggtctccctcgcggtgaagcaagcaagtgcaggtcctgaagcagacttccgccgcctgccttcacgcctccccagttcttcaagtgtctcagtcttgcctgaaatatcgcatctcctggtgaatgacaggaaatagtatgctgtgccttcaacgttttcctagtaaaatgggagagcaaagacttggattcatctctgcaagaaatccttggtttggaaggtcaagaatgtttcgacactgcttggacctacggcatctttgcaggttacctaaccagatagtcactcttccaaattaccgaccaaagcatgctcccagtgctgcagtatacaggggtgttagtagtccattaacagaggaatttgttgatgaggtgggatcaagatcaaggattattcacttttaccgtaaaccatttcttcaagagagtgagactgaggaattactcaggaaagtgcaggcaaaggtttcttgtaacgttattgacataaagaccgagcaatgtttcaatgttgaattggagagggccctggcatctgagaagcttgcaacacttcagtggcttctagcggaaacttatgaacctgataatttacaaacaaggagctttcttgaagaggaagttgctagcggtccttattctgttcttgtcgaggtagggccacggatgacattttcaacagctttctcgaccaatgctgtctcaatttgtaaagccctatcgttaatggaagtaactcgcttggagagatctcgaagatatcttttgtgccttcagcctggcggtggagcacttgatgaaagccaactcaacagctttgctgctttaattcatgacagaatgacagagtgtgtttatcctagcaagctcacatcattttggtcagatgtagttcctgaacctgtcagtgttataccagttattgaaaagggaagggaagcattggaagaaataaatatgagaatggggcttgcttttgatgaacaagatattaaatactacacccacctcttcagagacgacatcaagcgcaatccaactaccgtggaacttttcgatatagcacaatccaatagtgagcacagcaggcattggttttttaatggaaagcttgtgatagatggagaaacgatggctagtactttgttccagttagtaaagagccccttgaaggcgaaccctaataactccgtcatcggtttcaaggataactcaagtgcaataagaggacacacggtaaatcatctccgtccagcactaccaggctcaacttcaccgctatcccttatgatgcgtgagcttgacattttgttcacagctgaaacccataactttccatgtgctgtggcaccttatccgggagctgaaacaggcgcaggtggtcgcataagagacacacatgccactggaaggggttcttttgtcgttgcttccacagctggttattgtgttggaaatcttcaaatggaagaatcatatgcaccttgggaggattcatcctttgcatacccatcgaacttagcttctcctttgcagattcttattgatgctagtgatggtgcttctgactatggtaacaagtttggtgagccactgattcagggatttacaagaagctttggtatgaggttgccaaatggggaacgtcgtgagtggttaaagccaataatgttcagcggagcaataggccagattgatcatgcacatataacgaagggggatccagaaattggcatgctagttgtgaagattggtggtccagcatatagaattgggatgggtggtggtgctgcctcgagtatggttagtggacagaatgatgcagagcttgatttcaatgcagtgcagcgtggagatgctgagatgtcacataaattgtatcgtgtgatcagggcatgcattgaaatgggagagaagaacccaattatcagcattcatgaccagggagccggtggaaattgcaatgttgtgaaagaaataatctatcctaagggtgctgaaattgatatccgctcaattgttgttggtgatcatacattatctgtcttggagatctggggtgctgaataccaggaacaagatgcattattggtgaagcctgatagcagaagcctgctggaggcactttgtgagagagaaagagtatctatggctgtacttggggaaattgatggcagtggaaagatagttttgattgacagtgctgctgtggagcatgccaagtcatatggccttcttcctcctcgccctgttgttgatcttcagcttgaaaaggttttaggagatatgcctcagaagacctttgaattcaaccgggtttctcgattgggtgagcctttagatattgcacctgaggtcacactaatggatattcttaagcgagtattgaagcttccttctgtatgttcaaagcgtttcttgaccacaaaggttgataggtgtgtgacaggtcttgttgcgcaacaacagacagttggtcctctccaacttccacttgctgatgtcgctgtaattgcgcaaacatacacagatctgacaggtggtgcttgtgccattggagaacaaccaatgaagggtttacttaatccccaggcaatggcaaggcttgctgtcggggaggccttgaccaatctggtttgggccaaagtttcatcactttctgatgtcaaagcaagtggtaactggatgtatgctgcaaagcttgacggagaaggagcagatatgtatgatgctgctgttgcgttggctgactgcatgattgaacttggtatcgcaattgatggtggaaaggacagcctttctatggcagctcaatgtgatggcgaggtagtcaaggctcctggaaatcttgtcatcagtgcttatgtgacatgccctgatataactttgacggttactcctgatttaaagcttggaaaggatggtgtcttgttgcacattgacctggctaaaggaaaacgtcgacttggctgttctgctctcacacaggtgtttgaccaaattggaaatgactgcccagatatagaagatgttccgtacctgaagatagtatttgagactgttcaggaattgctcagtgaacgtcttatttctgctggtcatgacattagtgatggtgggcttattgttactatttttgagatggcatttgctggcaattgtggtgttaacctcaacatagacttaaagggaaatagccttcttcaagcactttttgctgaggagcttggccttgttgttgaagtgcactcagatgaccttgattctgtaaagcaaaagcttcaagcagcaggtgtttctgttcatgtaattggagaagtaaatgcaacatcagagatagagctggttgttgacggggaggtgcgtctgaaggaaagcattttagacctcagagatttgtgggaagaaacaagcttccagcttgaggagctgcagcggctgaagtcttgtgtgaaccttgagaaagaaggtttgaagagtcgaacatcaccttcatggcatttgtctttcgctcccaaattcacaaacaagaagctattgactgcatcctccaaaccaaaggttgccattattcgtgaagaagggagcaacagtgatagggaaatgtctgctgcattccttgctgctggctttgaaccatgggacatttcaatgtcagacctattgaatcaggaggcctctttgactgaattccatgggattgcatttgttggtggttttagctatgctgacattctagattcagcaaaaggctgggcagcgtctatcaggttcaaccagcccctcatacagcagttccaggagttctacaataggccagacacgtttagccttggggtgtgcaacgggtgtcagctcatggctcttcttggctgggtgccaggaccagatattggcggttcccttggtaaaggtggagacatctcacagccaaggttcattcacaatgaatctggccgttttgagtgccgatttaccagtgtggctataggggattctccttctataatgttcagaggtatggaaggctctaccttgggcatttgggctgctcatggtgaagggagagccttgttcccagatgaaaatgttttatctggtgtcattaactctaatctggcccctctgcgatactgcgatgatgctaataacgccacagaggtctatcccttcaaccctaatggttctccgcttggtatcgccgccctctgctctcctaatggaaggcaccttgctatgatgccacatccagagcgtactttcatgatgtggcaatatccctggtatcccaaggaatggcaggttgagaggggtggtccgagtccatggttgcgcatgttccagaatgcacgagaatggtgttcatagagcagagcaaaactggtgttcgctggtgttgatcttttcttgctcgcctgcacgtatgaggatgaacatgtttcctttcggagttgagcatggattaccccacaatcgctctttagatggtagagctcctatcaccatgatttgaagcatcagtatggttattcttgaactgctgtggccagtattgtgcgattctaagagttgccgacgttgtgctgtgatagtcggacagataattcttccatatacaggagttgatgtcctattaactttctacctcgttaaaacttgtgtggacgtgcagttcttgtatggcatagccattattttttgttccttctattatttatcagatgtcaagaacaagctcctgaaatcccagaacatcttgaatgaaaatcttgaatgtgcgtttctgaatacaatttataatcttggttggtttcataaaagtatattt

SEQ ID NO: 82 - DNA, 2640 bp, Brachypodium distachyon
gtccacaagccaagggcgcaacgacgcgagcccatcatcggtctcccccttccctccctcccttccccaaccctaatctacatacacgtagatccatacccccgccgccgccgccgtgccctagctccccgccgccctaggcgcgatcggcggcgtcctcctgctgggcagagaaggggcggcggaggagggatcccgcggccagggccaacctcgcgacgggggccgtcatcatggaggaggacggcgcctccgcggcggaggcggcggtaccggctgccacgaagccgctcacgcccgaggaggaggcgctccggcgcaacaccgactgcgtctacttcctcgcctcgcccctcacctgcaagaagggaaatgaatgtgattttcgtcacagtgagattgcccggatgaaccccagagactgttggtactggttaaatggcaattgcttgaatccaaagtgttcatttcgccatccgccaattgatggtatgtttggtgctccaagtcctggaatacctgcagtttcttcacactatgctgcttataacttgggcaagcagatggtcccttgctattactttcagaaagggaattgcgtgaaaggtgataaatgccccttttaccatggaccacagtcgactggtaataatccaccagaacaggtggcgaaggtttcttcatttcctttggagcagcctcagacccaaaagaacgatttgttgggtataaaggagtctgcacggacaaataatttaattcagcgaggtggtccaataattgatgacaggtccaaaatggccgttgataggcctacagcaaattctgccaagacacctgcagatgcaatacctgctaaacttgcttccagcgcattgaaatctttgcccaagtcagagaagctacaaagcagtatgccagcagcaaagagaagtttcagaacctcttcaggtgaggatcatcctgagtgctatcacaacaatcttatcgaaagtgatcctgtgcaagattggaatgaagattaccgaccacctgctgatgatgacttgccccagaacagtagagaggctgatgaattgccaggtgagtcttcacctggttttgatgttcttgtggacaatgatggagatgctgctgcttatttgcatgacgaggaagattttggaagggatatgtatccagtggaggattatgaatatgctccggctgattttgaaattccgccacatcatgaaagagagctgttcaatcgaatgggcgagcaaggcccagtcggacaaatttatgatggctatgaaaggaagcgccgtagaacatcatctgagaggaacatggacagaccttcccattcagaaagaaggtcccgtcacagagatattggtcatgttgagatagatggatcagatttacgtcaccgtctccgcagaagaaaaataaatggttcttcaggcactagcccggaacgcagtggagagcaccgccggagggatgaacgctatagggaaagggcgtacgatggacaccatacacacagagatcgccatcggagccctcgaggaagcactttaagctctcgcctgcaaggcagaataaagcttcctggaagatcacctgatagagtggttactagctctgagaaagagcaagatagaagaccactccgggaaaggctgtctccagttaagcatatggatgttcagggtgtgaggcatcgggaggcagggcaacatcaagagaggactctgcggagatcaagcgaacttccctccagtgctaggaatgcagatggacagcatttgaggaggaacgtaacagaatcactcaactttggcaggaaggccaatggaagggttgaatctgaagcatctcttgattttgaaggtccgaagcctctcagcatcatcttgcagaagaaaagacaggctacatgtggcaatggctcatctgcccacaatggcaaacaagataaatctgccaaggtctcacataggcaacctgagtctattgttgaaactgagaaggaaggctatgacaacattgtcagttctgaagaatacaagagtagatcaggtgatgaatacaaagaggaaagccgtatccctgcggagggccatggccaatcttcatctcatggtgacaaacctgagacagaagacattattgaagtggatcccgtggtaaatcaagaggctgataactatgagcagggggagggggagtccgactacgatgcagctgaaggccaagaatacaaatctgaagatgagaatgcatatcaaaacgatgaagacgagtttgaagatgacgatgattttgcccggaaagtaggggttgtcttctcttaagctctggttcgtttcttggttatgttgcttcaggccaagcgggaatgcttgaattccttggcgattcccttggataaattcttctggcgctccatgtttctttttcaagttcatggtgccaaagcctcttttctgaggctgataagtgataactgctaagtataggtcaggcgtgaagtgaggtagatttttataaacgagaaagcgattacgtgtaaagacagctgttctttgttcagcttatttgatgcatcctcaaacttgtattgtattagttcccttactaacgtcgaga

SEQ ID NO: 83 - DNA, 2841 bp, Setaria italica
tgaataggaggggattgaggctgcaattgaaactccgccttggattggaatgcttttgggagggtcgggggctcgtcgccggctgcttgggttgatgttgggagcgcgcgaatcggctcaagttccgatcttggcgagtctggaatcccggaatcttttggggtttttgttttgaagttttcaaggcggcaggactgtgctgctgatttgtcggaacccatggagactactagctcaacaaatgaggataccggtagggggacaatgtgggagctggaaaggaatctcgatcagcccatggatgcagaggccgggagattgaggaacatgtacagggaaaagacatacccaacacttgtgctgttacagttagctttccaaagccttggtgtggtgtttggggatttaggcacatcacctttatatgtcttctacaacattttccctcatgaaatagaagacacggaacaagttattggagcactctcgcttattatttactcccttactctgattccacttgttaaatacgtcttcattgtcttgagggcaaatgataatggccaaggtggaacatttgctctttattcactgctttgccggcatgcaaagataaacactattcctaatcagcatcgaacagatgaagacctaacaacatacagtcgccacacatatgatgagaaatctcttgctgcaagtatcaaaagatggttagaggggcaccaactcagaaagaatgtcattcttattattgttctttttggtacttgtatggccgttggagatggaatcctcactcctgccatatcagttctttctgcgactggaggaatacaagtggaagagcccaaaatgagaaatgatgtggttgtcatcgtctctgtggtcatattgattggattattcagcatgcagcactttggcactgataaagttagctggctttttgcgccaatagtgttagtttggttcattctcattggaatactaggcgctgtaaacatctacaaatacgatcggtctgtcctcaaggcgtttaatcctatttatgtctatcggtacttcaagcgagggaggactagctgggcttctttaggaggaattatgctcagcattacagggacagaagcactgtttgctgatctttcatatttccctgtacaagctattcagattgcttttaccgtggttgtgtttccctgccttcttttgcagtatactggccaagctgcctatatagctcagaatacacacagtgtcccccacgctttctattattcccttccagcttctatactttggccgtcattcattgttgcaacagctgctgcaatagttgctagtcaagccactatatcgatgacatattcgattatcaagcaagcacttgctctagggtgcttccccagagtgaggattatccatacgtccaagaagtatcgaggccagatatacagtcctgatatcaattggatccttttgatattctgcatcgctgtcactgctggatttaaaaaccaaagccagatagcaaatgcatatggtactgctgtgataatggttatgcttgtgacaacatttctcatggtccccataatgctgctggtgtggcgcagccactggaccttggtcattcttttcaccacgctgtcattgattattgaaattccatacttcactgctgtggtgcggaagatcgatcagggtggatgggttcctcttgtgtttgccgctgccttcctcgtcatcatgtatgtatggcactacggtacactcaagcgctacgaattcgagatgcacagcaaggtgtccatggcatggatcctaggccttggtccaagccttggtcttgtcagggtgcccggtgtcggcctggtgtacactgagctggcgagcggtgttcctcacattttctcacacttcatcaccaacctcccggccatacactccaccctggtcttcgtctgtgtgaagtaccttcctgtctacaccgtgccactggatgaaaggttccttgtgaagcgaatcggccccaagaacttccacatgttccgctgcgtggcgcggtatggctacaaggacattcacaagaaggatgatgacttcgagcagatgctcttaaacagcctgatgctctttgtccggctggagagtatgatggaagagtacacagactctgatgagtacagcaccggccatgagctgaaccaggcaggcaacgccaacccaagaatcaatggcatcaacaacagttcaaacatggagctcagctacacatcccacgactccattatacaggtgcagtccccaaaccatactgggaacagccagttgatgtcgtcaggccagacgtaccagacggtgggcgacgagatcgcgttcctgaacgcgtgcagggacgctggggtggtgcacatccttgggaacacgatcatcagggctcgcagggattcggggttcctaaagaagattgctatcaactacatgtatgctttccttaggaagatctgcagggagaacagtgccatcttcaatgttccccatgagagcctactgaatgttgggcaagtgttctatgtgtaagcactgaaagtaaatacatacaagtagatgagatgttcttcagcctcagaactactcaagagaagatagctgtgtttgttcataatagctaataggagggcgtctttgttgaaagaattgtacagcatcatatatgtgtgagcacttggagcctgatcaatagtggccatgttcgttgtgtagaacttgtgctgaatgcacatgtgtaatggctggttgttaaatccagagtaattttgctgctatatttgccat

SEQ ID NO: 84 - DNA, 1312 bp, Setaria italica
cccgccgcctcttttaactgccccggccgtctcgcgtccgtcacaggccacgccacgcacaactgcacagacggccgcctcacgccagtagtcttgccaatggactcgtcacgcggcccccacctgctcctccccctcctcctgcccgccctcctagtcctcgccctcgccccgtcgtcggcgcgcgcggcggagccgggggtcatccggctgccgagcgggaaagcgggggcgcgggcgtgcgcagcgccggcggaccccgcggcttacgaccgccccgtcatcggcatcgtctcgcacccgggggacggcgcgggcgggaggatcagcaacggcaccgccacctcctacatcggcgcctcctacgtcaagttcgtcgaggccgccggcgcgcgcgtcatcccgctcgtctacaacgagcccgaggagcgcctgctcgagaaactgagtttggtgaatggtgtgctgttcactggtggatcagagaagcaaggtgtatactttgagacaattaaaaaatcgtttcagtatgccttggacaggaatgacgcaggtgaaccatttcctgtgtttgctcaatgcctaggctttgagcttgtaagcatgattgtcagcaaggacaataatatcttggaaatgtttgacgcccagaatcaagcatctactcttcagtttcccagctattctttcgagggtacggtgtttcaaagatttgactctgacctcatcaagaaagtcagcaccagctgtcttgtcatgcaaaatcacagatatggtatttcaccaaagcgtttccgagagaatggtgaattatcaagtttcttcagaatcttgactacatcgcctgatgaaaatggcaaggtctacgtctcaaccgtacaagcaaataaatatccaatcacttgcacacagtggcatcctgagaaagccatttttgagtggagaaaaccaatgataccacacagtgaagaagcagtacaagttactcaacattttgctaatcattttatcagccaagctcgcaagtctcccaacagacctcctgcggacaaggtgcttgataacctgatctacaactacagccccacatttagcggaaaaacctcgaaatcttttgaggaggtttacatattctcctaagactggagcaggcggcagagggtcctcctgaaccagcattcaattgctattgtgttatggctgtgtatttatcatacctgtattgttctcttgccgccatattggtgggcgctgctgtattattgtggactcgcagtcgagccaccatcgccttcagcaggaacatatatgt

SEQ ID NO: 85 - DNA, 5267 bp, Setaria italica
ctcctctcctctctctcttcccctgctctcctccgcggcgctgctgcttcctcgccacgccagagctgagcgaaccccacccaatccaatccctctcgtcctcgcttcctcctccgcgccggagcccgccgctcgccgaagcctagctaggatggaggaggagccgcttgccgcccgcgccaggaggtaggggcgggggcgcggccgatcggcggggtgggagggaggggaatgagggcgctgcagcagcgaaccatgcgagatctctacgatcatacgcggcacaaggatctcgcggcccccgaggaaccagcggaagggcgcggcggaggacgcgcggaggggtcggggtaccgcgaactggtccccaaggaggacaaggctgcagtaaggaaaagattggtaccgagcaatagcactcgtttgaaggcagagtcaggcacctgtaatgtctgttatgctccttgctcctcctgcctacaccgaagtcttgcagttgaggattcaaatgctgaatgtgcatcatctcaaacatgctctgcaaggtcagaagtaagaaacaattcactcgttcgtagtgagaaagggctccacaataaaggagaaaacgacgatgaatttagtgcaacctcaggtcatgtttcctactctataaccggtggaaataataaagtgttcgcaagaccatccattgcagacgactcttcagaggtagacatgccagcaaaacgtagaaggctattaaatcaaaacaaaaaacaatctagagcagaacaccatgatgacagcaactcgtgtgttactggtacatcagcagaaggcaagcttcacgcggataagaaaaaactatcgacttctgcatccagtcgagatttgactgctaatgattataaagacaacagcatggtttgccgcagcagattaaaaaatcaatgtgttgatgaatctaagaaaggatctgatgctcatgacatgcatcctagctcatctggtagactgtttcctgcagattctcctatttcaacaaagaagttgctgcgaacccagtcttctgtcagtgcatcaagcagattatctcctaagaagaaagctcacgaatgtgggacagtgcaagataattcatctcatcaatcttgtgaaaaggtttctctttcaaagaataacgttgaacaaccgcgaggtggaaaactggacccttgtgtagctggcagcggcaaccatggcacgttggcaggttacagtaacataaatgcaaacaaagccggtttctcatcgaaggatctggagaatggcagctcatgccgaaaagatgaaattcaggaacatgctggcatccaatctaatgatggtgttactaggaatgagggtgacaaacaagaatgggatcaagattgttcaatggatatttctagtgatggaaagttgaatatacaacatgacatgatgacagactgtgggacttcggaaggcttgatagatgttaatgtttgtgatatatgtggagatgttggtagggagtatcttctagctacatgtactagatgccttgagggggcggagcatatttactgcatgcgagtgaagttggataaagtcccagatggtgaatggttgtgtgaagaatgccagcttagggaggatcagaacaatacaagaagtaactatggtgtcacggcggttaatatgtctgaaggaaagaagaaccaaagttcagaaagtcgaaacaagccaaaggcattgcaaattgttgtgcctgaattggatgctcccgaaagcacacgcagcacaccaaaagctgatcagtgtgatggtaagaataaaaaattgcacttagcttcagctgatacacaaacacggcaagcaaaggttacccccctagcttctgaaagactggatgtgaagagcaaaaaattattgagcattgcaaaccgtaacaagcaagtgcttccatctgatttggatgcacggccacacactcatggaacaccgacggctggaggctcaaacaagaaatgtcaaagttcagaatttttgttaaaccgcaagaagttgcgagtttctaccgatatggagtcaccatcttcaagtgaaggcctacggagtccaacaatgtcatgtaagagacaggcagagaataattcatcccctaagcctaggctcttaaagacagacagctttagaaaacatgatgtcatctctcgtgagaactcgtttaagaaatcagacaagggaggtttaacttcagttgataatgctccagtaagaactactcaagcagtcaaaaattctcaggccttgtcacggtcatattccttgggtaacatggttgctaaaacaccagttccttcaccaaaaggtcttttgtcgaagcaactgtctttcaacagcaccaacaatggaccaaaggtcaagcagttggctgaaggggtggctagcaagttgagacctgcgaaccattccccaagagatcctagagataagggggccgtaaaaaagctcgtacaatctggatctttcaaacgcgagggttcagtttgcttagatgctggctcatcaaaacaaaagcaaacatttcatttgtctcaagatgaaaaaccaggaatattgaagccagtgaaggaaaagaatttgatggaaagaagggcttcctttagttttaaaaaaccgagtattccttcatctccaaggcctgacagttgtatgaagttaggtgaaagaaagaacgaccaggatatttcaaggtctggatcaagcatacttaaaagtagcaaaagacctggaaatgttgaaaagaagcagagctctgatttgtctaaaagtgacaatgacaagcaagatgttactatacatccaaaatcaatgggagttgtttctggtaaagttgctcatgtacctgatccaccagtttcatcaaaatgtgtcaaaaaggaaagctcaaatggtgtgtctaaaagtgacaatgacaagcaagatgttactgtacatccaaaatcaatgggagttgtttctggtaaagatgctcatgtatctgatccaccagttccatccaaatgtgtcaaaaaggaaagctcaaatgatgttgaggatgaagatttattcatttcagtgaaaaatggtagcagaatgccaaatgagtctgcagaggtggttctcacatcgtctactaccatgacttctgaatcaggtttgcgagatgtggcaatagcaagcacctccgaagattcagctcctaaagtggtatgcttccaacaaaagcctttggaaagcacaggagatgactcctgtaaaattgtagaggcagctcaagcaacaggaagtatattgaatgagattccacccggtgttcagatggcacacaatctatacccccctgatgataaattggataaacctgatttgaagcaggaagctttcatggatcaatcatcagctcttgaaaatcctttaagagatttagttattccagagcagtcttacatctggcagggcagctttgaggtttcaagacatggaaactcccctgaaatatttgatgggtttcaggcttacttgtctatttgtgcctcgtccaaagcacgtgaagtaggtgaacaattaccagataaaattcagctagcagaagttccgcggctttcctcatggccactgcaatttaaagaagtaaatccaactgaagataatattgctctttttttctttgctaaagatgttgaaagttatgaaagggcatatggtaaacttttggaaaacatgcttctgggtgatttatcccttacagcaaatattagtggcagtgaacttctcatttttccatccgataaattgccagagaggattcaacgttggaatggtttacttttcttttggggcatttttcatgcccggaaagcaagtagcccaccggaacttcctctgactgggacaaataattgttcattacaacaaatcactgggtcagatgtgggttcccctaaagcactacagtctttgggtatagatttgaacgagtgccccaatgatgatatatctgacccagctatttcacttggatcagagagtgagaagtctggtgcatttgtagatcataatacttttttggtgtccaaacatgaggataggaagcttaatgcaagtgaaatacatcatgaagaaactgcagacgcaaaacaaattataccaggacatcctactgcagcttcctatggaattcatcctcccacattatcaacaggagaaggtcatgacatgattcggaattattcaactgctgcaaaaggtagcacaggaacagcaggtagaaacaaaatggaggaagatcagaatgaagctctcttctgtgctgcacagcagccaggtgccattgggtcaatctcagatgagataaaacctaagaaacatgatcttctgccctctatagaagtatcacaacgtcattttattggatcaaagatatgtgatggtccaagcaaattaattccaaattcagatatgggttcttttgatcctgacctcacctacaaaaggcagaagacttcatacggaaaatactctgcttgcagttttggagatgaaatgcaacctagcaaatgcttgtccaagatacatcccttaccggttggacagcataatccatttgatgatttacagtataattacagggttccctcagatcctggctcccttaaacaacctgtacctgatcatatcatccacgttctttcatctgatgatgaagattccccagaacctagtactagcttaaataaggcatcactgaaggcagatgagagctcctccccattgttgtcactttccctgtctatggtggcaacgaagcataatctttctggttcagatattgtagatgatgaaccgctgtctctctctcttgggctccctagtgttgtggaagggggtcgggctctggagatgaagcagtttctgccggagaagccaggcataaacacttagtgctttttaggtttgcgagtgtacagttttgtgctatgtttagctgtatggagtttagacagggtagatggtatagcttttaaattatgaaacattttgccttttcttttctcactattacatgcatctgctgctgttgatagtgatgctggtctgatgatgttactgtccgccttattttatgtgatatatggtgttagtttcccatgaactctattggtatgacataaaaggatatatcagaatgtgaatgtttataaattcaattttgcgttgtggaacttacagtttctacc

SEQ ID NO: 86 - DNA, 2057 bp, Setaria italica
gtgcacagtagtgttgtgttggcagcctcgctctctccgtcctcgtgagcgggcatggaggtctcagccatggaggaagccctccccaaccccaaggcgaggagggagggaggcctcagaaccatccccttcatcatctcgaacgagatcttcgagaaggtagccacgttcgggctgacggccaacatgatcctgtacctcaccgagcggtacctcatgtcgaacgccttcgccaccgtcgtcctctacaactggaacgccttctccaacttcctccccatcttcggcgccgtgctcgccgacgcctgcctcggccgcttccgggtcatcgcactcggctccttcgtcagcctctctgggatgtgtctgctgtgcctgacggcgatcctgccggtgtacaagaagacgccagagtgcgcggcgcgggtggcggactgcgaggtggtgccgtggcagctgccgctgctgttcacgtcgttcgcgctcatgtccgtcgggtcgggcggcatccggccgtgcacgctggcgttcggggcggaccagctggacaggcgggacaacagctccagcaacgtgaggacgctgcagaccttcttcaactggtactacacggtgctgggcctcgccatcgtgttcgcggccaccgtcatcgtctacatccagcagaccaggggctgggtcgtcggcttcgcggtgcccgtcgtgctcatggtcaccgcgctcacgctcttcctcctcggctcgcccttctacctcaaggcggcggcagacaggagcgccatcgtcggcctggtgcaggtgctcgtcgccagctacaagaaccgccacgagcccttgccgccggagaccgccgacgcctcgaccttctacaacaaagccggctccaagcccaggacgcccaccaacaagctaaggtacttgaatcgggcctgcgtgcttaggaacccgagcaaggagctgagcgccgacggggcggcgtgcgacccctggaggctgtgcacggtgcagcaggtggaggacaccaaggccgtcatccgcgtgctccccatctggtcgacggggatcctgcccggcgtgatcgtcgggcagcagatgttcccgacgctgcaggcgaagactatgcagcggagggtgggcggcctggagatccccgcggccaccttcggcgtcttcagcatcctgacgctcaccgtctgggtggccgtgtacgaccgcgcgctggtgcggcccctgtcccggctcacgggccacgcgcgcggcctcagcctgcgccagcggatgggcgccggcctggcgctcttcgccgcggccatggccgtggccgcgcgcgtcgagagcgcccgccgcgccgccgcggtcgccgaggggctccgcgactccgacccgcggtcgggcacccccgtgcacatgtcggccatgcggctcgtgccgcagcactgtctgatggggctcgccgaggggctcaacctcatcggccagatcgagttctactactccgagttccccaagaccatgtccagcatcggggtgtcgctgctggcgctcgggctcggtttcggggccctgctgggcagcgccatcgtcggggtcatcggcgcggcgacccggggcggcgggcacgacggctggctgccgagcaacctgaacaggggacactacgacaactactacctggtcctggcggtgctgggcacggccaacgtggtgtacttcctcgtgtgcgcctgggcgtacggggaggagggccacaacagggtggtggcggccgacgccgaagccgaagcggcggtggaggacggcaacgtcaaggaggagcagcaaaaagcggtgatcatttaggcgtagggccagttaccggctttgagcactaggaaaacagtatagtgtttgatctgagatggtatctttctctggtctaaatcgtggtatctggtatatatgcgagcttatatgctgatgtttcaagcgaaactaatcttcaaatgttaatatggtaaaaggctgttgcaacttgcaactccaatgccgcatgcattttgcgtgcattcttcaggttc

SEQ ID NO: 87 - DNA, 1751 bp, Setaria italica
cgcgtcaaggccttcagggtagaagagcttttacccgcgacgctagcaccagctagcgttcgtccgagggagagagagcaaggggaaataactagcaagcagcgaggcgggagcaagcaaggcaaggggagtgggagggaaatggtgggctcgggcgcggctgggggcggcggggatcacgcgcggagcaaagaggccgcggggatgatggcgctccacgaggccctccgcaacgtctgcctcagctcggactggacgtactccgtcttctggaccatccgtccccgcccgcggtgccgcggcggcaacgggtgcaaggtcggcgacgacaacggcagcctgatgctgatgtgggaggacgggttctgccggccgcgggtggcggagtgcctggaggacatcgacggcgaggacccggtgcggaaggccttcatcaagatgtccatccagctctacaactacggagaagggctgatgggaaaggtggcctctgataaatgtcacaaatgggtcttcaaggaaccttctgaatgcgagcccaacatctccaactactggcagagctctttcgacgcacttcctcccgaatggaccgatcagttcgcatcaggcatccagaccatagctgtgatccaagcggggcatggcctcctgcagctgggttcttgcaagattatacccgaggacctgcacttcgtgctgcggatgcgacacatgttcgagtcgctgggctaccagtcgggcttcttcctctcccagctcttctcctcctcgcggggggcctcgccgacgccgccgttcccgctcaagcagccggcgccggctgccgcgcgccccccgccgcagctcttcaactggccgggccaccagccgccgcagctcccgccggccgcgggcgcgtcgccgctcttcccgccaggccccgcggccgcgttccacccgtcggccgcgcgcccgatgccgccgttccctggcggcaagcaggacgagggccacatgttccacctcccgccagcgcaccatggcggcggcaagccgccgcacatggacgagcagcaccagcagcaggcgatggggccgggcggcggggaggctcccgacggcgacctccggtggcctaacgggctgtccttcttcaccgccctcaccgggcgcgcggacgacgcgaagctgctgttcggcggccccggtggaggcggaggcggcgcggacgaggagaaggcagcgccggacgccgcacagggcggggccgagaacgtggaggagtacctcagcctggagagccactcgaacaaggcgaggagggtggagagcgccgcccagagcaccaagttcaagaggagcttcacgttgcccgcgcggatgagctcgccggcgtcgacgtccccgtccgtgtcggcctccacggcaccgccgccgccgcagcagcagcagcaagggatggagtaccgaggcccgcacgagggcggcgtctactcggacctgatggagacgttcttggagtagccgttcgtagccctcgctcgtccgtagcacgcatcacgatcgatcggttcaagatcactacgacaagtgcacgttttgtttcattctctccctgctcccaacctatgttttacgtttggagttttaatcgcatatgtttaattagatttttattttctccgtttcttttcctcgtgtacgtcttcctcttcttctagcagtagttgtagcagctcgatcgtaatgcagaaaaaccttgatggata

SEQ ID NO: 88 - DNA, 1173 bp, Setaria italica
gtgagttctacagtctggggcggttcgagtggatgggctactctcgataggactaacaggacacgcgtcgatatcctgcacggtgacgcaggggtgcggtgcgacaccgctgcaaagaattttttttcccacgtgcacggacggggcacggctatataaggtcatcgtttccaaggcttttctctgcgccgagacgtggctgcagccgcacaagaggtgatcgagcacgagcagtaactcgagcccgcacgcaccttctctccatggggtgcatcaagcacatcgtgctcgtccacggcgcgtgcctaggcggctggtcctggttcaaggtggccaccgcgctccgcgcggccgggtaccgcgtggacacaccggacctggcggcctcgggcgtggacccgcggctgctgcgggaggcggcgcccacgttccgggactacacggcgccgctgctggacctcctcgcggcgctcccggccggggaccgcgtggtgctcgttggtcacagcctcggcggcatcaacgtcgccctcgccgccgagctgttcccggaaaaggtcgccgctgccgtcttcctctgcgccttcatgcccgacttcgccgcgcggccgtcgcacgtgctcgagaagttcgtggaggggaagtggctggactggatggacacagagatgaagccgcaggatgccgagggcaagctccccacctccatgatgttcggtcccgggatcctgcgcgagaagttcgtccagctctgctcgcccgaggacgtcaccctcgtttcgtctctgatgagggtgagctcgatgttcgtggaggacctggccgtccagcagccgttcaccaagggcgggtacggctcggtgcgcagggtgtacgtggtgtgcacggaggaccacgccatcgcggaggggttccagcgcctgatggtggagaacgacccggttgacgaggtgaaggagatcgccgccgaccacatggtgatgctctccaggcccgacgagctggtgcggtgcctcactgacatcgttgagaagtacacttgatgctatagcgcgcgcctacctggcagagcttcgggttatgctaaaatggcttcagctctgactccaccggtgaaatggtatttctagtggcaaaataaattctcctgcacttctcgatggctgatgctct

SEQ ID NO: 89 - DNA, 890 bp, Setaria italica
aaaagaagcagcagatttctgtaggtaggcgttctgtatcaacagttggacttggacatggctcatggctgaactctgaactttgcatcacccatactattccacatttccactagacagccgaagatgggggcgtcagcagcacccttcaccggtggcttcctctgcccgaccaaaccaaggacaccaccgctcccgtcctccacctcccgatcttctcactcccgcctccacttccgcatccgatcccccaaacccaagaacccggcggcggcgcccgtctcctctcgcatggaagcgtccctgccccaggcgcgcgacgcccagggaggggcggagtcggccatgaagctgctgttcgtggagatgggcgtcggctacgaccagcacggccaggacatcaccgccgccgccgtgcgcgcctgcaaggatgccatatcctccaactccatccccgccttccgcggcgggtctatacccggagtgaacaccgaccagatgaagctgcagatcaagctcggcgtgccgaggtcgacacagcacttgctggatgctgagagagtcaaagccgtcttcccctatggcgagataatcagcttcgaggttgtcgatggcggcatgatctgttcgagcggcgtgtgcctggaagcaatgggggacaaaaacgacgactgctacatagtcaacgctgcagtttacgtcggctattgatgtaattctggaagagcggctttcacctggaacagtagaaatcgggcaggccacctctattttggagaactagagatgttttcctacctcaataagcatgtcattgctgaaataagtgcacttccttggtgtcgtatcgtattcgttctatgcctgccctcgtacgtcttttggtcacg

SEQ ID NO: 90 - DNA, 1659 bp, Setaria italica
aacacacaccccccaggacacaaagaaagaagccttcctgtccccgagcacaatgcgcctcgccggaatcctctccgcctccaccgtcctcctcccccttctcctcgtcctcggcgcgtctccgccgtgccatggcgcctcaggccacaacatcacggacatcctcgcggcccacccggacttcaccgagttcagcgccgccctgacaagcaccggcgccgcggcggagatcaacaaccgcaccaccatcaccgtccttgccgtcgacaacgacgtgatgtcgcagctcaaggcgcagcagctccagccgagagacctcgagcgcgtgatctacctccactgcctcctggactacttcgatgccaccaagctcggtagcatccggggtggtttcgtccaggccactagcctctaccaggcaaccggcaaggcgcagggaggagaaggaatggtgaacgtcaccatgttccgcggcgggcgtgtcgcgttcgctctgtccggcacctcgaacgtgccgccggccgcgttctaccagaaatccatcaaggaagagccctaccaaatcgccgtcctgcaggtgagcgccccgatctggtctccagcgccggtggccggggcgcaggcgcccgctccagagccgccggcgccgggattggcggatctcctgtccaagaacgggtgcgggggcttcgccagcctccttgccgcgacggccgacgctgcggcgaaattcgagcgcagcgccggcggcggcggcgggctcaccgtcttctgccccgacgacaaggcggtgacggccttcgacgccaccttcaagaacctcagcgccgacggccagctcgcggtcctgctgtaccacggcgtggcggcgcactactccgcgcagtctctcaagacgatcaatggggatgtgaacacacttgccactgacggatccaagggctacaagtacaacctcaccgtccgtgctgacggcgacacggtggaactgtcgtcggcgtcccagagcgcggccaaggtgaccaagacggtggtcgacaaggggcccctcgcagtctatctcatcgacgccgtgttgctgccaagtgagctcttcaacgccagccatggccgcactgcgcccgctcctgcgccggcctcgtcacctgcccatgcgccgccacctgctcctgcgccggcctcatcgcctgcacatgcaactccacctgctcctgtgccggcctcgtcgcctgcacaagcacccacaccgccagccattgcgccggcgactccacctacgcccaggcgccaccccgcgccaccacaagaggcggacacccctgcggattcgccggacgccgacagccagccgcctgcagatcagaagaacaacggagctagggacacggtgtcttggagtcttggcatggtggtggccgccgcggtgccggtgatcgtgctcctgctgcagtgaagggttcatgctggttagaatgatttcgatttggtgttcccgtgaccaatcatcttgattacaggttagcatggaaacagtgtttatgggcatgtattggtcaaaataatatgatcctgattattgtgcctgcttaacaatggtgttcttcgtggttggattggcatttctgtattgaatctttcttctaattctctctgtgtttc

SEQ ID NO: 91 - DNA, 1481 bp, Setaria italica
cgcccccaccaccaccatgccgcgcgcgctccctcccctctcctccccccaccaccaccacaagaaccgcgtcaacaccacctgccattgccgcgccgagctgagcctctagccgcgccaggagggcgcccgcctctgcctgcctgcctgcctgcctgcctgccgacatcttcggtagttgatggagttgcacaagtactggggcgtcggtggcaggcggtgcggcagctgcgaggcggcgccggcggcggtgcactgccgctcgtgccccgcggggggcgcgttcctctgcacggcttgcgacgcgcgcccggggcacgcgcggctcgcccacgagcgcgtgtggatgtgcgaggtctgcgagctggcgcccgccgccgtcacgtgcaaggccgacgctgccgtgctctgcgccgcctgcgacgccgacatccacgaagccaacccgctggcgcgccgccacgtgcgcgtccccgtcgcgcccatcggatcggaggccgcggccgccgccgtcgaggccatgcttttcgggaccgccgaggcggccgcgtccgaggccgatgagccgcacaacgccacggccgcggcggcggccgggcaccagcaccagcaccaccaccagcaccacgcgctgaacctcaacgtggaggccaaggacatgaagctcgactacctcttctccgacctggacccctacctcagcgtcgagatcccgcgcttccagcacgccgacagcgtcgtccccaacggcgtcggcgccggcgccgggggtgccatcgagctggacttcacgtgcggcatcggcgtcaagccctcctcctacagctcctacacggcaacgtccctcgcgcacagcggctcatcgtcggaggtcggcgtggtgccagaggccttctgcggcggtggcggcgggagcttcgagctcgacttcacccggcccaagccccaagcctacatgccgtacaccgcgactcctcagagtcacagcgtgtcgtcggttgacgtggaggtggtgccggagcggggggacatggcggcggcgaggccggtgccgctgatgggggagagccgggaggcgcggctgatgcggtacagggagaagcggaagaaccggcggttcgagaagaccatccggtacgcgtcccgcaaggcctacgccgagacgcggccgcggatcaagggccgcttcgccaagcgcgccgaccacgacgccgacgccgacgacgctgaggccgaggccgccgtgccgtcgtcgtcgtacgtgctcgacttcggctacggcgtcgtgccaagcttctgatgatggcgacggtctcggtccacggatggccggccggcggcgccgcgcttgacccggctctcgatggcgcgccagccttgtacttgtatcgatgtataggggaggaatagtaatcccatgtactctctttctgcattgagctagccttaagtacgctagtgatgtataatttgtatactac

SEQ ID NO: 92 - DNA, 1509 bp, Setaria italica
ctccctctccggttacccccacctgagggcgtctcgctgaattggttgcgcgcgcgccgtaccggtcggggacctgcgctccgcctccgctgctaccagcagaaactgcttctaggtttcctgcttttttctgtgggcacatctgcaaccgaattggtaaagatgggttgctgctttggaaagaaagctgaacaagccgttcaaggcgatggtgatgtacatagcgtgaaagtcttttcttacagtgagttgagaaaggctacacaagatttcagtggcgcaaataagatcggcgagggtggttttggttccgtcttcaggggagtgcttaaagatgagacagtagttgcagtgaaagttctatctgctacttcaaggcaaggcatccgggagtttttgactgaacttacagcaatatctgacattaagcatgaaaacctcgtcactcttatcggttgctgcgcggaaggctctcacagaatccttatttacaattaccttgagaacaacagcctttcacagacattgctaggaaccagatatagtaacattcggttcaactggcgggcacgtgtcaaaattgctgtgggtgtcgcccgtggacttgcatttctccatgaggaaatccggcctcccattatccaccgggacataaaggcgagcaacattcttcttgacaaggatctcaccccaaaaatttctgattttgggttggcgaggctcctaccacccaatgcaactcatgtgagcacccgagttgcaggcacattagggtacttggctcctgaatatgcaatccgaggtcaagtgacaaagaagtccgacatctatagttatggagttcttcttttagaaattgttagtggcagatgcaacaccaatacaagattaccttccgaagatcaatttcttcttgagaggacatggggcctctatgaggaagaacgtttggaagagatcatcgatatcgacgtcggtgatgacctggatgtcgaggaggcatgccgtttcatgaagataggcctgctatgcacacaggacgcgatggcgcgtcgtcccaacatgaccaatgtcgtccggatgctcacaggggagaagagaatcaacgtagacaagatcactaggcccgccatgatcaccgactttgcggatctcaaggtcagcaacaaggggcaaagatcaagcgagacacgctctcccgcgacgactgcacccacaacgttcaccactacagaaccattctcatcgtcagaaacgcccacgcagtcatccatgtgaaattctgaacgtcagaagcgtcctttttttctctccctcagtttgtatattgtgtgaattgtgatagaagggtcaggttacatgcaatttttgatgagtttcttgtttgatttgttatgaggaaagatctcataggcagcttattgcttctttgtatgctgtaaatatttcgaaacgaagatgataagctttgtgccattcgcattctgggactaccatgttggaatgctg

SEQ ID NO: 93 - DNA, 1144 bp, Setaria italica
ccttcctcttccttcccctgcaaactcctctcttgcccattggcaacactgaggtttgaaagatggctatcttggttatctcggtggacctggaatgctgccgctgcagagccaagatcaccaaggtcctggactgcctcaaagaggagttctgcatcgagaaggtggagttcgaggagaagctcaacaaggtgattgtgcgcggcaagttcagcggcgagcagctctccaagaagatctggtgcaaggccggcaggatcatcaaggagatcaaaatcgtcgaggtctggccgccgccgccgcccaagccggacccccctaaggaagatccaaagccagagccacccaaggaagaacccaagccacccaaggaagaacccaagccggacccccctaaggaagatcccaagccccccaaggaagatcccaagccgcccaaggaagaacctaagccgccgccgccgcccaaaccagaggtgaagtgggtgccatacccgtaccctctgccgtacccgtggtcgccgtcgcagagctggccgtgctcgtgcccgccgcagcggccgtgccagtgcccgccgccgcggccgctgccgtggcctcctctgccgccgcactgcacgtgctccaagaatgacgacaagcacgacaggtgcagcgcctgtggcggcgaaaggcccgacccgccggcaaagccgccgtgccagtgcggcgggaggccgccgtggccgccgtgcagctgcggtcccaacaaacagccgttctggtggccgccgccgcctccgccgccgccgggggtcgtctacccgccgccgtggtgcaatatcgtcaccgaggacaacccgggatgctccatcatgtgacaactgctgcatgctaatggcatcagcactctgctctagccgggtttcgatttcctctgctaatgggcctcggagatcgcaataatccgacactagtcggtgccgttcgtgtacactctgaagctttttgtggttggtccttgcgtcgtgttgccatttgggttgtgcagtgtgtgcgttgtgcgttcaactttatttactttcttcaaaaataaatacatgtaacaccaatgtatttaattattcgatgttatgttggtaactgtatgagttgttcaatctag

SEQ ID NO: 94 - DNA, 1208 bp, Setaria italica
cacagctccactccaagaacagcaaagcccacgcacaccgaagcagtgagcgaccgccagccagcccaaaccccacatggccgcctccgcaatgctgctcctgttcctcctgctggcgtcgccggcggccacgcggctggcctccgccgcctgcgcgagcgagaagttcccggcggggcgggcgtacgcgacgtgcgaggacctccccaagctcggcgcgtcgctgcactggacctacgacgcgtccaagagctcgctctccgtggcgttcgtggccgcgccggcggcgcccggcgggtgggtggcgtgggggctcaacccgaccggcgagggcatggccggcgcgcaggcgcttgtggcgctcaaggggtccgggtccggggcccccaccgtgaagacgtacaacatctcaggctacgggctgggcgcgtcgtccccgctcgagttcccggccaccgagctcgccgcggacgccggcggcagcgggggcatgatccgggtgtacgggaagctgcagctgcgcaaggggatgaaggccgtgaaccaggtgtggcaggtggggtcctccgtcaccggcggggcacccgacaagcacgcgttcggggccgacaacctctccgccaaggccaagctcgtcctcgccggcagcaaggccgccgccgcgggctccccttccctctcgcccgtccccgcgcccgaggccggcggcccgtccgcgtccggcagcggcaccgacagcggcgcggcgtcgtccatggcgccgtccgcggggaagagccctaacgccgctgcgctcaccgcggccggtgtgtccgcgccggcgctcctgatgatggcgctggtgggtttcttggtgacggtatgatgatggcggtagatggattctaccaagcatcattcatcagcgaaggtggcggcggcggtgggcaggagaggaagtattgcgctatttttgctgggcttttttttggctgggggaggaaataaacattgttgctgtacttgttggttgttgaatgttgagctgttgtttggtagcattagcatagcgatttactgtagttggagacatgtcattcatccggtcacatggccctagttctttcttgccgcagcgctctgtttctgatgaatctctgggtggtggtgttgtcgttgtagcagcagagttgtctgcagatgatgcagtacaagcgtttggtaggacg

SEQ ID NO: 95 - DNA, 1969 bp, Setaria italica
agagagagagagagagggagggaggggaaagagggaagcgagcacaagaggccaccgcagcggccaggcggcgagcaagacgcctccacacgtctctcccccttcccttcccattcccctccccgcccctgcttcacaacacagccctgtaggagcggcgcaaccaaaccccgcgaatcctcccccgatgcggcgcgggtaggagccggcggcggagcggaatggcggggggcggcgggaagcggcgccgggtgggaggtgggggccacgaggatgaggaggaggaggagatggtggtggaggaggaccgcatctcggacctgccggacgcgctgcggatgcagattctgagcctgctgccgctcaaatccgccatccggaccggcgctctctcctcgcggtggcggtgcctgtgggagcagcggtggccggagccgtcgtcggtccgcatccgcctccctcccggcgcggcgggggcggcggcgcgggtggagcagttcgggctcatcgaccggcgcgggaggcgccggatggactgcttctcgctcgccttccacggcgggcagctcacgcagccggacctcaggcgctgcctcgactacgccgcggtgtgcgaggtcgaggacctgcacctccgcgtcgacggcggcgcggggaggggatcgcgcgggggcgggggcacccgcggccggggcatgctcaccgtccacttccccgtcgggagccgcctgctcgcgcgcctctcggtgcgggggctcaacctcacggcggccgccaacgcgatggtcgccacgctcgaggtgatccacctccactcggtgttcctcaccgacgccgcgctgcgacgggtcgtcgccgcctgcccccgcctccgggagctcgacctccgctactgccgccgcctccgccgcatcgacttcagcgccgtgggggtgcccaacctcaggaccttcaccctcgtcgactgctcccgcaccacggaggtgcgggtccccatggcgccgcgcctccggtcgttccggttgagcggcgccttcctctccagcaacatcctcacgggcgctgggggctcacttgagcatctctacctctgctccggcgggccggagaacggcttgccgcccaccaacttgcccatctcggttccccacctatcgaacctcagtgtcctcaccctctgcagcattgcactccagtacatttctgctttcacagctaaggccgtagtggagagcaagctgcagagcttgagagagctcaatttcctcatgttcggcatggccaactccaaccttgctgacatctacagcttcctcaagacatgttcctgtcctcagttggagcggctctttgtgcagctcccgacgaacgttcgtgattcattcacggagaatttcttggaggtagcggaggaagagccacctaaaggtggattagaaaacctttggttagccaagatgacaaacttcaaggggcaccgtaatgagatgcaactagtagaatttctgcttagaaagtctagttgtctgaagaaactatttctgattgctcctacagaggatcaccctcaaggactccgcaagattcagtcggatgtgctgcccagttttctgaaaacagaaataatgcatttggaaagagcttcagcaaatacccagataattttcagtgagcctgatggtcctcagatccaaccattgcattcggaggtctttgtcaggttttagattgaaatgagcaaaatattgttgtagttcagtttctgctcataaattttagatttctagctgttagataacagacatggggaaaagaaatctgcaaggaatacagagtttgatatatgttttctttttgcaattcatattactgaaatattctggcataaaggttgaaatgggaggaattctgacctgccacatttttctcttctaccatcctcagcttctcttttgctgcttgtgtgcat

SEQ ID NO: 96 - DNA, 1254 bp, Setaria italica
ttgttaatttttcttcttctatttccaatccccacactgtccatcccccgaatcgaatcgatcgaaagcggaagcgaaaaggggcggaggaatctatggcggcgtcgacggcggcggcagcggcacccccttcctcctgcgagatcgcgcggatcccggaggacctcctcgcggcgtcgatcgcccgcaccacgccgcggaacgcctgccgcgccgccgcggtctcgccggccttccgcgccgccgccgactccgacgcagtgtgggcctgcttcctgccgggcgacctcccgccgcttgccgacggggagctctcccccgcgccgccgtccaagaaggagctcttcatgcgcctctctaacagcgacagccccgtcctcctcgccgaccgcctcatgagcatgtggttggacagggacaccggcgccaagtgctacatgctctcggcgagggcgctgtgcatcatttggggcgacacgccgcggtactggcgctggatccctctcgctgactccaggttctcggaaggtgccgagctccaggatgtttgctggttggaaatacgtggcaagatacattgcaagatgctctcgcgaaactcaacttatgctgcttacatggtgttcaagatatccgatgaatcctatgggctggattatccaccccaggaggctgcagttacaattggggaaagcaaattcactcgtcaggtttgcctccaaggccatgagaacgagggtgagggcatagaagaggtgcctcagaattaccgatctcttatggttccagccatcacacgaaggttaagaagaaaccgtcctttgcctcatggagtgactgtgcctaagaaaagggctgatggctggatggagatggaaatgggtgagttcaacaatgaagaaggtgaggatggtgaggtgtctatcagtctcatggagacaatacaaggccactggaagaaaggtcttattgtgcagggcattgaagttagagcaaagaaataaaactgggagggtgggatatcgtctttgcacatcaaaataaggctatatgtatatgttttgcagcattgtgttggtggacaatgtgcttttgtttgccaacgagctgctaactacacactgataaatgggtgtgtccaggttcttgagggaaaacaaaaaaaaaaaaccctgcagttttgtacaaattatggtgtcccagatcagttagtgcttgtctgcttgatgactggcaacgtttggttctgaaaat

SEQ ID NO: 97 - DNA, 652 bp, Setaria italica
ccgctctcagctcgccgtctccccctcaccttgtgcgctccgcaccgagcagcgaccagcaagaattctcagagagaccaaggcaaggcagcgagagaaagagagagtgagcggcagagcgttctacatgggcggcggcggcatggtgttcgagccccacgccggcgcggccgtcggtggcggcgacgtcgtgttctgcgtcgccatcgcgctcctgtcgctcctctccatgatcatcttcgcggcggccgccgggggcgaagggaagccgcggcgaagtgggcgcgccagcgggccggtgttcgtcggcgggaagggctgcggctgcggcgggtgccgcgcgggcgccggcgtctgcggcacctacctctcctgaatcctgatcgaccacgcgcacgagcagagagcatcggcgccgcggcctcggcgaccggcaaacccaggctcgccggcgtgcacgcgctgtacatacacacggcactgctctaaactttcctcttttttcccccttctgactttcttttctgaggactgtcctgcttggatatcatcgatcagtgttgctcctaataaacaccatgctgtaattataatttcataatctaaaaagagatggaacgctttctcttgaagattatatatctttcctctc

SEQ ID NO: 98 - DNA, 1881 bp, Setaria italica
gagctcgcgctgacagcggcgccgccccccttcccttctcctccgcctccgcccatccgccgccgccgcccgctgctgccgcggtaccctatggccccggccgggcggctcctcgcggtagccgccctctctgtcctctgtttgcagggtctattgcgcgattcaggcactgcatttgctcagagccacctgccgcttcaccggatcgttcacgcaggcgaaaatgacggcggcctcatgccggagctcccgcccagcggcctcatgcccatgcccgagctctcccccagcggctcaccgaagccatttgttcccttcctggctcctgctccgctcgcgcccttctttaacaacagcacgcccaagctctcagggaaatgcacattgaactttaccgctgtcgataagctgatgaccaccacagctgtcgactgcttcacctcgtttgctcctttcttggccaatgtcatttgctgcccccagcttcaggcaacactgaccatcctcatagggcagtctagcaagcagacagggtctctcgcattggatcccaccgtcgccaactactgcctgtcggatgtccaggagctgctgctgagccaaggtgccagcgataacctccacagcctttgctcggttcacctctcgaatgtcaccgagggatcatgtcctgtcagcactgtggatgcatttgagagtgtcattgactcgtccaagctccttgaggcctgtcgaaagatcgaccctgttaacgaatgctgcagtcagacatgtcagagtgctataaacgaggctgcccagaaaatctcgtccaaggatggaggtttgacgagctacactgggagcctgaaaattgatagttgcaggaacgttgttctcagatggttgtcgagcaggcttgacccaccgtccgcaaagcaaatgctgaggcagatatctaactgcaatgtcaacggagtttgcccgctaagctttccagacactagtaaggtggcaaaagagtgtggtggaataatcaagaacggtactacatgttgcaaggctatgttaagttatgtagcccatttgcaaaagcaaagcttcataacaaatttgcaagctttaaattgtgcttctttccttggggcaaagttgcaaaagatgaatgtcagcacgaatgtctatagctcttgtcaaataacactaaaggatttttcacttcaagttggatctcaagaatctggatgccttcttccaagtatgccttcggatgcatcctttgaccgcatttctgggattagcttcacatgtgatctgaatgataacattgcggccccatggccatcttccatgcaagcaccatcctcatcgtgcaataaatctgtcaatattccagagcgacctgctgcgacatcggcacaaaatggtgtgaaccacaagaacctgaagctaagcctgcttgtttctctggtctcccttgttctggtgctcgtggtgcaagtttagtgcagtccagtttggcaattattgagattcattcaggagagctaactggaagtgttggtgaagagcttgagtttttgcgatctggtggtcgcatcaaagtgttgtaggttcacaagtgttttgtgtttttgtaatctcctggtagctatatattagtgtaatttgttgtaaggcatataatataatgatagcaataatttatatttgttttgtatagtgagaaagagggggtggtgaatccaaagtgcatggcgatttggcaggagggaacgggttctttcagcattggttataattcatattgttcaattgatcatattggtgtggtgcaccatgaagtctgatataaatgttattagtattttatcctcttggtacaatacaaggtggtatgac

SEQ ID NO: 99 - DNA, 4660 bp, Setaria italica
cggcatctactactactcctcccacctcgtctccggcgggcgatctctccgatcagcccccctccgccgagatcgagcgatgctccgtggcgaggtgaggacgccctgattccgcgctgttgccgtacgtgagatctcggggtggccatctcgcggcggcgacatgccgtctctgcagctgctgcagttgacggaccgcggacgggggcttctggcttccaggaggaggactctcgcggttgtttctggcgcgctgattgctggtggagctttggcctatgcccggtcaagtcaaagccagcggagcaggcgttcggaggcaaattatggcagcgaagccagtgaattggccaccaatggggatgggttgagtcaaaattgtagattggctgcaacaaagcagaaaaagagtgggcttaaatctttgcatttcctaactgctatcctgctcaagaagattggtcccaatggcacacgctaccttctaggcttggtattaacagcggtgctgcgtactgctgtggggcatagattggcaaaagttcaaggctttttgtttaaagcagcatttcttcggcgtgtcccaacatttacacgcttgatcatagaaaaccttatactatgtttcctccaatccacattatatcagacatcaaaatacttgacagggtctttaagtttgcgtttcaagaaaattttaaccgatatcgctcatgctgattactttgagaatatggtttactacaaaatgtcacatgtggatcatcgagtatcaaatccggagcaaaggattgctagtgatatcccaaagttctcttctgaactaagtgagcttgtacaggatgatctggctgcggttgcagaagggctaatatacacctggcgtctctgttcgtatgctagtccaaaatacgtgttctggattatggcatatgtactagttgctggtggggcaataaggaaattttctcctgcttttggaaaactgaaatccacggaacaacaactagaaggagactatcgtcaactgcattcacgattaagaacacatgctgagagtgtggcattttatggtggtgagaacagagaagcatctcatattatgcagaggtttgatgctcttgttgggcatctgaatcttgtgcgtcatgaaaactggtggttcggcatgattcaagatttctttctgaagtattttggtgccactgtggcagttgtccttatcattgaaccattcttctctggcaaccttagacctgattcatcaacccttggaagggctgaaatgttgagcaatcttcgatatcacacaagtgtgatcatatcattgtttcagtcccttgggattctttctatcagttcaagacgtttaaatatccttagtggctatgcagaccggattcgtgagttattggatgtttcacgtgagttgtctggtattcgtgataaatcattgaatcacaattcttcttctggaaattatatcagtgaagcaaaccatatagaattttctgatgttaaggtagtcacgcctgcaggtaatatcttggttaacgatttgactctccgggtagaaactggttcgaatcttttgatcactggtcccaatggtagcggaaaaagctcccttttccgggtccttgggggtctatggccactggtatctggccacattgttaaacctggtgttggttcagatctgaataaggagatcttttatgtcccgcaaagaccttacacggctgttggaacactacgtgaacaactaatctatcctcttacagaagatcaggagattgaacgtcttacctatgatggcatggtggaccttctaaagaatgttgacctggaatacttgctagaacgctaccctcttgataaggaaattaactggggtgatgagctgtcccttggtgagcaacaaagattgggaatggccaggttattctaccataagccaaagtttgccatccttgatgagtgcactagtgccgtaacgactgatatggaagaacgtttttgcaagaaggttcgagctatgggtacatcctgcataacaatatctcatcgcccagctttagttgcatttcatgatattgttttgtccttggacggtgaaggcggctggaatgttcagcatagaagggaggactcttccttttccactgaagagtctgatttttcttcattagaaactgatcgtaaatctgatgcactgactgttcaaagggcttttatgagcagggcaaagagcaatgcttcgttggggtccaaggaccattcgtactctacagaggtcatagcaacatcccctaaggtggaaatagaacatgcagtacggacatctcgggttccacatttgcgatgccacccaagacctttgcctctcagagtagctgcaatgctcaaaatactagttcctaaactacttgataaacaaggcgggcagttgcttgctgttgctgtacttgttttctctcgtacatggatctctgatcgtattgcttcattgaatgggacaactgtgaagttcgtcttggagcaggataaagttgcctttattcgcttgattggtgtcagtattctacaaagtgctgcaaattcttttgtggcaccatctcttaggacccttaccgctaaacttgcccttggatggcggattcgcatgaccaatcatttgcttcgatattatttgaaaagaaatgcattctacaaggtattcaacatgtcaggtaaaagtattgatgcggaccaaagattaacacttgatgtagacaagttgaccactgatcttgctggcctagttactggaatggtaaaaccagtagttgacattctttggtttacatggagaatgaagctcttgtctggacgaagaggagttgctatactatatgcttacatgttactgggtttgggcttcctgagagcagtatcccctgactttggtcgtctctcaggccaagaacaagaacttgaaggaacattcaggttcatgcactcaagactgcggacacatgctgaatcaattgctttttttggtggtggttcaagagaaaaagctatggttgatgctaaatttgtaaagttacttaaccactcaaagattctcttgaggaaacagtggctttacggtattgttgatgattttgttacaaagcaacttcctcacaatgtgacatggggtcttagtctattatatgctttggagcacaagggagacagagctttgacctcaactcaaggagagctggcacatgctctacgattcttggcttcagtggtgtcacagagcttcatagcctttggcgacattcttgagttacataagaagttccttgaactctctggtgggattaaccggatctttgagcttgaggagattatatgtgccgctcaaaggaataccgtggtgtcttccaatgccatcagtgcatcctcagaagatattatttcatttcatgaagtggacattgtaacaccatcacagaagctattggctagcaaactgtcatgcaatgtggtacaagggaaaagccttcttctgactggtcccaatggtagtggaaagagttctatatttagagtgctcagagatttgtggcccaccttctctgggagagttatcaagccctctgaagggatgtttcatgtccctcagcgtccatataccagcctaggtactctgcgggatcagatcatataccctctctcaagggaggaagcagagatgaaagttctctcgttacatcaagctggaaacagatctagtgcttccatcctgcttgatgatcacctgaagacaattctagagaatgtgcggctggtgtatcttctagaaagagaagggtgggattctacaccaaactgggaagatgttctgtcactaggagaacaacagaggcttgggatggcccgtttgtttttccatcatcctaagtatggcatcctcgacgagtgcaccaatgctactagtgttgatgttgaagaacatctgtacaggcttgcaactaacatgggcataactgtgatcacttcctcacaaaggccagctctgatacccttccatgccttggagctgaagctcattgatggcgaagggaactgggagctatgttcaatccgccagtgagtgatgccacacctgagctgatgctatcatatgcgccgtcagctgcatgtacaaaagcaagcagctatcgcattgccattgtgtatgataatagacagtggcagtgttggtgtcctgaaagacagctatattcttgtcagaatctgcttggcgtagaacaacaaatcactcgtagtttagcttacatcaaggagaagggtggtgcgtgattgtgatccatgaatgatgtgtggcgaggtttcacttgtagaggtgtttcagagttgcagtagttggacagctgcagagcagaagagaacatgtaaattagcagatacctactgattcattgtattagattatgtgtagtgtagtagatatatatatgctatcgcaggcaaagcaataaataatgtggacgctgcaagggctagcggcattttagagcagaggctgtactgtaaatgacaataatttgtaaaagtgtcgttcctttttgtccatctttttttaagaaaaggaaatttgcaatccatgcatgcttggttt

SEQ ID NO: 100 - DNA, 878 bp, Setaria italica
gccaaacgaagccaacatctagtcaaggtccgtctctccttgccgcctccgctcctgcgccgcccgcttcaccgcaggcatccggcagccggctctacaacccgacgacgtgatctccccgccttcaattcctctctcgtcctgctctgtgcacaccaaggaagatggtccgggaggtggccgagagctgcgtcgacggggtggtcatggagatggtagcggcctactgcggccgcttctacgccgccaagcccgagctcgcggcccgccgcatcgaggccatcggcttccaggtcggtcaccagctctccgagagatataccatggagcgccctcgatttagtgatcatcttgaagcaatcaaatttatctgcaaagacttttggtctgaactattcaaaaagcagattgataatcttaaaacaaatcacaggggtacctttgtccttcaagataaccgttttcggtggcttactcgtgtttctctagatccacctgcagagagcactgatgcaactgacaatgactctgcaccattgggtgatactgcagcccaaacaacaagcatgcttctgtattttccatgcgggttgataagaggtgccttgaccaacttaggaatttcatgttccgtctctgcagatatgtcaaaccttccagcatgttcctttgtggtgcgcataaagacatgaactgcgagaaatgatacaaatacagtattaagtgctggcttgtggttcaagtcatttgacacctacctgttttcactgtctttcaatgaaattccttcttcgccttcatgaccatataaccgagatcgggtgttactttatgttgcatattagtaatattttctctggaagaattgtggcgccaat

SEQ ID NO: 101 - DNA, 2650 bp, Setaria italica
gtcgcaagccaagaacaagcgagcgtggtggggaagggggacgtcgggggcaaccaccgatcgacggggcaccggcgccggcgcacgccatgaggctgctcgtccccgacggcgcgcgccgccagcggctgctgcagtgcgaggcgcacctgccgcctgcatctccgcccccggcgccggcatcccctgctccggcggcggagccggcggcgggcgggaggacggtggtggtggggatcaggcgggacgccgccagccgggagctgctcacctgggcgctcgtcaaggtcgccaatgccggggaccgcgtcgtcgcgctccacgtcgccgcgcagcacgtcgccgccgccgccgacggattgctcatggggctggatgagcggagcagggccgcggactcgctcgcgtcggtgctcgctgtctacgacggcttctgcaacctcaagcagattaatttggagctcaaggtctgcggaggatcgtctattcgcaaaactctggtcaaagaagcagcttcctgtggcgccgcccatctcatcctcggtgttgccaagaattcccggtccttcggatcctcctccacatcagttgccaagtactgctcaaagagagttccggtgggctgctcggtccttgcagtgaacaatggcaaagttgtttaccataaagatgggggccacgggatgcaacatgaactgtaccaaagcacaatacctgagacaccaaggaggagctaccggaagctcttgtcatccatgataggagagaagctttgggatgaacatggaaaggacaacaggtccatttctcgtgccgtcaccatgccaatgaggtctcctgcctcatccataccaatgaggtctcctgcgcggtcaaaagaagtttcactagcattggtcccagtgaaggcttgccgccgcgaatcaccagaagtagcaactggatggcccctcttgaggaagaagttcttgccagaccggaaagcttccctgcctgacaaatcaaagatgtccgtggtgcagtgggcgatgcggctaccgagtaggtattctggagtttcaccagtccattcggaatacagaaccacaagaccagactccatgagtaccagtcatattctccgtgaccggttggttattcccttgaggagcaattcaggaaaatcttctgtagtaattcaagaattggacaaggaaactccagaggaactgaccttgctgaaagagaaattctcatccgtttattcttccttcagttacagtgagcttgcaaagatcacctctgatttctcaccagagtgtgtagttggacaaggtggcactagtcaagtttacagaggctgtttggcaaatggcagggagctagcagtgaagatcctgaagtattctgatgaggtgctgaaggagtttgtctcagagattgagattgtcagctctcttagccacaagaatgtcatttccctcattggtttctgcttcaagaatgatgaccttctattagtgtacgagtacttgcaaagaggcagtctggaagagatactgcatggtgaaaaagaatgcaagaacatatttggttggactgagaggttcagcgtggccgtgggagttgctcatgctctggattacctccatggcaatgacaacagtcgtccagtgatccatagggatgtcaagtcatcaaacatcctcatctcagagtgctttgagccaaagttatcggattttggtctcgcagtctgggctgctgatgtgacatctcagatgacgtgcaatgacgttgcaggaactttcggatacttagctcctgaatacttcatgcacggtaaggtgaacagcaaaattgatgtatatgcttttggcgtagtccttcttgagctcatctcgggcaggaaaccactctgcaatggttgtccaaaagggcaggagagcctagtgatgtgggcaaattccatcatacaaggagggaagctcacacaacttgtagatcccaacttacctactgaaggccataccaatgaagttgagaggatgacccttgctgcttccctctgcattagacaagcacctcagaaccgtcctcaaattgatgctgttctgaagcttctcgaaggtgacaacgatatcctcaagtgggcacgatcacaagtcggattagcatacgaggtcgatggtgatgaatgtgtgatgacaccaccagcaccagggagcaacgccaacatccagtcctacatcaacctagcattcgatgtggatgatgactccgcctctgtcagcagcaccgacttcattgcagccaacacctccttggaagagtatctgaagggaagatggagccggtcctcaagcttcgactgactgatccgtggcagagttacaccttgctagtgtatagatcctttttttttaaattaagttacatttttgggccttggatgagagttggcacatgcaatgccctccaccgggaatttcatttgatcatgtatggcttagttttttttttatgtgggggtctttttacctctctgaagggaccccttttttactgtctgaagagacttgtcatacccaggtattctcatccaaagggatgagaaataaaataggaggcaatatgaaattgtgggtttcttcccataccgaaatgaatc

SEQ ID NO: 102 - DNA, 2137 bp, Setaria italica
cctagaatataggatcagtagtacacacgcacgacctcctgtatatgaatcccgtactgcagtaaagactttgagctttccagcagttgttcctctacaccgccgaccccgaggttttagctccaccacgagctgccactcccctccaccgccgcgacgatgatctccctgctccgccgcaccgtctcctcctcggcgccggccgccgcgcggtggcggaggcccctcctcgcggcgctgctctccccgccgccggcccctcccggccctacacgccgcgcgccggcgctggagccgccgaggcgggcgttccacggctcgcgggcccccctggggttcagggccacccccgcgtcgtgggctgggcccggaccgggggcgggcgtggcagcgggggaggacggcgggctggagattgcgaggctggggatctccgggcggatcgtggagaagctcgccgcgcggggcatcaccaggctcttccccatccagagggctgttcttgagccagcaatgcaaggaaaagacatgattggccgtgctcgaacaggaactgggaagaccttagcttttggtattcctatcatggacaggattattagctacaatgagaagaatggaagtggtaggaatcctttagctatagtcttggcaccaacaagagaacttgcccggcaggttgagaaggaatttagagaatctgctcccttggacacactctgtgtctatggaggtgttcctatcaaccaacaaatgagagttcttaactatggtgttgacatagtggttggaactccaggtcgagttattgatcttttgagaagaggtgttttaaacctttccgagatccagtttgtggttctggatgaagctgatcagatgctggctgtgggttttgatgaagatgttgaggtgatcatggagcagttgccacagaaccgtcaaagtatgctgttctctgcaacaatgcctagttggataagaaaaatttcaaacaagtacttaaaggatccagttataattgaccttgttggtgactcagaccaaaaattaccggaaggaatctctctgtactccattgcctctgacaactttgggaagccatcaattcttggtccgttgattaaagagcatgctaatggtggaaaatgcattgtgtttactcaaactaaacgagaagcagatagattggcatatgttatgggaaggagttatccatgtcaggcgctacatggggatatttcacagaatcaaagagagaggacactctcaggatttcgtgatggtcgcttcaatatccttgtggcaactgatgttgcagctcgtggattagacatacccaatgttgatctagtggtacattatgagattccaaatacctcagagttatttgttcacagatctgggagaactgcacgagcagggaagaaaggcagtgcaattttgatatacacatatgagcaaactagagctgtaagggtcatcgagcaagatataggttgcaggttcacagagaagaacgggtgggactttggccgtgaaagttatggtggcttcggagatcaccgttccggtggctttggtgattttgacagttttggtggttcctttgatcgcggtggcgggtcccgcgactctggttcgggataccgtggtgggtctggaggtttcagacgaccttccaatgactttggcaggtctagtttcggtcgctccgatagatttggcgactttggagaaggcgatttcagcaggcgtggcagccctgactttgggcgctcccggagctccgatgattcaggatcctcgcgctatggcagaggatccagtggtgttggcactcctggtttcggcaacttcggtggctacggggattccaagcgatgagtggaatgtctttcttcttgtacagttctgaacttttttctagcacctgttgtttcttccatgcctgagagaactaggcgcgctttgttgcgcttttggcctaatcactagtagtttggttgtgtagtgctgtttcagaacttatgttgtatttgtaatttgtgtatgtgcctactggcccctgtatgttctgattccgttctctttaataataatctgataaaagtaaaccctttttttttgttcctgt

SEQ ID NO: 103 - DNA, 1429 bp, Setaria italica
cggctccattccgcctccgcctccattgctttgcttgcaattgcaatgtggcggaagacttgagtgagagctgagtagagtacagtaggccgaccatggaggtatcctcgaggctccaaagcctcctgaggcccctcctccgcctcccctcccgcaccacaggcagagccctccaaaccctagcccttcgccccccgccgcctcctccccgcgtcccatcctccttcctcctcctccgcccgcgccgcctcccgcctccccatcctgccagcgccccgtcgcgcctcctcctccgccccttcgcctccgtcgccccggtccccgggagggaccacctcgactccaaggaccagggacccccgcccgcacccttgcccccgccgccgccggaggagctcgcctccgacgacgaggcctactaccacgagcaccttctcgaggtagcacaggagaaccagacaagggtcgtccccgtcaaggcgttcttcctatgcaccagcatcgacctgcggagcctccagtcccagaattccttcaatgtcatcccacccacatcgcgtgccaccaactacgtcgtccttagatactacgatgtcaagggagaccccgagggttttaagtctggtgtcatagatgagagccattgtcactacatggtcgttttccaatatgggtccatcgtgctgtttaatgtttctgatcatgaagcagatggatacctaaacattgtcgagaagcatgcatcaggtttacttccagagatgagaaaggatgattatgctgttgttgagaagcctaccttggagacatggatgcagggtggtcttgactatattgtgcttagggatctgagtattgatggaatccgcaccattggaagcgttctgggtcagagtattgctcttgactactatatccgtcaagtggatggaatggtagctgagttcacagatatcaatcgtggaatggaaaaaactggcaccttcactatggaaaggaagaagcttttccagctcgtagggaaggccaactctaacttggcagatgttattcttaagcttggactctttgagaggtcagacatagcatggaaaaacgcaaactatgctcagatctgggaataccttcgagatgaatatgagctgacccaaagatttggaaaccttgactttaagttgaaatttgtggagcacaacatcaggtttcttcaggagatcctccagaacaggaagtcggatttcctggaatggcttattatcatcctgatcagtgtggagatattgatatctgtttataacatcgtccaggagcagatgtagcggctgtgttacatcctgaacacggcaaaggtgtttttgcgttgccccaatgccactggcagcctcaatcaatttgtaaagaaagagtactagatagtggatccgattgg

SEQ ID NO: 104 - DNA, 6873 bp, Setaria italica
ccgggcctcgtcttcctcgcttcaccgctctggaaattcacgcgctaagcgcacccgcgaatctacccacgctagcggggccgggccagaggatgctgtccgtggcgggggcggtggaggttggggtgaaggcggccgctccaatggcggagtgctgaggcgctcgggaagggaggagagggcggtggttgcggcttcgaccctgcgaacgagcgagcggggatgattcggtaccagatacggaacgagtacgggctgtcggatccggagctgtacgcggcgccgggggaggaggatgacccggaggcgctcctcgagggcgtcgccatggccggcctcgtcggcgtgctccggcagttgggggatctcgccgagtttgcagctgaaatttttcatgaccttcacgaagatgtgatggccactgcttctagaggacatggtttaatgctccggttgcagcagctagaggcagaatttccagcagttgagaaggcaattatatcccagactgaccactcaaattatccacatgatgatggtgtcgactggcatgctaatcttcaacttaaacagaatatgatcacacaaggagatatgcctcgcttcattttggattcatatgaagaatgccgtggtccaccacacttgttcactctggataagtttgatgttgctggtgctggagcctccttaaaacgatattcagacccctctttcttcaaggcagaacatacctccaacatgttagaaattgatgtttcaattgaaaagaagccccgtcgacttaagaagaaggctatacgttggaggaaaggggcgacacttgaatcattacttgcaaagtctgaatcttttactacccccaaggatcgaacttcgaggaaagttccacctaggacaacaaagttgaaatccaggcatccaaggagtcctgaccataaaactattagcagaatctgcagggagcatctgctagaagtaatttcatcacaacaaaaaattttctccagatattctggaaggcaatgtcatgtgagatttaggtcaactgactcgagtgaaacgggagaaatggagaattttggtgccattgttcagtcttctggtaaactggaacttactaaaattgttccaataaacgaatccaataccatggagattatatctgcacccactgatggatcagcttacctggagctaggtgataaacaaattttggggaaacaacatgaacctttagaaaaaaatggcatggtccgtgacttaggaaagctgcaggattgtccaaacttccaggttggtgaaagtaatcacagctcgcattcaggacatgaagagaaacacattttagctggggttcctgctgatcaagatgctgatggctgcaggcctgatgacatttgtagtgatcaagacaacttcatcgacgctcttaacaacatgggcccagaaggtgaagcagatcctgaaatagaaactgaatttgatcccagtgccaacgtggaacagattgaattgaaccgtgacagcaaggaaggtgaagatgcattgtatgcggagtccccacaagtaggtcctgcaatagactcgtcaccagggttcaacagttcatgcaatgctgaagaagcgacctgtatggacttgccaagtgactctgctaatcccgcagtgtcagccagtaatggtcctagctctgtttcacaatctggaagacaattgaatgatgttgattggatcaaagatgaagaaccttttgatgatgaggatctaatggatgtgagctcatcatctagtgtagcttctgtcaatgctgtcttacaaaccgatgaagatctctatggttgtcaacaacaccaagagaaagcttatcactatcaaagtagtgataatgcagctgttatccatagttctgataaacattcacccaagacatctagtgacttggatggtacggctgtcggcaacaacaattacactgacgaagtatattgttccatggagcaaggccaggatgttgtgctagatgatacttctatggtatcgagcaaacctaactatgttccagaagacgaagacaaactcagttttaggattgctgatgatttgtttccccacccgaccatacccaatcaagaggaaatacaggagatggagaaagaattggaaggtggatctctagatacagacgcttcacctggcatacttgcatcatggccagataagaaccatgttatgtgcttgaatgatgtagagatggacaaggacaatgttatcgttcctgaagaaattgctgctgatatggccccaacaggtttggatcctcatgacaaccatgatcatcaagatggaattgcaccagaacattcaggcatgcgtaataatctaccgtatgaatcatatgatgatgagattgctgaagatatgcactctttactaaacgatggtctatcaactccttttaataaggatgttgcagaggataatcaaatagttgtgcttgaaggaggggcctgtccagctagcctcaactcacacaaagaagattctgagcaagcacctgccatggccaggaacttatctgatgtccaagagtttccagtagtaattcaaggtgtaccttctcaagaggagacagaagctcatgcagtagagacccttgcacctgtgtcttgtgtgttcagtgctgatacagaaccagtggggattagtgtgcttccagcccctaatacttcctctctacctgacaacagtagttcatgtgtagaacaacatgcattgactgaaatggaagacattgtggagggtggcaaagttgtggttgcagaagaatcaactactagcaggtttgcagatgacgtggtacctcctgaagattttattgatgatgccatatatactgaaaaaacacagattctggctacagattcaactgaagaagcctctaggcatgatctgcaactacagcataattctcctttaagggaagggttggaaccagtagaagctactgacagaaatcttggggaagtagatgcatcaagagaatatatatctaaggaaaggatgttgcagacagacaatattcctcctctcaatgaaatagagcctacaggtgaaaaatgtagtgacagggatgaggttctttccgcaggacattttcctgtagaatctgattatcaagaggaattactagagtccagtcataatgctggagttcactctctgtgtgatttggataaggattttgcagtaagcctgaaatgtaacaccatgggggaacaaccagaggatgttgacgatcaagatttggcttgggggatgcccgatcaagattttactagtacaaacccattcatggatcctgcctacatgctgagcctaactcaaacttgtccatctcccattgtgagttgccaaccatgtttccctgaagaacaggatttcctttcagaacttctagtgcagcatgacaatatgggagcagctgctgattccctttgggagcctgcaactccacctgatgaagcgccattgccatcagaagttatgactgaagaagatttcagatccttctgccgtgagtatcatgagataaatttttcagctgccgctgaaggttgtcacagtgaaccggcctcagactctaacaatatttcaaatgcttttctggtcagtgaatcagattttccaagttctgtttctgccttgccagtgaagttaaaccaggaagcctgtgttcattctaagtttggttctcaatgtgctgagccttcatctaccatggatatacaaggcgctacatcaatgaccttttctggcaaagaagatctcacggatgagacaccaggagtagattctcatttaaaatctgatgcatctttcagtgttaacagaagttctgaactagatatgctctctgttccagtagatttacagcaggaacagctgtctggaattgattctcatagtagttctcctttgttggataaagagatgaccggtgaaggatgctgctctccttcaagtgatgttgttgaagtgaaacacgatctagaaatccacgccaatcttgctctacattcttttattaatgaaactggagacgaactggatgttgctgtacaagtggaaccagaggtaggagctcatgctgatgataaccaagatattccatgttgttcaactagcgaaaaggatgattcccttatgggcaaacctgttctagttcaggagtcagaagtttttgccttcggtgaatttgattctccaatcgttccattatcttcaattgatgacattgaagacaatcaagactctgcttcgaggacttatgttcaaacagaacaagagtcagaatgctgcacctcaggtgaacttgattctcaaaccactccatcccctttgcttgatgagaagattgacaaactggacggccctcctttgagcaatgctgccatgctggatcaggaatcagaagtttgtgttccaagtgggcttgattctcgaatcgctctatgttcttcaactgatgagaatgtacatgaattggatcatcctcctttgagcagttcagttttaatcaatcctgagtcagaagatcatgtgttgggtgacactagttccaaggttactatgtgttctttagttgaagacaagattgatgaatccgaagatcctcaaccaaaccataattttcctgaggtacggcaggaagctcttgcatcccctgaattagactttcaggttgctccatgtcccttgaatgatgataaggttggtgaaatagaagggcctccatcgtgcaatggccgggtggaatcagaaaaggaatctgattgctcaattgaatctgattcccaaagtgcgccatgttcttcaaattcaccagtactagctgacacaggagtattgacttctcctgtcatgcctaataatgaggaaatgaatcagttgtctcctggtccgccacccgctgtacaatttcaaaatgattcctacgaagatcctcaagctcaagcaccaccccctctccctcccctccagtggaggcttggtaggcctcggctagggcttctaagtagaaaaagctctatgcctgagcctgcaaggagcatagatcctgttttccaggcatcaaaccaagacatggatatcaggctaggtttgcttgatcaaccagatagatcaatagaaccagtatcctctcaagcgaccgaagaagatacgcatcagagttctttgttagacggtagtgatcaaaatgtagaagttggattgtcgaccagtgtcacagtaactggtgtggcaaggactgaacactattggccattctcagaagcttcagagaacattaagggaccggagcatatttcttcatcatttaacagaaatctggatgctggggtcacatcagcaacagctgacgaggaacatctggatgattctggggtgacacatggagcagttttatactcatcagacccgctgcttcgattacctgcagatgaacagcaggaacctcaactgtgcaccttatcttcagatactcgagaaactagtgtgcatcccagccgtatgcatccaggtgcatctgaaaatgataagtcaacagatgctgctggtggcatggaaagcacctcaacaaagggacctgattatgaaaatagtttttaccagcaacctcagcatgttgaatcgttctcaaagacttcagattatggagagcatattacaaatgcatcggtggagggtgtaaaacatcagtctggtacaagcgagacactttcagacccagcaaagcattctgcaccaggcacattgttgaaagatgggaatagcaaggggagtcaaattttgcaggaacaaaatgtgggtagttctcaggacaataagtcaggaggcccattgcccagctcggaatcaatggcatctgaagattatcgacatgatgaatataatttggagagagaaaatagacacccgcctagcaacccaggcccactagtggcatggcctggtgataaaaataacttcttcagtggccttgatgaagctagctttgcgcatgctgagcaaccacctgtgatgggatggactgttgggcctcagatgattcatcctaagtatggtatatcagcagaagagagccaatttgagccaaatatcaccgacaatcatttaatcaagaagcctatttcaattaaaaacatcccaaggaatccactggtcgatgctgttgctgctcatgatagaagctcgatgcgaaagatttcagagcttgcaccatcggctgacaagccgaagcccaccgagagaaatctgttgctagagcagataagaaacaagaccttcaacctgaaaccggtggctccttctcagccaacagccatgagatcccctgctagagctaatactagaaacttgaaggttgctgcaatcatagaaaaggcaaatgccatccgacaggcggtgggaagtgatgatgaagacgcagatagttggagtgacgcctagacgcccatctgttcccctctcggtgttcatcaaggacatcgtggacaggttggggttgcacagccatgtcattttttggttagcaatggtagtcttgtgtatagtatatgctcataatcttctttctttctttcttttcattcttctcttattctttcggccgattatctgtatacttgcctctcccagcagcaaaggctgttgcagtggacatgatccggaggagagcatgcatattcttcaggtctatgtaaatttaacagttctagttaaacacgtctatctactggggaggattatgacatcaatgattccatacatacagaccttaagttacaaaaatataagagatccaaaaaa

SEQ ID NO: 105 - DNA, 4332 bp, Setaria italica
ttgcgaacaaaatcaggcaatcgcccccaattccacttcccctctccctacttcgccccgcccccctccccgtctccgagctctcgcgagaggcggctgcggctcgccgagacacagacccctcgcctcgccccgccccaccccgcccccggcgcatcagccagccactaggtctagggttcctccggccatggaggacgacgagtacgaggaggggatggagatgggctacggcgggcaccaccagcaccgcggcggccacgcggggtacgcggaggaggaggaggaggtggggtacggcggcggggacggggacgagatggaagaggacggggacgccgagcagcgggacgaggaggagatcacccaggaggacgcctgggccgtcatctccgcctacttcgaggagaagggcctcgtgcgccagcagctcgactcattcgacgagttcatccagaacaccatgcaggagatcgtcgacgagtccgccgacatcgagatccgccccgagtcgcagcacaaccccggccgccaggccgagttcgccgagactctgcacaagatcagctttggtcaaatctatctcagcaagccaatgatgacagaagctgatggagagacagctactttatttccaaaatcggcaaggctcaggaacttgacatactcggcaccactgtacgttgatgtatcatacagagtaatgaagaaaggacatgactgtgaggaagttacagaaacttcagattacccgaaagtgttcattgggaaggttccaatcatgttgcgttctagttactgcacactatatcaacaatctgagaaggaccttaccgaactcggggagtgcccttatgaccaaggcggttatttcattatcaatggaagcgaaaaggttcttattgcccaggagaagatgagcaccaaccatgtttatgtctttaagaagaggcaaccaaacaaattttcatatgtggctgaagtccgttccatggctgagaaccagaacagaccagccagcagcatgtttgtaaggatgctttcgcgagcaggagcaaaagggggttcatctggtcaatatatccgtgctactctgccctatattcgtgcggacattcccattatcattgtttttcgagcattaggatttgttgctgacaaagatatactggagcacatatgttatgacttttctgatacacaaatgatggaattactacgcccatccctggaggaagcttttgtcattcaaaatcaacaggttgctctggactatattggaaagcgtggagctacagttggtgtcactcgagaaaagagaattaagtatgcaaaagaaatacttcaaaaggaaatgttgcctcatgttggtgtgggggaattttgtgaaactaagaaggcatactattttggatacattattcaccgcctactgatgtgtgctcttggtcgaagagctgaggacgaccgagatcattatggcaacaaaagactagatcttgctggtccattgcttggagggctgtttagaatgctcttcaggaagttaacaagggatgtgagatcttatgtgcaaaagtgtgtagataatggaaaagaagttaatttgcaatttgctatcaaagcaaaaactattaccagcggcttgaagtattcccttgctactgggaactgggggcaggctaaccaagctggaaccagagcgggggtttctcaggtgcttaatcgcctgacttatgcttctacgctgtcacatctccggaggctgaactctcccattgggcgtgaagggaaattggcaaagccccgccagttgcataactctcattggggaatgatgtgtcctgctgaaacaccagaaggacaagcttgcggcttggtgaaaaatcttgccttgatggtatacatcactgttggttctgctgcaaatccaattttggaatttttggaggagtggggcacagaaaattttgaggagatatcaccagccgtcattccacaagctgctaaaatttttgtcaatggttgttgggttggaattcataggaaccctgacctgctggtgaagactcttaggcgtttaagaagacagattgatgtcaacactgaagttggtgtggttcgtgatatccgtcttaaagaacttcgactctacacggattatgggcgttgcagtcgtccattgtttattgttgagaaccagaggctgctcatcaagaaggcgcatatccgagcattgcaacaaagggagactcctgatgaaggttggcatgagttggtctcaaaaggatatatagagtacatagataccgaagaagaggagactaccatgatctccatgactataaatgaccttataaatgcaagacacaacccagaggaggcgtattctgagacctacacgcattgtgagatccatccttctttgattcttggtgtttgtgcatcaattattccttttcctgatcacaaccagtcacctcgtaatacatatcagtctgctatgggaaagcaagccatgggaatttatgtcaccaactaccagttaagaatggacacattggcctacgttctctactacccacaaaagcctctagttactacacgtgctatggaacatttgcacttcagacagttaccagctggcattaacgcaatcgtcgctatctcttgctactctggttataaccaagaagattcagttatcatgaatcaatcttccatagatcgtgggttcttccgatcactatttttccgctcttacagagatgaggagaagaagatggggacacttgtcaaagaggaatttggtcgcccaaatagggagaatactatgggaatgcgccatgggtcatacgataaactagatgatgatggccttgcaccacctggaacaagggtctcgggtgaagatgtcattattgggaagacatctcctattccacaagatgacgctcaagggcaagcttctagatattctaagcgcgatcatagtacttctctgcggcacagtgaaagtggtatggtagatcaggttctgttaacaacaaatgctgatggtctaagatttgtcaaggttagaatgcgatcagttcgcattccacaaattggagacaagtttagcagtaggcatggacaaaaaggaactgttgggatgacttacacacaagaggacatgccatggacgattgaaggcatcacacctgatattattgtgaatccacatgctattccatcccgtatgactattggacagctgattgagtgtattatgggtaaagttgcagctcacatggggaaggaaggagatgcgactccattcactgatgttactgtggataacatcagcaaagctcttcataaatgtggttatcaaatgcgtggatttgagaccatgtacaatggtcacactggaaggaaactgacagctatgatttttctgggtcccacatattaccaaagactcaagcacatggtggacgacaagatacattctagaggtcgtggtcctgttcagatactcacccgacagccagcagaggggcgttcgcgtgacggtggtctccgctttggagaaatggaaagggattgtatgatcgcccatggagcagctttcttcctgaaggaaaggctgtttgaccagagtgatgcatacagagtccatgtatgcgagaaatgtggtctcatcgcaatcgccaacctaaagaaaaactcatttgagtgtaggggctgcaagaacaaaactgacattgtccaagtacacataccctatgcttgtaagcttctgttccaggagctcatggcgatggccattgctcctagaatgctcacccatgatatgaagacagggaaggatcagaaaaaacgctgaaccagtatcccatgggatgcttagctggccctcttccttctagggttcatacgacgtgatcttttatcagctagtaccatgttgagaaacttctttgtgaccacttcttttttaatttggacttcggttcttcacgaatgatgtctccatgggtatcatgcccgtctctgttctggatgtctcaaatctacgctagcaagcaaatggcgtatgagttttagttacttttgtacattagaaattgactcatgggtaaagggactgctcttgtaaggttttttgaaggactcgtgtgctgcactgtattgagtaaaaatatttggacacttggcgtgccaacttgggcgcttgctgtaacttcaattgacaattgtatgggccactggcactgtatcttagtagtgttcgacttagatctatataaaccaaggattgttcaaggataaggaaaggaatacttt

SEQ ID NO: 106 - DNA, 2485 bp, Setaria italica
atctccttcctgctgctagcctgctacccctctctctctcgtctgcccccctcccatctaaagctttctagcgattcctggcgttcctcttccgattcgcctcctccgtttgcggcggataggatttggattttcggatcgaccgacgaatccatccatggcgcggaccaactgggaggccgataagatgctcgacgtctacatctacgactacctggtcaagcgcaaccttcaggccaccgccaaggccttcatcgccgagggcaaggtcgccaccgaccccgtcgccatcgacgcccccggcggcttcctctttgagtggtggtccatcttctgggacatcttccactcctccaccgcaaaaccagcctcctcctccgcctccggtcctccccttcacgatatcaacaagtcgagggagcaccagatgaggctccagctactgcaccaacacaacgccgcccaactccacaccagaggacctgacgtctccgccgtcctcgcttccaaaatgatggaggaccgcatcaggaaccccaacccggccgactctgacgcatcacagcatctcctagacgcaaataggatcgcacttctcaagtcaccacctaaccaaactgggccaccccctatgcagcagcagcagattcacccaagaaaccagcaacttgacatcaagcccgatgttgctatgccacagagaacagtgccagcggaccattcttcattatatgcatcagggatgatgcacccaaaacctccattactcgccgctggactaaatcaagctggaggaagtgtgccgctcaaaggctggcctctaacggtcacaggtatcgaccaactccggtccaattttggtgcgcagaagcagttggtgccatcttcaaaccagttccaacttttgtcaccacaacaacagttgattgctcaggcacaaacaccgaatgaccttactagaatgagttctccagcaccatctgcttcaccgaatgttcgatcagatgatccggattatttgatgaagttgaagatggcccagatgcagcagccctcaggctaccggcctatggaattgcaacagccgcaacaacagaacactagaaagcggaagccaacttcttctggagcagctaatagtactggcacaggaaatactgttgggccttctcctccatcaactccatccactcatactccaggtggtggggtaccagtgactagcaatgctaatattttacagaagagttcaatgatttgcggcacggatggaaccagtggacttgcctcgtcctcaaatcagatggatactttggatagttttgttgattttgatgaaaatgttgattcattcttgtcgaatgatgatggagacggaagagacatgtttgcagcattgaaaaaagggtcttcagagcacaattcagagtccttaaagggtctctccttgagtgaggtaggtaacaaccgcacaagcaacaacaaggttgtttgctgtcacttctctacagatggaaagttattagctagtgctggccatgagaagaaggtcttcctctggaatatggataattttaagatggataccaaaatagaagaccacacaaactttatcacagacataaggttcaaaactaattccactcagttggctacatcatcttctgatggaactgttcgactttggaatgctgctgatgaaagtggcactttacaaacttttcatgggcatacctctcatgtaacgtcagtagattttcacccaagattgacagaggttctttgctcttgtgatgacaatggagaaattcgcttctggaaagttggtcaaactacatcgacccatgttttaagggcgaagcagggtggtaccggaagagtcaggtttcagccacgaagtgggcagctcctagctgtggcaggtggaagcatggtgaacatttttgatgttgaaaagcaggcaaacttaccctctccagcaaagggtcacaacagtgaggtaaactgtgtgtgctgggatgaaagtggtgaatatctggcttctgtaagtcaagacactgtgaaagtgtggtcagtatcgtcaggagcgtgcattcatcagctaagatctcatgggaaccaatatcagtcatgcgtgttccacccgagatacccaaaagtgttgattgttggtggttatcagacgctggagctatggagcttatcggataaccagaggaacccaatccaggcgcacgaggggctggtagctgctctggcacactccccgttcacggggatgattgcctctgccagtcatgacagatacgtgaagctctggaagtagctagaaactaaaggtgatggatggattgattgattgattatacactcactagtcgtctatctagtcctcctaataattataaaatgtacttatgatgatcagtttacttgtgttacatagcgcctgttcattcctttggtgacttgattagctatacac

SEQ ID NO: 107 - DNA, 2437 bp, Setaria italica
ttcctccaccaccagcccaccccgcccgcccgcgcccgctgctgcttccgacgcacgcgagctccgcggcatccgcatccgaatccgcacacgatccccgcgccacttgcccgcccccctcgcgccccgcgcctccgccaatgcccgccgcgatgagatgagatgacgccgccgcgcggcggtgctcggccaccctcgcagcccctccctcctcacgcgcgccaccatcgggatccctcctccctcccacccaccctcctccccaccagcgccgcatttattcccttcccccgcacgacagcggtcacgcttccgtcgtcccgtcctcgtcgcatccggcgctccgcctatttaaggcgcgcgggctgagaaccagcgataatgctcttcgccaggaggcccctctccgccgcactccacctcgcgcccctctcgccccccttgctcctcttcttcgcgtccgcgtcgtcctcgtgctcgcccgccgccgcgtcggcctccggcggcaccagaggttgcagtgctgtaaggatggacagcggtgcagtggagacaacgtcaactggggcagtatggtcaacaccttcggcagaaccaagaagcgtttctatcgggaaggcgatattctgcaataggtcactcaacatgaggaacatcacagcagtgggatttgatatggactacactcttgcacagtacaagcctgagaccttcgaggcccttgcttactatggtacaattgagaagcttgtgaaggatctgcactaccctgaagagctgttgacttgggagtttgattggaaatacatggtcagagggctagttcttgacaagaagagaggaaatatcttgaagatggatcggcacaagtatgtaaaagttgcataccatggttttagggaactgtcgaaagaagaaaaagttgctgcttatgggagtacattgataagagattcatttgatgaacctgattatgccctgatagatacgcttttctcattgggtgaagcttatctatttgctcagcttgttgattttatggacaataatcctggaaaagtacctgccggcacagactacccgcttatgtataaagatgtgaggtctgcagttgacttgtgtcatcgtgatggaactttaaagcggatggttgcgaaggaacctggcaggtacatcaatgaggacttggcaattgtaccaatgcttgaaatgataaaaaaatctggacgctcaacattcttagtgacaaatagtttgtgggactacaccgatgttgtcatgaactacctttgtggagcatacacttcagatgcaggatctggtctcaaccacaagtggcttcaatattttgatattgtaataactggcagttcgaagccaagtttcttccacgatgataaccgtgcgggcctctttgaagttgagcctgattctggaaaacttctaaatgctgatattcagattggaagcccaagatcaagtcatcagcatgcaacaccagttcacaaagtttaccagggaggcaatgtcggtcatcttcacagattactttctattgcttctagttcacagattctctatgttggtgatcacatatatggagatattctgcgcagcaagaaagttctgggctggcggactatgctggtgattccagaactggagcatgaggtgaagcttctttcagaatcgaagtcgacacggaaggagcttagacatcttagaatggaacgtgattcaattgaagacagaatccatcatcttgaatggtctctcaaatttgatgatatcacggaaaatcagaaggaaaagttgttctctgaacatgttgatctgctgcaacagcgagagcatgttcgccgccttcatcaagaggctcagaggcaacatcatcagaagtttcataaggtgtggggacagctcatgaagactggttaccaaaattcccgatttgctcatcaggtcgagagatttgcatgcctgtacagcagccaggttacaaacttcggtttgtattcccccaacaagtactatcgtccgagcgaagattacatgccccatgagttcgatgtgcttgggctgtaggagcaatccctgccgatgctcagagctccccgttgtaactgaaccagagcaggataggagggtgatttgagttgcggcattgattaacatgtgtacttggcatatttatcgagtgaaagcttcaccattggacatgttatggatatgggaggtaaagggtggtggtttaaatagcagctatagtttctcatagagcagcaattttacctgtatatttttgtacataacaagttttaagcagaagcaaaggaaagcaacgccgatcatgtcttgggtacacattgtgaattcagctttttgttaagtgttccaatcacaaccattgtgtagtgcagcgtgcttgtcaggctga

SEQ ID NO: 108 - DNA, 1482 bp, Setaria italica
ctcctttaaagtccccgcgccgcagcggaagccatccatccccggctctcacctcaaatcccagccacggtgatgacgacgaccatgatgaggctgaggcagcacctggcctcctcccctatttatacctccgccatcgccaggatcggcaacagcagagccccccaccgcctactccccgtcgcaccaccgcaaaagcaccgcccgacaagtaccaccaacaagcccctgctcctgattcttctgctactctgcttcttcttcctcttcttgatcccgaccgtcttgttgcccccagcgcgagtcatgtcgtcgtcttcctccgcttcggatgccgctgccgccgccgtgccgttcgagaagcccagggccgtggtcaagaagctcctcgccgagtcgcagcccgaggggcagggcgccaccgtccggaggagcatcggcaggcatgagctcaggaacctggaccccttcctcatgctcgacgagttctcagtctccaagcccgccgggttccccgaccatccccacagaggattcgagaccgtcacctacatgctcgagggagccttcacccaccaggactttgcgggccacaagggcaccatcagggcaggggatgtccagtggatgactgccggccggggcatcgtgcactcggagatgccggcgggggacggggtgcagaagggcctgcagctctggatcaacctctcctccaaggacaagatgatcgagccccggtaccaggagctccagagcaaggacatcagccgcgccgagaaggacggcgtcgaggtccggatcatcgccggcgaggccttcggcgtgcgctccccggtctacacgcgcaccccgaccatgtacatggacttcaccatgcgcccgggctcccagctccaccagcccgtcccggagggctggaacgccttcgtctacatcattgacggcgagggcgtcttcggtcgggagaagtcggcacccgtgtcggcgcaccactgcattgtcctgggcgacggcgacgggatcagcgtctggaacaagtccggcgcgccgctgcggttcgcgctggtggccgggcagccgctgggcgagccggtggtgcagcacgggccgttcgtcatgaactcccgcgccgagatccagcaggccatggaggactactactacggcaagaacgggttcgagagggccagccagtggagctcctccgcctgatcatcgatcacccgcttctgaattctgatgcatgcattttcttgagaaattgacatggaaaaaaaggaaattgctgtcctgcatacctggatgggaaaagactaaagagtagtagaccattagtagatactctgatcttgattatgatttttaaatttttttaatgattgtattgtagaagcatgtgcttgtcatttgtatggtgatttgtaataagcaggatggcaaattccactgttcatcatagtcaaggtacgcaatccaagt

SEQ ID NO: 109 - DNA, 1211 bp, Setaria italica
gcggccgcctgcaggaaactggccgtcggagcgcagacctttgcctgaacctgagaatctcgtttcaaaccgtccaatccccaaatctgccctcccaaccctcagaactcgccgccggcgacacctccggcgatctcccccctcttcccttctttccgcctcaaacccctcccgagcccaacaccgcccaaccatgcagcgaaagaacttccgcaagcggagcttcgagccggacgccgacgaccgctccgacgacgaggacacccgccgcgtcgtcctggaggagatcaagtacatgcagaagctccgggagaggaagctgggcatccccgccgaccccgccgccgcctccaccaacgggtcagccgcccgcggactggtgggtggagggggagcggctatcggcgaggccgagaaggaggacctcgtcctccaggacaccttcgcgcaggagactgccgtcaccatcgaggaccccaacatgctgaggtatgtggagaccgagctggcgaagaagaggggtaagacagttgatgtgggacacaaggaagagatggaccatgtggacgagctctacaccgtgccagaccacctcaaggtgaagaagaagaactcggaggagagctcgacacagtggactacgggcattgctgaagttcagctgcctattgagtacaaattaagaaacattgaagaaactgaggcagctaaaaagatgctgcaagagaaaagacttgcggctaaaccaaaatcagattcaaatattccatcaagttacagtgctgattatttccatcgtggcaaagaatatgatgagaaattgcggagagagaatcctgggctgtacaaagataaagattctcggcctaatgaaagtgcaggaggtaaagcaacagatactaaaaatacagctggtgccggtgcaggacggagagaggctgctagtgatgatatcatgcttgagcgattccgcaggcgtgaaaaaattcgtgtcatgcgaaggtagccagagctgtcagattgctaccgttgcctttgaagatcaaatatgtgatcacatgaagacctcagtattcctgtcctttttagcgagaattttactgtaaagctgcatccttggttcttggctacttttgcagctactaagggcaaggagcagattaaatccttatcgcagaggtgatttggggcaatagattttggggagagtt

SEQ ID NO: 110 - DNA, 1627 bp, Setaria italica
gtagcccggaggtggagggtgggcttggtctggtgcatggccattccttctctactgccttagacaacagctggaggaagataacatcttctccacacaccagaatagatatagcctcttcttcctcctcgttttcttcgttcttctttttcttcgtttctttcttcttcttgatctctaaagccgccatcgatcaatcctagcatccttgctgtttttcttccccaaggatcttgctagcttcctcttgcagatttcactcaaaactaatacaagttctttcaacttttaaccttctcagcagttctccttttaacttcctttgcccttcagcaatcccaacgaaaacccgtctttcctgagcaaaatagcgcagagagacctaaaaacctttcctcctagatcaacaagatggaaaacgttctcctggatcgatcgtctggaagctttgagttcccgaagaggtccctcggccgcagccggcgggggctcgccgcgaggccggcggcgccgggcggggcgtacagctccttcccgacgtaccagccgccatacagtggcgcgtggacctccgctccagcgcttccgtacgcgaggcctccgatatactcgtcgccatctctgcctctcctaccgtccaaccaaccgccgctgctgccgctcccacccaccgctaccaagtacgctactttcccctgcctaccggcggcagctccgcctccatcaccaccgccggcgccacgcgcggcgggcaggggtagcgcaggggtaactaccgcggttccagcagcagcagctccagcacctgcgcggcgcgagagggacaggaggaggaggccggcaaggccgccgccgccgccgtcgacggcggaggcgcccagggcgcagaagaagaagccactggagcgggccacgcctctgccgccggcgccggtggtgacggaggcgctggacgacctcgagcgggaggtggccaggaacttcgtccaggacctgctgcacgcactggcaccgccaccgagcagcctgccgctgcccaggttctccctcgtcgcgaaagcgtcccctgccacgagccccagggtggtggcgccggccgcgccgtcctgcaacgtggaggctgccgccgccgacggcatccacggcctcctccgcctgtaggagaaggcttcgctctccgccgtgtttggtattctataatatttccctccaatattatttttttggttgggaaaattaaatgcgtactataaaggtagaaaaatattgggagaaaagatgtgatgctcgagccatggtcggtcgagttgtccgtagtgtgactgtgatggtggcgttggatggatgctatctctggcggtgcaaaagcgagaggaagaagacgatgtcagctaaggttttattagtttgtgtgagacgtcgtgtggtagatatctagggttttacgtgatgtctaccgacgtaagtacgtaactgtgtgcgtagttctgctttcttgattgggtgatgggtttttgaattaccttgtatcaagagattactacatatatatggtgtatgcaagcgtgactttacttatatacaaaaaatgtgttcttgataaagtattgaagtgttgaaatattgt

SEQ ID NO: 111 - DNA, 950 bp, Setaria italica
ctctgtttttctcaaactcctttgccgccgccgccgccagtctcgctctccggcgaagggtgtttacccaggggaccatggaggagtacggagggggagacctcctgaccgaggcgatgggctccgcggcgcggttggtggtagtagaggactgcgtggaggcgccgggggccttcgtcctccacctcctcctcaagcgcgcgctcgccggcggcggggcggctgccttcctcgccctcgcgcagcctttcacccattacgaccgaatcctgcgcaagatgggatgtaacctttccctgcataggaggaacgagaggcttcatttctttgaattgcaagcattcccaggtggagctagggatggcgccattgctgatagctttgttcgactgtacagtgaaattcaaagagtggcggaggcaaccaggagtggagaaaatgcaggccaattcaccatcgtgatagacgatgtttcactgttggaagttgcggcccatggttccatagacaatgtgctggacttcttgcattattgtgtgactcttacatctgagatgaattgctcgctggtgatcctcgtccacgaggatatatatgcaggcgaggagaacaatggtcttcttttacatttgcgccacattgcagatcttgtggttaaagcagcacctttgagcacaggcttggctgctgatgttcatggacagctttcggtggtcaacaagggtacattcagcgagcaaagggcaaaagcgcagaaggtttggaatttccattttaaagtgaaggaaaatggtgcggacttcttttatccagggagcagacattagggagtactttgtaatactggcagagatgacttttgttgtgataactggtgttgctatgctttgcatgacatctgctaacctacgtagtatttcagtaaagtttcgtcgaatcctttccttcac

SEQ ID NO: 112 - DNA, 1655 bp, Zea mays
ggccgcatcctctccccccgcggccgagctccacccccacccacccacacgcacacactttgccggcggcgagcaccaccaggacagcaggtgttccctcctcttggttttcccttcatgcggtgcgactgggtctaacccttctggaatcatctccgattcggggggttttagacgatatctgggcgggatacaaggtttttggatggaattccggggatctctgtcgacccatatgtttagtggttggggaattggggaaagcggtagaaaggtgtgatgttttagtcctttttggttgaagcggagcttgagtctttgagaagccatttgggcgtaattcttctttcgttgattggggtcggccttgtgtgcaggttacgcagatgtttctttttagagttattgcatctcctcagttgtagtttatctcggttgtgtatccacgagtgctgtgtacaccaattcctgtagaaaagatgggtgaacatgttttcattgttcaagaatgttgttatatgtttttaaatcatgtaagacatgttttagttttaccatggggtctcgagaacaatattgtttatttcctcattctgttttgaagccgtcggaattatgcttgtaatcattgctgaagtttttgtgaacatatattttttttcaatcgattttgctcgagccagtatcttttattgcaacaccatgaactcccatggtgctggttcgcattcacggcttttggacctcaactatccccctgctgaaggggctggtgagggggcttcacgtttcagcagtatccctgtctctcatagagagggttcaagcagcatgcctgtacaacacatccaggcttcgagtagtacaccaccggctactggtgagcctcgcattggtatgcgtagttgccccatcgatgtggaagccatcgatgatgatgccgttatctattcttcaagaccactgcctcgagcaagacagcagttgaccacgacagaaagtattactatcataatagatgatgattccgaaacaaacctagaaacagcaggcgatgctcttgacgagcatgtgaacttactgctatctctgggcatagaacgctcgcatgagcctacaagtgcaaccaacaccttccctggaataagcatggtggacacaccaaaagtaaacaccttcaagtggatccaggtgcctcctgaacctgtgaaggaggttccgaaggaaccgaagctcagctgcccgatctgtatgaacgagataaccgaagcggcgtcgaccgtatgcggtcacattttctgccagccgtgcatcaaggctgccattaaggcccagaagaagtgccctacctgccggaggaagctcactccaagacagcaacaccgggtgtacctcccatcgccttagtagcccagtgcagagtcattttgctacaagttctgccgtgccgggggctgtatgttggaggcaactggggggggggggggggggagcatagaggtcctgtttggttcgttcatttagtgtcataatcagttaacagggtaatctattaccattgctttatgtttggttagactatactgtaaacgattgcagtgggatgcaataccagccaatacaaaattattgccgctgctttttgactgttagcc

SEQ ID NO: 113 - DNA, 781 bp, Zea mays
accgtgtgatagctgctgctcttggcctgctacgacctcacggccacctctgtcctgtcccactagactagctgcagctagcgcctcttcccctcgccgccgccccctatccgagagcgacgagcatggcgcactccctcgccgcctccttctcgccggccgccgcgcggcgccaggtgacaaatgtgatttcaagccggagctcggtttccttccagagccacaggatgacttctgtatccatccgttcaagaccaagttctcttcgtttcaagatttgctgttcggctaagaaggagacagtcgacaaggtctgtagtatagtgaaggagcagctggctcttcccgatgggactgctatcactggcgaatcaaaattcgccgaacttggtgctgattcactggatacggttgagattgtgatgggcctcgaggaggcgttcaacataaccgtcgacgaaacaagcgcacaggacatcgcgacggtgcaggacgctgcagacctcatcgagaaactcatgctggaagcgcctccaaaggttgtctagatcgatccatcagtcttgcgattggcgacttggcgttttatgttaaattgttcatgttacccaatttgttctttattgatggttcaagataagatttttgtatggatgttgctgaggtataaattagatgctccaaaggctgcatggagcagatgaagacgatgtattccacttcccatttgcatgttgtacttccatagagagatcaatgaactgttatgaagagtcactgc

SEQ ID NO: 114 - DNA, 755 bp, Zea mays
caaactcggtaaaccattcccctccgccccacctcttgtccagtgccccaaatgctggcgaccacctgcagccggccgccgtgcccgtgcccgtgcgcgcggtcgcggcggctccccgcggcgaccttcggcggcaccagtagcgcgaagcgaagggcgccgaggagagcggcggcggcggtgcggtgcgggctgctgcccgtggacccgtgggcgccgacgatggactcccagagcgtggcgtcgcagctcttcgccgtctcgctcttcccctacctgggattcctctacttcatgaccaggtccaagaccgcgcccgggctcacgctcttcggtttctacttcctcctcgtcttcgtcggcgccaccatacctgctgggatttacgcaaaagttcattatggtacctcactgtccaacgttgactggctgcacgggggcgctgaatcgctgctgactctcaccaacctgtttatcgttttggggctgaggggagccctgaggaagctggaggaagagggcacagacgagattgtttctgaagcttctcaagacagtgcagaaaaaagttctgtctagatgggttcatcatcagtacccctgaaggtgcacgagtgcgctgtttttcttcttctgcagctcaactagctcgtagtgatgttttgggtgtaaggaaatctggcagatctactctgtgcatactatgctgataagaaaacaatgtacaggcatctcctgcaattctgagtagtaac

SEQ ID NO: 115 - DNA, 3603 bp, Zea mays
aaaaccaaaccaaaaaccgatggaatgaaaagtcgtattccattcagtttttgtctactaactagggtttgccgcggatccggtccctcctccactaacataagtcgccatccccgccgctgcagttcgagctccgaccggtcccacgccggatctacccggtgtcgtcctcgactttcgccgttagtcccctcaaggaaaggaaagaaggagagggatgacgtggttccgcgccgcatcgggtgccgcccgcctcgccctccgccgcagcctcgccacccgcacgccgccagccgccgccacccgatgcggccgctgcttccactccaccgctatgcgtccccgctccgccgcccccgtgccccgggccgtcccgctctcgcgcctctctgacagcttcctcgacggtaccagcagcgtctacctcgaggagctccagcggacctgggaggctgacccttcctccgtcgacgagtcatgggacaacttcttccgcaacttcgtcgcccaggcctctccttccgccggcgtctccggccagaccatccaggagagcatgcagctcctcctcctcgtcagggcctaccaagtcaacggccacatgatggccaagctcgaccccctgggcctcgacgacagagccgtccccgaagatctccgcctcggcctctacggcttcacagaggccgacctcgatagggagttcttcctcggcgtctggaggatgtccggttttctctccgagaaccgccccgtgctcacactccgtgagatcctcaacaagctccagcaggcatactgtggacccatcggctacgagtacatgcacatccctgatagagacaagtgcaactggctcagggaaaagatcgagactgccaagcccaaggaatataacaaggaccgccgccttgtcatgcttgacaggcttatctggagcacccagtttgagaatttcctagccaccaagtgggccaccgccaagaggtttggccttgagggtggtgagacgctcatccctggcatgaaggagatgttcgatagggctgctgacctcggtgttgagaacattgtcatcggtatgccgcataggggaaggctcaatgtccttggtaatgtcgttcgcaagccactgtctcagatattcagcgagttcactggcggcacaaggcctgttgaaggcgaagatggtctctacaccggaactggtgatgtcaagtaccacctgggtacctcctatgatcgcccaactcgaggcggcaacaggatccatttgtccttggttgccaatcccagccatctggaagccgttgatcctgttgtcattggcaagacgcgtgctaagcagttctactccaatgatgctgacaggacaaagaacatgggtattctgatccacggagatggcagctttgctggccagggtgtggtctatgagacactccatctaagtgccctcccaaactacactactggtggaaccattcatattgttgtcaataaccaagttgcctttacgactgatccaagagctggcaggtcctcccagtactgcacagatgttgccaaagccctgaatgctcctatattccatgtaaatggcgacgatttagaggctgttgtttgtgtttgtgagcttgcagcggagtggcgccagactttccactccgatgtggtggttgatctgatttgctaccgccgtttcgggcataacgaaattgatgaaccttccttcacacagccaaaaatgtatcaggtcattaagaaccatcccagctcattgaagctttatgagcagaaactgctaggaacgggtgaagtcatgaaagaagatgtccagaggatccatgacaaggtgaaccgaatcttgaacgaagagtttgctaagagcaaagactacgttcccaacaagagggattggctctcagcttactggactggctttaagtcaccagagcaaatatcacgtgttcgcaacactggggtgaagcctgaaatactgaaacgtgtaggtcaggcaattactacactgcctgaaaacttcaaaccacacagagcagtgaagaagatttttgagctgcgtgcagctatgatagagagtggtcaaggaattgattgggctgttgctgaagccctggcctttgcaacacttatagtggaaggcaatcatgttaggctaagtggacaggatgtggaaagaggaactttcagccatcggcatgcagttctgcatgatcaggaaactggagcaaagtactgtccacttgaccatgttgcaatggatcaaaatgaggagctatttactgttagcaacagttcactttcagagtttgctgttcttgggtttgaattgggttactccatggagaaccctaattcattggtactttgggaagcacaatttggcgattttgccaatggtgcacaagtgatgttcgaccaatttttgagcagcggcgaggcaaaatggttgcggcaaaccggccttgttgttctgttgcctcatggttatgatggccaaggtcctgagcattctagtgcccgcttggagcgcttccttcagatgagtgatgataatccttttgtcatacctgagatggaaccaacacttcgcaagcagatacaagagtgtaactggcaagttgtgaatgtgacaactcctgcaaattattttcatctgttgcgtcggcagatacatagggagttccggaagccgctgattgtaacagctcctaagaacctgcttaggcacaaggattgcaagtcaaatctttcagagtttgatgatgttgaaggccatctaggattcgataagcagggaacacgtttcaagcgactgataaaggaccgtaatgatcacaagcaagtcgaggagggtgtcaaccgtcttatcttatgttctgggaaagtttactatgaacttgacgaagagcgtaagaagtcggagcgtggcgatgttgcaatttgcagagttgagcaactttgcccgttcccctatgaccttatccaaagagagctgaagagatacccaaatgcggagattgtgtggtgccaggaggagcccatgaacatgggtgcatacagctatatctctcctcgtctgtttactgcgatgaaggctcttgggcggggttcgtttgaagacatcaagtatgttggcagagcaccttcagctgctacagcaacaggcttcctgtcggttcatgcgcaggagcagtcagagctagtgaagaaggcactgcaggcagagccgatcaaattcctctgatgtatgcaccgtatctacagcaacaacctgcctgcatggttgcaggaacatgccagggattttcttttccccggccagttttgaggcttttcagcgttggaactaatgacgacttccttccttgaagacatcatattaattgccctaatcagctatctagtagttaattataaactacgtgcgaacagaccctggtttagctggcagttcaatttgagacctgggttcaaaaaaaaaaatctctgagtcgggtttaaggcagccagacaacacaggagttcagcttctgacccataataaaactatttatatttaataaaactatatttaacaaa

SEQ ID NO: 116 - DNA, 1088 bp, Zea mays
actggtgcggcgcggagcgaggacgacgtcaccttctccaccccccgcccctgcccctgtgtgggagtaggtgtagccgcgtaagcggcagcggcgtaggcctcagctcggctcagctgccgcctcgctcgaaccagaggagccaagcagaggaagcgaggcggagatgtcggcggggctggtgaccgacgaggccaccgtggggcggctgtaccggatccggcgcacggtgatgcagatgctgcgtgaccgtggctacctggtggtggaccacgagctcgccaccagccgccgcgacttcctccgcaagttcggcgagtccttccaccgcgaggacctcctcatcaacaagtacaagaagaacgacccatccgaccagatatatgtcttcttccccaacgatgacaaggtagggatgaagcacatcaagaagtacgtcgaaatgatgacgcacgagaacgtctccagagctgtgctggttctccagcagaacctaactccgtttgcgaagtcgtttctcatagagctggagccgaagatccatctggaaattttccaggaggccgagatgcttataaacatcaaggaacatgtccttgttcctgagcatcaggtgctcacaaacgaggagaagaagacgcttctggagcggtacaccttgaaggaaactcagcttccaagaatacagatcacggatcctattgctaggtactacggcctgaggcgaggccaggtcgtgaagatcatcaggcccagcgagacggcgggcagatacgttacataccggtacgttgtatgacagaacgtcagaacactgaagaagaagagaaccacagatatgtcaaaaaaaattcaagctacacataccccacgtgcttgcagacatctgtatcgctttgtagcagcagccactggtaacgatctgtggctgatgtgtaagtgtaagtggattgaataagctgagtcagagcatacgagaattctcatgttgtacacttgtgttttatgaaccgcataaacactcacgacgataaaagaagcctgtttttcggagcgacagaagctcctgcgatcaggatttcggattt

SEQ ID NO: 117 - DNA, 1313 bp, Zea mays
gggagagccagagaggagggagaagaaaatggtcgcggcggcggcggaggtgtcgacggcggcgacggctagcagtagccccccggcggaggagggggagcggcgggacgagagcgagagcgacggggagatggcggggctggcggccgtgctggacttcgacatgctgtgcgcgtccgtggcgctgtcggcggagaggaggaaggccggcgcggcgctggcgggcgcggccggcgactgcggcggtggaggcggaggggtgcagaggatgtgggagggcgacgtcgtgctggattgcctagacgaccggcgaatcgcgctcgagacgtcctgctgcccatgctaccggtttggtaagaacatgcggagagccaatctcggatcttgcttccttcagggaatggtttactgcattctgttggctgctgtcctaatcagcctaattgccttttctgtaacaaggcatcatatatatttatatatgggaatcggctctgtcctcttgatagccatctatactggttatttccggagaagaatcaggaagcaattcaacattcggggtactgagagcagtctggacgattgtgttctccatctcatatgtccttgctgtacgctgtgccaggaggctagaactttggagatgaataatgtccagtgtggtgtctggcatggccgaggtgataccatttgtttagggagcaacggtgcaggaaacaaggctttcgctgccctgaacaaggcctctctcgtgcctgtaaagtccccggggctgtgtggcatggatagatcgtcaagcgcagccgacgagcagcagccgcttgtcccaccggaccaactggagcaggtttaggtattctctgtcgccacgacctctgcactttcctagaagggcttggacagcgccgacggaaaaaaaaaatcgtcctctgccggattattaggcgcctgcatctgcatccattggtcccgagaactggactttgcagctaccgtacatgggtgatgggcgcagtcgacctgctgctggctgctgctgttgtaaaattcagtgatagattttctcttgcagtcgaattgtttaggtcgaagactgtatcttcataatgtcacgacacgtgctcaggccttttgcctgaatccaactgtaaatttcagatccaatctagcagttcgagttacatagacaggaatgagatggtaatgttcttttcaccggccgtgcttgctccctgtatctttcatacgctgccccttgtcgttcctgttctcaggagcttgattaacactgttttctttacgaaacgtca

SEQ ID NO: 118 - DNA, 1516 bp, Zea mays
ctcctcttcctcgaacggtcgaaccgccgaaagcacgcaccccgccgccgcgtaccctcccctcacccgctcaccatcgccggccgccgttcggcgcgacgcggattcgaatccggaaagcgggcgatgggggcgaagcgcgcggtgctggtgggcatcaattaccagggcaccaaagcggagctcaagggctgccacaacgacgtcgctcgcatgcgccggtgcctcgtcgaccgcttcggattcgacgagtccggcatccgcgtcctcatagatgacggctccgcgccgcagcccacgggggccaacatccggcgggaactcgcgcgcctcgtcggggacgcgcggcccggggacctcctcttcttccactacagcgggcacggcatacggctgcccgccgagaccgggaaggacgacgacaccggctacgacgagtgcatcgtgccctgcgacatgaaccttatcacagaccaagatttcacggagcttgcgcaaaaagtccccagtggctgtctctttaccatagtttctgattcgtgccacagtggagggctacttgacaagaccaaggagcagattgggcacagcaccaagcagaagcagaagcagacccagacccagacccagagccgggaacttgaggaacggtctccttctggcaccagcttccgggaattcctcaaaggtactgttcgggaagcgtttgagtctcaaggaattcacctgccccaccgtagccgtagccaccagcaagggagcggtcacggcgacgacggtgaccaagagtcgcgctacatcaacacagccgatgcccacgtcaaaaaccggtcgctacctctctcgacattgatcgagatgctgaaggagaagactgggaaggacgacattgatgtagggtcaatccggctaacgctttttaacctcttcaaagacgatgccagcccgaagataaagaagttcatgaaggtcatgctgaacaagttacagcaggggcagcacggaggcattgtgggcttcatgggcgctctggcacaggaggtcctgaaagccaagctcgatggcaaggaagaagaagagttcgacccggcaatgaaacagcacgtgcacagcgatcaagaggtgtacgccgggacgacggcaagggtgccgagcaacggtgtcctgatcagtgggtgccagaccgaccagacgtctgccgacgcgaccacgccgaagggggtgtcctacggtgcgctcagcaatgccatccaggccatcctcgcggagcgtgggacggtaacgaacaaggagctcgtgctgaaagcgcgcaagatgctgtcgaaacagggctacacccaacagcctgggctctactgcagcgatgagaatgccagtgcggcttttatatgctgatgatgattcattgggtttgtcctgtggattgcaatatttgtattttgtctctaagtgcatgtgagttggactggtggttatgttttttcgctgagatttgggaatgtatcgtttctttcgc

SEQ ID NO: 119 - DNA, 1664 bp, Zea mays
gatgatgtcacgttgttgatgtaaggactcctcgtccatcggttccacacagttcgctgcgattttaattcacccgcttttgctttttctgcagtcaaaacggctttaatccagcatcctaacagcctcaggattgttgaaaaaaaactaggtcttccactcttcctccactagtctactcggcagatttcactgactctcaccggcggtctttgtgcctccaccggccgccgccatgccgtacctcgtccgcgagcggctctacttcggcggcatcaaagacgccattgccgccctcacggagtcttcctccacgccggacttcacccacgtcctctccgtggtcagctccgcctccatctccttcatcaccgattgccgcccgggcctcgagatccccaccgaggaggtcctccgcgtagtcgccggcgaggagggcgcggcaccgactgccgcggttcccccggggacgctgatgcgggtggtggagcgcgccgggcacgggctgcgggtcacgcgcatggccgtgccgctgcgggacaccgaggaggcggacctgctcgaccgcctcgagccctgccttgagttcatcgatgagggcaggaaggtcgggaatgtcctcgtccattgctttgctggggtgtcgaggagcgcttccatcattgttgcttatcttatgagagcagaacagaaatctcttgaagaagcattagaagctctgaaggagatttctgagtcggcgtgcccaaacgatggttttcttgaccagctgaaattatttgaagaaatgggcttcaaagttgatacttcaagtcctttgtacaagagattccgcttgaaattattaggccaatcctacatatctggggagaaaataagcagctatatgtttgaagatgaccctggcctttctctagagtctggctcttgtcaagattcttcaaaggttgagcaacgtaaaacagcttaccgctgcaggaaatgcaggagagttattgctgtagagggcaatgttataagtcatgttcctggtgagggtgaatcttgctttgattggaaccgaagaaagagtggtcatccatacaacaacaaagaacatggttgctcatctttgtttgtcgaacctctgaaatggatgactccagtagaagacggcgctttggagggaaagctatcatgcatccactgtggagctcggttgggatacttcaactggtcaggaatacagtgcaactgtggtagctgggttactcctgccttccaaattgttaagagcaaagttgatatcagcaccatctagacctgtgagcaaacgactggcaagtttgagggacgaggagcgcgacagcagtgacgcctgacggtttaatgttttgtgtaccatatgaacgctacgtatacaggtgaagcaatagcgtattttatgtttttccattgccgatcagaagctgtgtgtgacaaataccgtataaaatttcgcatttgctgatgtaacaagtagccgtgatgtcggccatctgtttagctggaacgggagcgaatgcagattgtgcagagaaatgaacacggttgtgtttctattctttctgtggattcaaatgtgcgcccaatatgaatactcgttcgtttctttttttcaacggtgcacatgcatcttaaggttc

SEQ ID NO: 120 - DNA, 655 bp, Zea mays
gtctagggttttaccctctccaacacgacgaggttttgctccgacaccgacgcgacagccgacaaggcagggggagaggccgagaggggaaatggcatcgttgtcccgcaccgctgctgccgctgtcgtggccctgaggtcggcggtccgctccgcgccccttaccggccgcgtcctcggagcgccactaccttcctttgcctcgccttccgctacccgctccgcccggatcctccgcaggtcggcggccgcggcgtcggcggggctggaaacgctaatgccgctgcacagcgcggtggctgccgcgcggcttaggtcctgcatcgccgtcgactcctcctgctggtgctcgctctcacaaggtttaaacaagcgcatctgaccatggctaggagctgagcagaagagaagatatgctttgcctttatgacagcgaggcgagctgcacctgaagaaacaaaagaatcttaggaattacaaacaagggctgtactgtaataatgtggttcttgtaaaccaattttgccttagaattctgtaacttgaatcatccacagatgtgcgactgtcttttgtttatgtggatctatgaattacctgccgctcctcgtttgaactacttgcaattccattatagcatcatttgaaaatggca

SEQ ID NO: 121 - DNA, 1720 bp, Zea mays
gaaactgaaaactagcggcggccggagaaagagagctgcgttgcgccgctggtctccatccatcgatttgttttgttggcttcttcgcatgtgattccgccagtaggagtgttgcttatctacccctcctcctcggctcctccacaacgtccagatcatcagagccagagggtaaaacggaatagtctattcccagtagtgataaacaaaacaaagaatcttctctgtcttcgtgcggtgtgcctgccatttccaggcccagctgttcattctcgaggctccttctcttgtagttcgtcgtccttgcgcagcagatcgagaggctgaggggagagggatccatggagctgggaaagcccctttcggcgcacagatgtagctacaccgctacctacacccactgttccataggcttctcccctcgggtcgtccgtaccagctggatccgcgcggcggctgagggcggcgacggcggggcagaccggcgacggagaggtgccagcttcgccgccgatgggcccagggtcgtcgaggtcgccgctgccccggtggctactagcggaggcgccgccggagcagccgggagcgcggggttcggagcacgggacgcggaactcgccatgtgggacaagctcggggcggtcgtcaggctcagctatggcattgggatctacggggccatggcactcgccgggagattcatatgccaaatggccgggatagactgcacggggggcttccatccgtctctcacggcactcgtcgagggtcttggctatgcagctccaccaatcatggctctgctcttcatcctcgatgatgaagttgtcaagtattcgcctcacgcgcgtgccatccgtgatgtggaggatgaggagcttcgcagcttcttctgtggcatgtcaccatggcagttcatcctcatcgtggctgctagctcaattggcgaggagctgttctaccgcgccgccattcagggagcattggccgatattttcctgagaagcacggagctaatgaaggatgctcgagggattgcatcactgagtggtatcgttcctcctctggttccattcgctcagacgttcgcggcagtcatcactgcagccctcacaggaaccctctactacgtcgccacaactccgaaagaccctacgtatgtggtgacaccagcgatgcgttcgcgcacagggcgtgagaacctcaagaaactatttgcagcttggtacgagaggaggcaaatgaggaagatatactcgccgcttctggaaggaatcttggctttctaccttggcttcgaatggatccagaccgacaatatcctggcacctatgatcacccacggcatatactccaccgttgttcttggccatgggctctggaagatccacgaccaccggagaaggctacggcagcggattcagaaggtcaggagtgaagggagtagctctgcagacgacacattgtaactgcagcatatgtagatcggcgtggtctactgctggatagctagctgctgattgcacgcacgtactgggtgatcgatcgatctaccgatcagtcagaagaccagaggcgtacgtctcacaagttttgatctacttaattaatatcaacaaggtaggtataagattgggcaaaaatatatatataatgcatgtagtcatgtaatgtagatacaatgtgtacatatatggataaatatatgcaggctgtaatc

SEQ ID NO: 122 - DNA, 2321 bp, Zea mays
tgacactcggctgttccattcgtgatcccatcacaccagccgccgtcttctccctcactccgccacgccactaaaaccctaatccctcgccgccatggctgcggcggcggccgccacctcgctcctcatacgccacaaccgcaacccccacctcctcctcctccgcgccgcgatctcctcctcccgcgcactgtcccagcagccggagctgtctcctgacccgaccaccggcgcccccgaccccgccggcgccgccccactccccccaaaccccagcacggggagccccttatacagccagaactggcgcaaccccgccgcagccaacccgccctcttcgcttctgcccaccgtcgccgccggcagctccttcggagcgcagcaccgcatggccgccttctacgataagcccgacgccgcggggctcaaggaaacgtttgccaagtatatggcggagcagcggtgggaggacatgaagcttctgttcgaccactgggtgcgctccctcgacgccgccacggggaagcccaaccaccccgacgtcgacctattcaatcactacctccgcgccaacctcatgacgggtgccgtaccgcacgagatgctcgatctcgccgatcacatgcgcgagttcgagctcgagcccaacagtgcatcgtacaacctcgtgctcaagagcatggtcgccgataaggagtcctacggcgccgagaagctcattgaacggatgctgcaaacaggaacagttccagatgaagaatcctacaatttggttgtaggcctgcttattagacagaaccttgttgactcatctctgaagtatttggatctgatgcttaaatcgggctacacgccatcactaactgttttcactgattatatccaagcatgtgtcagatctgggaggttggacacgttgacatcaattatacagaaatgcaagacagctgataagatcaaagttttgtgtccacaatgggcctggtgcattgacatatcagaagctgcatttgaagctaacaatagcaaattagctctttttgctctggaatttcttgcaagatggattgttcgtggtgagaatgttaaacctcctgttcagctgtcagttaatgaaggtcttgtaatatcagctctgagtgctgctggcagaacttttagtactgacctcttgaatgctgcttggtcgctactacggaagtccctgcgccagaaaagggcacccaccccagagacatatcttgccaagatctatgctcattcatcaattggccagcttcaaagggcttttggtacattgcatgaatttgaaaatgcctatgggaactccaaggacgttgatttagagctcttctcaccatttacgtccttgcatcctcttgttgttgcttgctgcaaagatggctttagcacattggatttggtgtatgttcagttggagaatctgagtcatgcagatccaccttacaaatctgttgcggctctcaactgtgttatattagggtgtgcaaacatttgggacattaatcgagcttatgaaacttttgtggctattaaggaaaaatttgaactcagtcctgacatccattcatacaatgcccttctgtgtgcatttgggaagttgaaacagacaggagaagcatgtaatgtgttccagcatgtattaactcttggtgttaagccaaatgcaacaacatactcccggcttgtcgatgcccatcttgcaaacaaagatccaaaagctgctcttgccataattgatgagatggttgatgctggcttcactccttccaaggataccctcaggaaggttcgaagacggtgctctcgtgagtcagactttgacagtgacgagaaagtccaatccctggctaagcagttcaactaccgaatgggtggtgagaatcgaagagagatgctttatagcatagaatacaatcctgtgtactgaagcggcagtttctactgagtttgctggtcgttgggagagcacggacattgtagcttgtaaattacttgaacgcaccaggattcttaagcaatattcagtttctcaatcattatttttgctcgcagggttgatgttaggacttgctaataagctgcatactatttgtttgcttgagaatccgaaaatgtcagttctttttcataaattgtagcatctgcgtggccccacttcttacgtgactcctaggtgttttcggctttgtttacacttgtaactaacgaagaagtcctgggatgactgggtcgcagcttcttcaaaagatgctattcttattatggaaatttaatggagactgacaatttaaagtcac

SEQ ID NO: 123 - DNA, 1027 bp, Zea mays
atacggcatgaaattgctatactagatttgcaggcagttgagccgaacggaaagaaccaaaaaataaccagacaatgagcttaacgcttctccagggctactcctccgctgaggacgacgacgatcccgccgccggcgccggcgctggcaccgagctgagcgagtctggtgattcgtcagccgaggaagccggatcggacgaagacgaggagtccgctcctccaaagccgccccccaagctccgccgccgaccaaaccctaaggggggagatgccggcggcagcgacgggggctccttgctgccctccgcgctggaggccttcgctgatgtctcgggaccaccagattttttgaggcacagggttgccgagccagaggaagggacggaggccctcggtgtactcgatcgccgtgggaaagaggggagcaaacagccgcctccaggtgctgttgtggtggcaaaaccacagatagttgctatccgcgagcgagttaccacaactggagccaaccccccaggttcagtgacagctggttctattgatggaaaaagagtaataggtgctgcaaatcctgggccagaagacgcagctgatcttctaaggatgtgtctacaatgtggtgtaccaaagacctattcacatggaaagggtatggtgtgccctcagtgtggtggtagaccgatgcagacaaaagagcccgaaaagaagaagggttccactgtcaaagacaaggagaaggtcaagaggatgagggggcaatcgtcacatgcatcatggaagagtgaaaccgagatggctcttcggcaacaattcgactgataactagttagggtgcccaatatttagatggagtactgggtaaactgtacgctgcgaaaaccttttttagctctgtgtaatgtaccatatgatgtcctttgtgcctcacactaggttccagaaagccagaaccaacgctgtgtttgtttgtatctgctgctttaatttttcagccattttgcgcttgcgttggcgcgccttttgca

SEQ ID NO: 124 - DNA, 1175 bp, Zea mays
aaggcccagatcaaaagaaaagagcagcggagcggagcatgctcttcctccggtgccagcctcgcgtcccgtccgcgtccgcgccgccttttcgtccccgcgtccgcgtcgcggctccactgggcgtgcgcgtcaccggcgggaggcgagggcaggcggtggtcgcgatggcgtccgccgacgcgcgcttggcggggattgcctcctccatccgcgtcatccccgacttccccaagccagggatcatgttccaggacatcacgacactgctgctcgaccccaaggcgttccgtgacaccatcgacctcttcgttgagcggtacaaggaccaagggatcaccgtagttgctggtgtggaagctagagggttcatttttggtcctcctatcgctctagccatcggtgctaaatttgtacctttgaggaagccgaagaagttgccaggcgaggtgatctccgaagaatattctctggaatacggaactgacaagatagagatgcatgttggagctgtacaggccaacgatcgggctcttgtagtcgatgatcttattgccaccggtggaacactctgtgcagctgtcaaacttattgaacgtgttggagcaaaggttgttgagtgtgcttgcgtcattgaattgccagaactgaagggccgagacaaacttggggacaggccagtttttgttcttgtggaagcagatgcttgagcggaacttgggacttctcttctcagagagttagagttggtgctgttgatgctacctctctgtcaacaacaaagtttcccatgttggctatattcttgctgacacgtaataaagtttcattccaaattgtgatcccctgaatgatttgtcaatgtagacatgattgctggtccttgtatactgtggcttattattcacatcaattaaggataatcctgattggagcttatcggtgcaactattggtgttatgtggggccaccactactagcgcagatcgtgcggccagaagcaacaaacgccggcagcaaaggcttaggcgctagcatgaagataagcatggctagaaagtaggagataagtattagagttgtttagataagatgataagtggcatgagtttgttagggaaccgggctatacaatgctggcaggcgattgaaaaaagtaagcaataattatttat

SEQ ID NO: 125 - DNA, 1329 bp, Zea mays
agtaacgccgcgtaagaaaaacctttcggtctaaacatttcgtcgaacgccagcggcgagtcgagctcgagctcgagccccagccaccgcagccatgctcctcacgaaaccctacctctccaactcgctccttccagtcccatccccgccgccgtcgggccctactctcagctccaaccatgcaagcccccttgccgcccctacttgccgtcgcagccgcctccgcatctccgccacatccacggctgcgccgtctccttcgtcggctgccgctgccaccgcgtcgctgagtcgagtggacgtgctctcggaggcgctcccttttattcagcgattcaaaggcaagacggtggtggtcaagtacggcggtgcggcgatgaagtccccggagctgcaggcgtccgtgatccgcgatctcgtgctgctctcctgcgtcggcctccgccccgtgcttgttcacggcggcggtccggagattaattcctggctgctgcgcgtcggcgtcgagccgcagttccgcgacggcctccgcgtcacggacgcgctcaccatggaggtcgtcgagatggtgctagtcgggaaggtcaacaaaaaccttgtttccctcatcaacatcgcgggaggcaccgccattggtctgtgcggcaaggacgcgcgccttatcaccgctcgcccgtctccaaatgcagcggcgctgggattcgtcggcgaggtttcgcgcgtggacgccaccgtcctccatcccatcatcgccgcgggccatatcccggttatcgccaccgttgccgccgacgagactgggcaagcctataacatcaatgctgatacggcggctggcgagattgccgctgccgtgggcgccgagaagctgctgttgctcacagatgtgtctggcattttggcggaccgtaatgaccctgggagcctggtgaaggtggtcgacattgctggggtgcggaagatggtggctgacgggaaggtagctggtgggatgatacccaaggtggagtgttgtgttcacgcccttgcacaaggtgtacacaccgcaagtatcattgatgggcgtgttccacactctcttctgcttgagattctcacagacgagggcacaggcaccatgatcactggctgagctgcttcatgccttcatgaaacgggctgagaagcgaagcgtttggtggccagaaaccgattctgacggccagaagccgatccaaacaggcccgatgttggattgaataatattttttgaaatgcttgatcgtgaacatcagttgtccttcaggcaaggtttttgcacattaatgagaattgtccaagttatgtgcc

SEQ ID NO: 126 - DNA, 2159 bp, Zea mays
cagtcactgttcacacaacagctgctagtagccgtagcccgtaggcgagccagaggcggcccaattcgagagcggttccggcggcgtgggcggcgccgtgcctgagatcggagccccgtggcgcggtgctggcaactggcggcgcgatgtgggcggtccacgggagggagtccacggccgctgcgcttcgcctgctgctgatcgcgatcgcctgcggcctcgtcttcgcgctcctccacctccccctcccggatgaccgtgcgcgaaccgccgaccccggtgggcagcgcggcgctgctgggggcggcggggcccgcctgtcggtgcagcaggggagggttcgagaggccagaaggctgagtgtcgtcaccgaagagacagatgggcaaactgacgaaacggcggcggaagaagatgaaaggatatctaaatctcccccagacaccaaagagaagatctggatgatgcaagatcagctaattttggccaaggcgtacttgcatttcgcttctccccaaggtagtgtacatttagttcgagagctgaaattgaagataaaagagatcgaaagggcaataagccactcaagtggaggtacccatgtacctgggagtgtgttgcaaaaaataaaggcgatggagctgaccctttcaaaggctcagaggacctacccgcattgctctcagatgacgtcaaagctacgtgcaatgatgcataatagtgaagaattggtcagagcacaccaaagtgaatcttcattccttgagcaggttgctgtgaggacattacccaaaggccatcactgcctagcaatgcagcttaccgcagaatacttttcgttagatcccactaaacgtgaattccctaaaagagacaacattcagttgggtggttattatcattatgcgatgttctctgacaatgtgcttgcaagtgctgtggttgtcaactctacaattgctgcatcaaaggatcctggaaggatattattacatattgtaactgacgcgttgaattatcctgcaatgatgatgtggtttctgacaaacccaccaactccatcagtaatccaaatccagagcctagatgatttgaaatggttgcctggtgatttcagttccagattcaagctgaagggggttcgggatccgagatacacttctgcactcaaccacttgcgtttttatttgccagaagtgtttccatctttgagcaaggttctactcttggaccatgatgtggtagtacagaatgacttgtctggattatgggacctagatatgaagggtaaggtaaccggtgctgtcgacacatgcacctcaagtgaaggtttccgccaattggatagccttattgatttttccaatccaagcgtcttcaacgaacttgacccaaaggcttgtgcatttgcatttgggatgaacatatttgacctgaacgaatggcgcaaacagggtttgagtacaacctatcatagatggtttcaactgggcaaaagtgagaagttgtggaaggcaggaagcctgccactgggtcaggtcgtcttctacaaccggacgctgcctctggaccaccggtggcatgttctagggctcggtcatgactccagcatcggaagagatgaactcgagagtgcctctgtcatccactacagtgggaaactcaaaccctggttggagatttctatcccaaagtacagaggctactggaacaggtaccttaactacgataacccgcacttgcagcagtgcaacattcacggatagaggcgatggcgggtgaggtgattcgcaaggtagaactgggatatacgcaacttcgctgtagtaacttattaggagagcaagttgttgtttttttgtttctgttgctagatgccctatttgcaattttgtttgctagtagtcacaatcggtacaaaagcaaaaaaggaagaacaaaatcgagtacacgagctacagtttcactagtgatacactgaaggtttgacagaagtcaagccactagctaacattatcaataactagtgttgcctcggacctggggaagagtgcgaattccacggagctcagttagcgtgcgttggacaagatagatgtaaagttttcgcgataatatcgttctctcttacaaagaaaggggttttactactgccattt

SEQ ID NO: 127 - DNA, 1789 bp, Zea mays
atttgcatcgcgcattcgcgccggtctggccaatctctagttctctactgcacggtgaccgatcaacgacagtcgacagttgcagtgcagccggtgagcttagatgacgcgcgtcccctaaaagcaggatctggcataaggctacgtgctggtttacagttacagctcaggcttaccatttctttaaccaattcgcttcttgttctttaaaagttcagagttcaagagttcagtttagagagagagagggggagagtgatttgccgacttgccagttgccgcacaaagctcctctagcacctctgtgtggccgacttgtccccggtatcaccaagtctgcaggcctccccagtcgtcgccggcgagggaacgcgccgcccgtgacgccgcgggttgttggcgccggcgttgaggccacaagcgcgccagcatcaggacctcacaggtgattcaatcctgaaggcatcaactatgttcaattttcaagaaatgtcttgctgttttacgtgtgcgacgggcatggaacgaaataatgaaaacgaaggaggaagcaaggtgaggattttttcctacagtgagatgaggaaagctacgcatgattttagtggagcaaacaagattggcgagggcggtttcggctccgttttcagggggaagcttaaagatggaacgatcgtcgcggtgaaagtcctttctgctaattcaaggcagggtgttcgagagttcgtaaccgaacttacagcaatttcagatatcgtgcatgaaaacctaattacattggttggttgctgtgccgaagggtcccagaggattcttgtgtacaattatctcgagaacaatagtctttcatatacacttctaggttcgggccggagcaacattcggttcaactggagagcccgtgtcaagattgctgtaggcgttgctcgtgggcttgcttatcttcacgatggaattcggccccctataattcatcgagatataaaggcgagcaacattctccttgacaaggacctcaccccaaagatctctgatttcgggctggcaaggctcctccccccaaacgcaactcatgtgagcactagggttgcaggaacaataggatacctggctcctgaatacgctgtgagggggcaagtgacgaagaaatcggatatctatagtttcggcgttttgctactggaaattgttgctggtagatgtaactacaacagtagattgcctcagggagaccagtttctgcttgagaagacatgggcatactacgtgcagggaaagctagagaaggtcatagacgccgaagcaggggaggacctgaacgtcgaggaggcatgccgtttcttgaaggttggcctactatgcgcccaagacgcgatgaagctgcgtccgaacatggccagcgtcgtcctgatgctgataggagagaagggaatctccgtggacaggatcaccaagccagccgtgatcggtgacccgtacctcgaccggaggccaagcaacgcagactctaccacgatgaagtccttcgccacgaccgaagctttaacgtcatcagaggcaaacacggagtggtctctgtgatggggggaaaaaacgtcatcatcgatggagatttgtttttgtggatgctgcagttgccaaacaaataccgcatcgcttctgttgattatgtttgtttgttatttttgtgtgtgtgtatatatacttgaaatggaaccacgggagtgaaacgaggattgaatatgctttacccatctttggtacaagtagaatcgtttgtgtttctatc

SEQ ID NO: 128 - DNA, 1455 bp, Zea mays
accaaccacgcacgccagcccgctccagcctccaacccattcttcggcggttcggcccggcctgcaccctgcagccaccaagcaaacccagtgctctgctttctgcattcccccccgccgccactccgtcgggcttgatgagcctctgctccaagctcttcgcgttgctccgcaagtcccgcgccctcgccaccagcaccgccgccgcagccgccgcgacaacctccgcgacggcgtcggccaacgggatggaggaggctgtcgccgcggcgggcccgctgcgcacgcgcgtctgcatcatcggcagcggcccagccgcgcacacggcggccgtctacgccgcgcgcgccgagctcaagcccgtcctcttcgagggctggctcgccaacgacatcgccgcgggtggacagctcaccaccaccaccgacgtcgagaacttcccgggcttccccgacggcatcctcggcgccgacctcatggatcgctgccgcgcgcagtcgctcaggttcgggaccaagatcctcaccgagaccgtcaccaccgtggacttctccgcccgccccttccgtgtcgcctccgacgacaccgttgtgcacgccgactccgtcgtcgtcgccacgggcgccgtcgcgcgcaggctgcacttcgccggctccgacgccttctggaaccggggcatctccgcctgcgccgtctgcgacggggctgcgcctatcttccggaacaagcccatcgccgtcgtcggaggcggggactccgccatggaggaggctaacttcctcaccaagtacggctcgcaagtttacatcatccaccgccgcagcgacttccgggcgtccaagatcatgcaggcgcgcacgctctccaaccccaagatcaaggtcgtctggaactccgaggtcgtcgaggcctacggcggtgcggatggcggcccgctagccggcgtcaaggtcaaggacgtcgtcaccggcgaggtctctgatctccaggtggccgggctcttctttgccatcggtcacgagccggcgacaaaatttcttggagggcagctcgagctcgactctgatgggtatgtggtgaccaagcccggttccacgcacaccagtgtgcagggggtctttgcagctggggatgtccaggacaagaagtaccgccaggccattactgcagctggatcaggttgcatggctgctctggatgcagagcactacctgcaggaggttggagcacaggaagggaagaccgattgactatgtctgggccaagctgctcttgggccaaggaaaacttctccgaaagccgctctctagtggtgtaaacagcacattattatttggttttaggcctcaaattacgttacattggaaattgatttatatgagcgtgcgcaagcttgtatacattattcgcattgtttattactcttagagtcttagtcattaatcacactttgct

SEQ ID NO: 129 - DNA, 942 bp, Zea mays
gacttggcccggcccatccagtagaagactagaagaggacggtgggaaagaggggtccaagaagcagggcacggcaccagacgcgtccatggaccccaccggcgtcgacggcgattccgcggcggcgagggggagcggaggcggaggcggaggggggacaggggccggccggtgggcggttggcgcggtgtgtggggggctggtctactaccactgcgcggtacggcgagccagcgcggtgtcccttgcagcagacgtgctcctcgtcctcctctgctcgctctccatcctcggcctcctcttccgccacctccacatctcggtgcctgtggatcctcttgaatggcagatctctcaggagatggcaaatagcatagttgcatctttagccaatacagtaggagctgctgagtctgtattaagggtggctgcaactggacatgacaagaagctgtttttcaaggtggtttctacattgtattttctagcagctttgggaagggtggtgtcaggcgctgccgttgcgtatgctgccctatgcatcttctgcctctacatgtttgcacaaagcaccgatctgtttgatcagctcccttcttgggtccctgtgggtagggattctttgggcggtactcaggataccgcgtgattttccacatgtacatggattgcagagtttttcttctcttccactgtctgtatatggtcttgcaggctaatagcttgaactatagcatctatctctgcccccacggtattacaactgtacccagtgtttagcaatggagtaatgatctttgtatatatatatgacacgtttgcaacttgccagatgccagtgatgcatcctgtatgttttcggagctcattgcagatctctctggcttgacatggttgttggtcgtgagattttgtgatggtgtgttttgcctgtaatctaaa

SEQ ID NO: 130 - DNA, 1730 bp, Zea mays
ttctcgctgtggtcaccacgcttcacatctcgcgcggtagcgtccgacaggcatggccgcctcctccctgctccggtcgttcacccgccgcagctgcgcgggcccgagcgctttcgcttaccgccaccaccaacgacagcaaccttggtctcccttctccaccagcgccgctgcggtcacgcaggacgaagcggcgaagaggttccctggactagggccgacggcgaagggggagaaggccagggtggtggtgttggggacagggtgggcggggtctcggctaatgaaggacctcgatacacaaggctacgacgtggtctgcgtcgccccgcgcaaccacatggtgttcacgccgctgctcgcctccacctgcgtcggcacgctcgagttccgatccgtcgctgagccggtcgcgcgcatccagcccgccgtgtccaagtcgccgggctcctacttcctcctcgcccgttgcaccggcgtcgaccccgacggccacacgattgattgcgaaacagttacagatggtgagaaagattccttggagccatggaaattcaaggttgcttatgacaagttggtttttgcctgtggagctgaggcatcaacttttgggatacatggtgttaccgaccatgcaatctttcttcgcgaagttcatcatgctcaagagattcggagacggctcctccttaatctgatgttgtctgatctccctggaatttcagaagaagaaaagtgcagattattgcactgtgttgttgttggaggtggtccaacaggggtggaatttagtggtgaacttagtgattttattatacgagatgtcaaacaacgttattcacatgtgaaggattatattcatgtgaccctgattgaggcaaatgagatattgtcatcattcgatgttcggctcaggcaatatgctacaaagcaactaattaagtcaggtgttaggcttgtgcaaggaattgttaaggatgtgcagcccaacaaaataattcttgacaatggagaggaagttccttatggtttactggtatggtccaccggagttggtgcttcaccattcgttaagtcattgccatttcctaagtcacctggtggaaggatcggtgtcaatgagtggttacgtgtcccttctgttcatgatgtttatgccattggtgactgcagtggatttctcgagagcaccggcaaggaagttctccctgctttagctcaggttgctgaacgacaaggcaagtacctggcaagcctgctcaaccatgtcatgaaagctggaggagggcatgcaaactctgagactgaagcagatctgggtcgtccaccctttgtgtacaagcatctaggcagcatggcaactgttggaagatacaaagctctagtcgatctgaggcaaagcaaggagtcaagagggatatctcttgcaggatttgtgagctggttcatctggcgctcggcatatttaactcgtgttgttagctggaggaataggttctatgtggctatcaattggctgaccactctcttatttggccgggacataagcagaatctagagtgtctttgtatacgtacgaacaagcatataagtcgatgtagagttacacgccacggtcacttgcttgccacacacccctccgggggtccactcctaccactgtccctattagctgtgaatgtaattcacaggtgaattatgaataaatctgaggatactgcagttactta

SEQ ID NO: 131 - DNA, 2346 bp, Zea mays
aggggaccaggaaagcgctctttgcatctccgccggtccgtccacggtgtgaatcgcgtggtccgccgaacctcagaatagccgctcgaaccgcttcataactcccaccgcaccggtcgccccggcgcgccggcgaggtgacctactgacctcgacgagcgcgcgacgttgaccggggcgtgcatccggccgcatcttgtcctcgttccttacgcagaggagcgccgctccaaaatcgcagaacgccaaggcgggcgtagcgaaggatgtcggaggccgtcgccgcaggcgagtcgcccgtcgagctgctgctccgcgcggcggcgatggtgcccgcagagcgctacgcgctggccgccatcatcgtcgtgtccgtctttctgtaccgcttcctcgagctccatgttatcggcgacatcctccgcggcttccggggcggccgcgtcgagctcaccttccaccccgcctcggagatctaccaccgcgtcgcgtccaagtgccgcttgctccacggcaggtatctggcgacaccatggctggcgagcccgcatttgcagacattgttcctgggcatttacgggacgccgccttcattcacatacaagagacagttgtacactgttcgtgatggtggaaccattgctttggattggctgttcgcatctgatttggaagttgcagatggattcatttcgaaagacgcttcaacaccccttgtagttgtggttcctggattaactagcgattctgctgctgcttatgtaaaacacttggtttactccatggcaagcaaaggatggaatgttgttgtaagcaaccacagaggtcttggtggtgtgtccattacttcagattgcttctacaatggtggttggacagaagatgtccgagaggtcattacacacctgcatcacagatatccgaaaaccacactgttttgcattggtacaagcataggtgccaatattgtggtcaagtatcttggagaagaaggcgagaatactcctatagcgggtgcagtatctatttgttctccatgggatctgttgataggtgacagatttatttcccgcaagcttgtacagcgtatttacgacaaagcacttgcaattggtctgaagggctatgcaaaattacatcaacctgtcttggcccgacttgcaaattgggaaggtattaaaaagtcacgatctatccgagagtttgaccaccatgctacttgtgttgtctcaagatatgagacagtggatacctactatcgccggtgcagtagtgctagttacgtcggaaatgtgtcagttcccttgctttgtatcaatgctttggatgatcctctttgcacaagggaggctattccttgggatgaatgcagggccaataagaacattgttttagcaactactccaaatggtggtcatcttgcattctttcaaggactaactgcgcggagactatggtgggttggagctacttctgagttcctttctgctcttcatgacagctcctacatgcataggcagaaggcaaatgatcatgttttgctctcgtctttggaatcctccattgataagagtccgtatgttaatctcatggaagatggaatggtagctgcggtaacaaaagatggccctagcaatgacgggtcacctttgaaccatgcagctgatgaacaattaagtaacgaggcgggcggtggacaacagaatgtggtatctgcattgaaccataatgaaaactccattggagtgggaaacgacagccctgcagagccagtaaaacagcaaggtgatgacatccacagcaataagcttcatgagataattgctcctgtcaagagatctatgagccaactgactcgataccaagggaggtcagtctggttgcttgcctacattgcttttgtaacatcctggccgctgcttggctccctagctttcatcaccttccggaaaaagtccaggaatccgttgcgagctaaatgaatcatacttatattatgttattacaattacatcatgcaacatcctctgagctacgaaggccatttttccccgggtcgtcacagctcctgtgtacagtatcatcaccgatcatcagcaaacattgggggcgcctggataaactgatactttgtaatttgtattgtatttacaacaaaataatacgcaggataagcatctgtgtaattttactcggtaaatctggctggatttgctgtttggcatctgtcgagcttaacattatttttaatccaaaggatgcgaaacgtgtggtgaatgaacggtaaaaactatcagatagttgaggcgggaattttaattttaatttattactacttttttgttg

SEQ ID NO: 132 - DNA, 1430 bp, Zea mays
ttactccaggcttaaggttaagcacctcccaaacacgcctatgagggccctcgtccggatccacctgcccacggccatctccaccggatccttcctccacacctcctcaaccgccgcctccaagaccctagtaccgaaccccaacctcgtcccgctccggctcgtccgccacttcccggccatggccgccaccgccgcagacgagttcgtgaagggccgcgtcttccccaacggcgtcgccgtcatcacgctcgaccgacccaaggccctcaacgccatgaacctcgaaatggatgttagatacaaggcacttcttgatgaatgggaaacaaatccaagtgtcaagtgtattcttgtggaaagcagctcttctcgtgccttctcagcagggatggatattaagggggttgccgtggaaatacaaaaagacaaaaaaacaccacttgtgcaaaaggtattcacagtagagtactctttaatttgtaagatacatgagtatgcaaaaccttatatatgcttgatggatggagtgacaatgggatttggaattgggctatcagggcatggccgctaccgcattattacagagagaacactcctagccatgcctgaaaatggtattggcctgttcccagatgttggctttgcttacattggtgcaaaagcaccaggagggggtgcagttggagtttaccttgggattactggaaaaaggatatcatcacctgctgatgctatgttcataggccttggtactcactatgtaccttctgcaaatttgggttcactcaaggagtccctgctgagtgctaacttcaccaatgatcctcatagagacgttgagtcagttctgacaggatacaagaaagaaccagagtctgaaccacaactaaaaaagcttttgccatatatcatttcttctttcagtcctgataaatcagtggctgaatctgtggaagagctaaagaaatgtagccgaagtggtgatgctgcagtggcagaatgggccaatgaagctttagcaggaattgagaaaggcgctccattttctctttgtttaacacagaagcatttctctcaagttgcatcagcatatgggactagtgaacactatttatctaagctggctggtgttatgaaattggaatatcgcattgccttgaggtcgtcgattagaaacgattttgttgaaggtgtgcgtgctgttttagttgacaaggaccagaatccgaagtggaatccagccactctggaagaagtaaacatggccgaggtcgaatcagttttcgagccattaggggccgaggctgagttgagtgtgtgaaatatggcctgccacactcagttttcttatttgtgctgcaataataatgtatacaaaacagaaatgcgatgcccacagaaacaataaatgctgtgtcttcatgaac

SEQ ID NO: 133 - DNA, 2391 bp, Zea mays
ctgccgcacaacgatccggtcgcgcccgtccgtggcccagagaagatcccaaccccgcccgtccgccgcggactcccgggcccgccgcctcgtccgttttccgaatcggccgcgcggggtaccgcggcgccgggggccgcccggagctccgtccgagtccgttgccgggagccagccagggcgcaacgcgagcgcaatggcggaggtggggagccgggtgcgcgggttcctgcggaaccggtggctggtgttcgtggcggcgatgtggatgcagtcgtgcgccggggtcggctacctcttcggcagcctctcgccggttatcaaggcctcgctcggctacaaccagcgccaggtcgccgggctcggcgtcgccaaggacctcggcgacagcgtcggcttcctcgccggcacgctctgcgccgtgctcccgctctgggccgcgctcctcgtcggcgccgcgcagaacctcgtcggctacggctgggtctggctcgccgtcacgcgccgcgtccccgtgcccccgctctgggcgatgtgcattctaatcttcattggtaacaatggggagacatacttcaacactgccgcacttgtctcgtgtgttcaaaacttccccaagagccgtggaccaattgttggcatcctcaaaggattcgctggattaagtggtgcaattctaacgcagatttatgcaattgtacactctcctgatgatgctgcactgattttcatggttgcagttggcccaacaatggttgttatagctttaatgttcattgtaagacctgttggaggccacagacaagtgcgaccttctgatggcacaagtttcacatttgtatacagtgtctgcttgctgttagcctcttatcttatgggcgtcatgttattggaagaccttgttgacttaagccagtcagtgactgtcgtgttgaccgtgattctaatcatgtttctattagttccaatagtcattccagttctactcagcttcttttcggatgatgacgagactttgtatgcactattgttgccatcacctcggaaagaagaagcaagtgcatcaacatcttctgaggagcaacatgaggttatactcagcgaggtggaggatgaaaagccaaaggatgttgatttacttccagcctcagagaggcaaagaaggatagcagaattgcagacaaggttatttcaggcagctgctgttggtgctgtcagggttaagaggaggaaaggtccacggagaggagaggatttcacactgatgcaagcgctcatcaaggctgatttctggcttctatttttctcccttctgctgggctctggatctggtctcactgtgattgataatcttgggcaaatgagccagtcattgggttacgaggaaacccacatatttgtgtcaatgattagcatctggaactttcttggacgtattggtggagggtatttctcagagattattgtcaaagattacgcatatccaagggcgatcgcattagcgatagctcaagtcctgatggcgatcgggcacttcaacttcgcgatggcttggcccgggacaatgtacatcggcacgctgctcgtcggagtaggctacggcgcgcactgggccatcgtgccagccgcagcctcggagctgttcggggtgaagaacttcggagcgctgtacaacttcctcacggtcgcgaacccagcaggctccctggtcttctcgggggtcatcgcgagtggcatctacgacagtgaagcagcgaagcaggctcagcagcgccacaactccacgtcgctggcgatgagtggcagagtggctggcatggtctctggagccgctccgtcgttgaagtgcgagggcgccgtctgcttcttcctctcatcgctgatcatgtccgggttctgcatcatcgcgtttggcttgagcttgattctggtctaccgcacaaagatcgtgtacacaagtctatacgggaaaccgcgtacttgaaggatcaaccctcaagggacacagggttatcaaagcatacttcaattttgaatttattagtctggtaccccatgcctgtacaggtacagtgtcggtcttcccgttgttgtgcacaggttctcaagcagcatttcaacttttcaagtatgtggctgcaaatgggagcttcagtatagtgaagcatgtgagagtagaaagtccgtctgtggctggactgggacgctgtccttggctcaagttttgttgtatttggttgggaaaaatttgtgtacacatgtaataagctggagacgtttcgacgcatgtcagagtggagaacatattcttttatgatttgttgaaacttgcgtatttgtatttatcacaaagaaaacagtccaacttgtcaaccggcatgtttgttcgct

SEQ ID NO: 134 - DNA, 2043 bp, Zea mays
gtgcgagctgtgactctgaagccgccgccgcctcccgcctgcctctccatctccgtccacgccgcgtcataaaaatcccccttcaaggcccgacctagcacctaccctcgccacccgcccattccagttcccaatccgatcggtgcacgagctccgaatccactatccctgttgttggcggcctccagctcccgctgggaccatttccgtttcagggaggcggtctactctgtatttagatccgccccctccttgcggtagtcgggggagcggatttaggtgaacaagcatcttgatttttttgaccccccaatctttgctctacccaccgcgtggtcttcgcctttaaatcctctggaggtggatagacggacgaggcaaagccgaaggcaagaacggtcgtttcaagtatcctgctaccggcgtccgaaggaaccttcaagtgttccagtggaggtattaggagtggtggggaaaaagggattgtagaggtaacgatgttgagacagagctctagtagaaatcagagatccagaggtctgaagctgaagaaagctcttcagattagtctcttgcttctggtttctgtttggttgctctaccaagttaagcattcttacgagaagaaggcggcgtacagcgaaggtgaagtgaatgatttgcataaagatgacaagggccagggagaggcagtcagattgggcaggaaggatgtgcctccaaagatggaggctgattcttcaacactggatgagcgggttgaggatgaagagaacgatgaagtggagcaagaaatgaagcatgatgagaacgatgaggatcccatcgatgagcaagacctggagaaggacgaggatcttcccgagcctggcgagcattcttctgaaaaggatgaagatgtgggtgtgtttgaggacgaagagcggaaggagcggtcacaggaggatcaagagaagagcttccatggtgacgatgtgtctagtgctgttactcatgatcctcaatcgtccgagcaagatgagctgttccatcatgcccaagacacggtcctattcgtggatgatgcttcaactgcagtgcccaatgaaaaccatgtggctggaaacgacgaggaggaagtgcagagggctagggaaaggagtttcagaggcgatgatgtgtcaagctccgtggatcatgacgccaaggtggcaaagcctctcccagaggaacaactgaacagcatggataagatatttgaaggcaccacaaacttgtctaacggaatttcgtttcgagctcctggaataaatggatcatatgccggcatggacaatgtggctacagtaccaactaattcaccttcacagaaaaacgcaggcactcctagcaatgacatagaaagcaagacccacccatctccggcaaatttgaccggaccagagcaaagtaattcgactttgaaagatcacccagatcaacaagtgaattcaacagcagtgctgggcaaccaagtacagcctttgactaaccagacgccgtggcccgagttggattctccaaatggcaccttggctctggtaacagatgtccaaaagtccacatctggagctggagatgatggcagcagcactgtggacaagaggacggacggtagagatggtcccaaagaagacgtggatgtgtccacgaaaataatgaacagggcaatcagtgaggatgaagtcgttccagagtgacaaggagatctctcttgccggcttctggtgtaacctgtaagtttgtaggacttggtttcgtctcctagactagacttggagatgcgcaagcaggctgtctcgttgtgcacgccttttgtgtaagtttgatagatgtctgcttttgtactgccagttagtagtccatcacaatgatctgggtcgagtggagaacaagaagcatgtgtacccacagaaatatatgtagcgattctgcagctcttgaagcttcgctgctcgaatcaaatgccaaagtaggcagctaaataccatctatcaatgaaatgtccatgcccatcgctgccca

SEQ ID NO: 135 - DNA, 814 bp, Zea mays
aacatgcccagagtcacgtctgcctcgccggtgtcgaaaccacagccacacaggcagccggtgctgggcctcggcactcggcagccatggttcgccttgcgaagttctatctcgtctgctacaactccctccaatcgctcggatggttcgtcgccctcctccgcctcctgccctgcctcgtccctcccttccctgtccactccgcgtacgtggtcgccggcgacctcatctgtttcctacagacatgtgcgatccttgaaacggtccacgctgccatcggattggtgccgaccgcgccacttcttgctttcttgcaatggggagggaggatccacttcatcctggctgttgtccggcaaattcccgaggttcagagcagtccatctgtgttcataacatttatagcttggagcatatctgaggtcatccgttactctcactatgctctgactaccttaaaagtttgtccagcatggctgacttatctcaggtacactgcttttatcccgctgtatccaatcggggttggcccaggagaaatgtggacaatgtaccaagccctcccgtttgtgaagaagagggacctttactcaggtttcttcgagaagttctccatgagctaccgttcctttctagtgggtgtgctggtgctctacccgttcctgtggctgaagctgtaccagcacgtgttcaagcagcgcaagtccaagctggggaaggggagcaggaagaaacgggcctgagaaaatctggctctgctcagctcagctgccacttgttgctgtcatgtgaaacgctaacgggtcattgtgga

SEQ ID NO: 136 - DNA, 590 bp, Zea mays
gcagggaactgaggaaacgtctcgaatggtcgaacagtagtttgctcgctattatccatggcgacttctacggctgctgccactgcactgctccgccccaggccggcagttccagccaagttggcgcagaggaggtgcctccatgcggttgctgggtggacgacgatgaggaggaggggagctgcaggggtcgtgcgagctttcttcaaccctctcggggatgagcgcatcctccgagaagccatcaaggagccagtagcattcatgggtggtgtgtttgctggcctcttgaggcttgacctgaatgaggatcctctcaaggaatggataagtcggacagtggaggcttctggaatagctgaggaaaacagctctgaagaatcaagtgaggcagatcaaaatgatgcacctcagcaaattgagattgagtgaggtgcattgtctacttttgtccacttgtcacttttcccttgtaacttatcctgaatatatgtgacacctgattcatcacgtgcttgtcaaaaaaaaaagttggccttataacgtttttaattcaaatattgtatcaacctcaaaatatcaaaccttgg

SEQ ID NO: 137 - DNA, 899 bp, Zea mays
actctgacacgctacggcctctcggcggggcccggcaacagaccgggcagcagcacggcagccatggcgtcgagttcgaccctggatttggcgatgggccccggcgccctcctcccccgcagcgcggtcccgtacgcctccttcgctccaggaaggggaaggagcgcgagcggaacgaggagcaggaatctggcgctctccgcttcctcctccaacggtgcagcagtgccatccctgacaacagattcggagaagaagggcccagtgataatggaaattccactggaccaaatccggaggccactgatgcgaacgcgggccaatgatccagtcaaggtgcaagaactcatggacagtatccgtgtcatcggcctccaagtacctattgatgtgttggaggtcgatggggtctattatggcttctctggatgccaccgctacgaggctcaccagcgccttggtctcccaaccatccgctgcaaagttcgccgtgggacaaaggaaacactgaggcaccatatgcgatgagttatattttattcagttacaaagtgatctgtgtatctagagctaaaacagaagcttccatggtcttttcgtcgtctcgtctgcaattctccatacctgtaaatgttgtccaaacagagtggtgaatagtacttctgtacccagcagcatcagaaaatgttaattttgcctacaacactcttttcgatcagtggatggatgagtaccacccgctcagtagatcattccatttctacgagatttttgtaaaaaaagaaaaatgcagcagcagtcggcacgctgtgtcatttagatcatctagaaaaccagaaaaaacgagtcatgtaacttgtttggctcgtgcaaaaaaatattcaaaaccaagtttgctt

SEQ ID NO: 138 - DNA, 867 bp, Zea mays
atcgtctccctctgtactccttcctcagcctcatcctatccaagaacgcagaaccgagacccacgaactcgcagcaggccagcagccatggccgcccccgcaacgagctccctgctgagcacgctgctgcagctaccgctcgctccgttctcggggaagagctcgccgccgtccgtggtgcacgtggcgcgccgggcgccgacggcggtggtggcggccaaggggttcaatgtgcagatcctggtggacgagaacgagggggaggagtccatctttcgcaggttccggcgggaggtgatgcgcgccggcgtgctgcaggagatcaagcgccgccggaggtacgagagcaagacggacgagaagaagcgcaaggcgcgcgaggccggacgccgcaaccgtcgcaggcgtatgatggacgagccgaggttcccagaagaagacgccgacgcgacctccaaggctcgggacgaggacaacgacaactgggaggtcgacggcatcctgtgaaacaaaaggaacgcatgcagtccacagttcaatttcacagcgtccagatgatgcacagcacagacccgtcaaattcgagttctttttgaggcccccccgtaagacgcaatccaaaccgtatatttgcgttttggccgcgttcgtttccacttcagtgtccaatggttacagctgcaattgcacaactaacgttcgcaaatgtagcgtcctccgaccccttctcgttccctgagctcttcttgtgtccatggtgtttgaaaccctactcttgtgtctgttccaacatctatcctttgtgtagcttgcgctcatgaaagttcagaaactgatgaagatacgataatgtctctgaagatgaac

SEQ ID NO: 139 - DNA, 1399 bp, Zea mays
cagcggccttgtctccagtgcgcgcctccttgcgcctagccaagctccgtgcgcgcgcgcccatctccctcctcatctcccccgcgcgcgcctggctagccctagtgctcggcctctagcccacccgcgtgcccgcgtgctcctccctgctgccgcgtccatggcgcccagctcggatctcacccaagtcgccactgtcgctccgctcggcgccttccctgctccccaagtctcgtgccttgccgagctcgccctccactcggctcatggcgctcggcctccagctcggccctaccctctgctcggcgcccgggccgctcctctcccttccccgcgagctcctccctgtttccaagtcgtagcgcgtccctggcaccagcttggagctcgcccggccgcgtccttgaccttgctccctgttgcgctcgctggccgactgctcgacccgagcagcggctcgtccccgacacctagtctccgcaccgcggttcccccagctccagctcggtttcgaccagagtagctggttgcctggtttgtgtcgtgtgtgcctgggcactaccctagttggtcgcctcagtgtgaattcgtcgtcgcgtccaggatttcggcatgtctccctgctcgccgtcagcccaagcgccacatcagacttaccctgtatgatgttcaccaagtgctcgacaaaaagctcgaacgagtcgtacagccattgtcttcgtcgaatggaaatcgtcgcgctggcacgtcgatgtcgtcgatcgccatcctcgtctacgccaagtcccaagccgtgaagacgctcttgtgctggccacgtgtcaccagctcgacaaaatgaatcccatgggtatctggtcaagaataggaattgtgtgcatcgctcgccagacgtgtctgatcaaagatgtcaaccggaaaccgtcgtcatgcttccgactatcgtgtcggattagtcagggtacgctagctaatcacgtgatgaggaggacaagagccaagctaacctcaagatggtgcaaggagtggtcttctccgtacgacgatgtcgtcagtcggaccaacctgaagatggttaaatcaagaaagtgctcggtcgagggataatcgtcaagcagacatcttctaacaaacactaacctagtgttatttcaggtactagatttgtgctattgtggatggtgttaagcgccggtgggcacggccttcttataagtctaagtacttcttctatacttcttattgaggattgtcattgagctagcatatatatttcaaacttatgaaaattatacatcattcaaagtgaaatactttggatttattttataaacactccgatcttgtataatgtaatcaatgtaacttgtaaccttttgtaataaagaaattccgctgc

SEQ ID NO: 140 - DNA, 5134 bp, Zea mays
ctcactctcactccgtcctccctcttccttacagaaacacaactcatgcagctcgtacggcaccaccaccaccaccaccaactgccgcactgacacatgcatgcgcagaaagcagctagctagcggccggtggccttgagagccgctcgctagcttttaaaattagccaccaattcaatctctagctagcttgggggagctccgttcctagctacacgtacgggcggcgcggcaaccaccagccgtgtagccgacctagtacgttggagcgaagcatatatcggcggccgcatcacatggagagcgcgatggagaaggtgtgggagtcggggcggcggatgagccggagcatcgggcggggcatgggcatggaggcgtggggcgtcgacgacgccttcgtgccgcagcacggctcccggtcccggggcggcggcggcggcggcggcgacgacgacgaggaggcgctgcgctgggcggccatcgagcgcctgcccacctacagccgcgtgcgcaccgccatcctgtccaccgagaacgccgccgtggttgacgacgacgacgacaagacgcggcggccgccgccgccgcagcagcagcacttcaaggaggtggacgtgaggaagctcggcgtcggcgagcgccaggagttcatcgagcgcgtcttccgcgtcgccgaggaggacaaccagcggttcctccagaagctccgcaaccgcatcgacagggtgggcatcgagctgccgacggtggaggtgcggttcgagcggctgacggtggaggccaggtgccacgtgggcagccgcgcgctgccgacgctgctgaacacggcgcgcaacgtcgcggaggcggcgctgggcctgtgcggcgtgcggctggggggccggcaggccaggctgaccatcctcagggacgtgtccggcgccgtccgcccgtccaggatgacgctgctgcttggcccgccgtcgtccgggaagaccacgctgctgctggccctcgcgggcaagctggacccggcgctggtcgtcgccggcggcggcgaggtctcctacaacgggttccgcctcggcgagttcgtgccgcagaagacggcggcgtacatcagccagacggacgtgcacgtcggcgagatgacggtcaaggagacgctcgacttctccgcccggtgccagggcgtcggcaccaaatacgatcttatgacggagctggccaggagggagaagggggccggcatccggccggagcctgaagtcgacctcttcatgaaggcgacttcaatggaaggagtggagaacagcctccagacggattacactctcaggatactggggctggacatctgcgccgacaccatcgtcggcgaccagatgcagcgggggatctctggcggccagaagaagcgcgtcaccacaggggagatgatcgttggcccgaccaaggtgctgttcatggacgagatatcaactgggctggacagctccacgacgttccagatcgtcaaatgtctccagcagattgtgcacctgggcgaggccaccatcctcatgtccctcctccagccagcccccgagaccttcgacctgttcgatgacatcatcctgctgtcggaaggccagatcgtttaccagggacctcgtgaatacgtcctcgagttcttcgactcctgcgggttctgctgccccgagcgcaagggcactgcggacttccttcaggaggtaacatcaaggaaggaccaggagcagtactgggcggacaagcagatgccttacagatacgtttcggtgccagaatttgcgcagcggtttaaacggttccatgtcgggctccagcttgagaaccacctctcgctgccgtttgacaagagcaggtgccatcaggctgccctcgtattctcgaagcactcggtgtcgacaaccgaactcctcaaggcatcctttgacaaggagtggctcctcatcaagcgcaattcatttgtgtacatcttcaagaccatacagcttatcattgtagccctcatcgcgtcaacggtgtttctgagaactcacatgcatacgacgaatctagatgatggctttgtttacattggagcactgctctttactctgattgtgaatatgttcaatggttttgctgagctttccttgaccataacaaggttgccggttttctacaagcaccgggacctgctcttctatcctgcttgggtcttcacagtaccgaacgtcattctcagaatcccattctccattattgaatctatagtatgggttcttgtgacatattacaccatagggtttgctccagatgctgacaggtttttcaagcacttgctgctcgtgttcttgatccagcaaatggcaggtgggcttttcagagcaacagctggactttgcaggtccatgatcattgctcaaactggtggagcactatttcttcttatcttctttgttcttggaggctttgtcctgcctaaagttttcattcctaactggtggatctggggctactggatctcacccttgatgtatggatacaatgctctagctgttaatgaattctatgcccctcggtggatgaataagtttgtcctggaccaaaatggtgttcccaaaagactggggatagctatgcttgaaggtgccaacatctttgttgacaaaaactggtactggattggagcagcagggctcttgggtttcaccatcttcttcaatgtccttttcacactgtcgcttatgtacctgaaccctctcggcaagccacaagctgttatatcagaagaaactgcaaaggaagcggaaggcaacgggcattcaaaaggggcaataagaaatggaagcacaaaaccaaaggacggtagtcataacaaggaaatgaaggagatgaggttgagtgcacgtttgagcaactgttcatcaaatggggtttcacgactcatgtccattggcagcaatgaagctgctccaacaagaggaatggttcttccattcaaccctcttgctatgtcttttgataatgtgaactactatgttgacatgcctgcggaaatgaaacatcaaggagtgcaggatgacagactccaattgttgcgtgaggttacaggatcattcaggcctggagtgctgacagcacttatgggtgtcagtggagctggaaagactactcttatggatgttttggctggaagaaagactggggggtatattgaaggagacatcagaattgcaggctatcccaagaaccaagcaacattcgcaaggatttctggatactgcgagcaaaatgatatacattctcctcaggtcacagtaagggagtctttgatatactctgcctttttgcgccttcctggaaaaattggagatcaagaaataactgatgacataaagatgcaatttgtggatgaagttatggaactagtggagctcgacaatctgagggatgccttagttgggctaccaggaatcacagggctttcgacagagcaaagaaaaaggttgacaatagccgtggagctcgttgccaatccatcaatcatatttatggatgaaccaacatcagggcttgatgcaagagctgcagcaattgtcatgagaactgtgcggaacacagttgacactggacggacagttgtttgcacaatccatcagccaagcatcgacatctttgaatcttttgatgagttgctattgttgaaaagaggaggccaggtgatctactctgggaaattgggtcgcaactcccagaaaatggtggagtattttgaggcaattcctggagtgcctaaaataaaagataagtacaatcctgcaacgtggatgctcgaggtcagttcagttgcaactgaagtgcgactaaagatggattttgctaagtactatgaaacatcagatctgtataagcaaaacaaggtactggtgaaccagctgagtcaaccagagccaggaacatcagatctttatttccctacagagtactcgcaatccacaataggacagttcaaagcctgtctctggaagcaatggctgacttattggcgcagcccggattacaaccttgttagatattccttcactctgttagttgccttgcttctcggctccattttctggaggataggcaccaacatggaagatgcaaccactctcggtatggttattggagcaatgtacactgctgttatgtttatcggcatcaacaattgttcaactgtgcagccagttgtttcaattgaaagaacggtcttctacagagagagggctgctgggatgtactctgctatgccatatgccattgctcaggttgttatagagataccatatgtatttgtgcaaacaacgtactacaccctcattgtatacgccatgatgagcttccaatggacagctgtcaagttcttctggttcttcttcatttcctacttctccttcctctacttcacctactatggcatgatggctgtctcaatctccccaaaccatgaggttgcatccatcttcgcagcagctttcttttctctcttcaatctcttctcaggcttcttcattccgagaccgagaattcctggatggtggatctggtactactggatttgcccactggcatggacagtgtatgggctcatcgtgacacaatacggagacctggaagacctcatctcagtccctggagaaagtgagcagacgataagctactatgtaacacatcattttggataccacagggattttctgccggtcattgcgccggttctggtactctttgcagtattcttcgcgttcttgtacgcagtctgcatcaagaaactgaacttccagcaacgataagaacaagatatggcagcaaaagctcttgagagtttttttggaacattgccgtgtatatagggtattttgcacatcgcgttctcctttcattttttgagtccctttaatacattgtcgtgtatatagggtattctgcacatcgccaaatgtggtgaggtcttatacagatttctagccatttattgcaagagcaaaactatgatatttttccggatacacagaagagctacatattattatattaagaagagaggtctaacgtagacctgccacaagatataatcctctattggataagaggatataacact

SEQ ID NO: 141 - DNA, 4167 bp, Zea mays
ggttgtggggcttgtgttgtccttatagcaaaatataacccaaagacggatgaagtgactgaatttacagcaagttcatgcctgacacttctttacactataaatttctgttcggttatcactactgagggtctgggtgatagccaatatggctttcatgctgttcaggaaaggatgtctgggtttcatgcctctcagtgtggcttctgcactcctggaatgtgcatgtctattttcacttcccttatcaaagctgacaaatccaagaggcctgaaccaccaaagggcttctcaaaactaaaagtatcagaagcaggaaaggctttctctggcaacttgtgcagatgcactggttatcgtccaattgttgatgcctgcaaaagttttgcatcagatgttgacttggaggatttgggccttaatatattctggaagaaaggtgataggaacccagatgttagtgaattgccaagttacacccttggtggtggagtctgcaccttcccagactttctaaaaactgagttaaaatcctcgcttgatcatctgaataatccttgtattgcagcctccggggagggttggtatcatccgaaaagtatcaaagaatattacgagttaataaattcttgtttatttagtgactcagtcaaagtggttgttggaaatactagcagtggtgtacctggatacaaggatcaagacatctacagtaagtatattgacataggaggcattccagaactttcaaatattgtaaggatggggtctggaattgaaattggagtagctacatcaatctctaggaccattgagatacttgaggaagaatgtgaatctatatcctctccaaacggaagtgtagttttcagaaaacttgcgaaccacatgagcaaagttgctacaccttttgttcgtaacacggctagtattggaggaaacatagttttggcacaaaaattcccatttccatcggacattgcaaccatactccttggtgctggtgcaactgtttgtcttcaggttgttgcagaacggagacaaattactttggaagagttcctagagcagcctcctatagatgctactactttactcctgagcatatttattccaaattggatttcagattccggggcaaatataagtttgctatttgaaacttacagagcagcgcctcgtcctcttggcaatgctgtttcatatgtaaattgtgctttcctgggacatgcttctttggatgaacaatcagatactcttgtattgagtaatctgcggttggcttttggtgcatatggaacagaacatgctattagagcaacgagggtggaggaattccttactggtaaatcactcactgcatcagttgtacttggtgcaattcaattacttagagaaacggttgtaccaatggagggaacatcacatcctgaatatagagtcagtgcagctgttggatttctctttagtttcctatctccattttctaaatgcatcccagagcctggaaagtctctggccagcagttctactgattcagcagatacagatgatgttcgtaatctgccattatcaacacgtcgagaaacattttctagtgacgaatataaaccagttggtgaaccaattaagaagtatggtgttgaacttcaagcatctggggaggcagtatatgtggatgatattcctgctccaaagaattgcctctatggagaatttatttacagcacacaaccccttgcttatgtcaaaagtataaaattcaaatcctctttagcatcagagaagatcatctcttttgtttccgcaaaggatattccaagtggaggactaaatattggatcatcctctacgtttggtgacgaaccactatttggtgatccaattgctgagtatgctggtcaagctcttggcattgtgattgcagaaacacaaaggtatgctgacatggcagccaagcaggttgttattgaatatgacacagaagatttgagcccaccgatcataactgtggagcaagcagtggaaaaaagtagctattttgatgttcccccagaattctatcctaaagaagttggtgatgtttccaagggcatggcagaagctgatcacaagatcccatcaacagaagtaaaacttgcctcagagtactacttctacatggaaacacagacagcactagcagttccagatgaagataacactttggtagtctacagttcgtcacagtaccctgaacttgcacaaagtgtcatagcaaggtgcttaggtattccattcagcaacgtgcgtgtcattacaagaagggttggaggaggcttcggtggaaaggcattcagatcattccaagttgcaacggcagctgcactttgtgcgtacaagttacggcgtcctgttcgaatgtaccttaatcgcaacaccgatatggtcatggttggtggtaggcacccagtgaaagctcattatactgtcggattcaagaacgatgggaacgttacggccttgcatctagatttattgattaacgctgggatatctccagatgcgagccccataataccaggcactattatatctagtgtgaagaagtacaactggggcgctctgtcatttgacatcaagctctgcagaacgaacaactcatctaaatccgtaatgcgtgctcctggagatacacaaggctctctaatcgcagatgctgtaatcgagcatgtggcgtctgtcctgtcactggatgccaacagcgtgagggaaaagaatttccacacctacggtactcttcagtcgttctaccctgacagcgcgggcgaagcttctacgtacacgttgcattctatttttgataggctggtctcaacttcaagctacctggatcgagccgaatccataaaggagttcaacagcaacagcaagtggcggaaacggggcatctcttgcgtgcccctcattttcaaagtggagccaagggcggccccaggaagggtttccgtgctcaaggacggctccgtagtggtggaggttggaggaatcgaaatcgggcaaggtctgtggaccaaagtgcagcagatgaccgccttcgctctgggaagactgtggcccgatgctgatggcggcggcgaatgtcttcttgggagagtgcgcgttctacaggctgacaccttgaacttggtacaaggtggactcactgctggcagcaccgcttctgaatctagctgcgcagcgaccctccaggcatgcaatacgctgtacgataggttaaagctagtcttggacaggctgcagcagcgatcagagaatgtctcgtgggataccttggtttcgcaggcctatgaagacgatgtcgatttgtccgcgagtgcgtactgggtacctggtcaagcttctaacaagtaccttaactacggagctggtataagcgaggtggagattgatcttcttacgggagcaatcactataataaggggcgatcttgtgtacgactgtgggaagagcttgaaccctgcagtggacttaggacagatcgaaggctcgtttgtacagggaatcggtttcttcgtatacgaagagtacaccacgaacagcgacggcctgatgatcagcaacagcacgtgggactacaagatcccaagcgtggacatcatcccgaggcagttcaacgccgaggtgctgaacaccggataccacaagaaccgtgtgctctcttcaaaagcttccggtgaacctgccttggtccttgcctcgtccgtccactgcgcgctgcgggaagccatccgagcggcgagggtggagtttgcggacagcaccgtgtcatctggacactcgccgctggagttccagatgggtgtccctgcaccgatgacactggtgaaagaactctgcggtctagatattgtggacaggtacttggaaggtctgtctacctgtgaacgtgcggctggtggggcgtagtcttcttctaatctaaactcatgttatctcatacaagggagtggtatcagcctattgtttgcttgtttgtacgtgtatatacaataaaacgtgctcgcggcgtggtggtgtgtgtgtcattgtgtgtgtgagtgtgagcacaatatctatctgaatgctgtcaaccatgtgtccttattaaaactgctggagtggtcatgtttcagtaatctattgtta

SEQ ID NO: 142 - DNA, 1321 bp, Zea mays
ggagcatcaccgttcactggataattcgctcgctccgctcgatgcccgcttgtttgcggtgaagcctccggcgaacagccgtagcggaaacgccgcccgagatgtctgctccctccgccccaccccgcacggtgatctgtgtgggcgacgtccacggctacatcacgaagctggagagcctctggtccaacctccaggccgcactccccgccgacgccttcgccaccgcgctggtcatcttcctcggcgactacaacgaccgcggcccgcacacccgcagggtcctcgacttcctcctcgcgctcccgacgcgctaccccgcgcagcgccacgtcttcctctgcggcaaccacgacctcgccttcgcggcgttcgtcggggcgctgccgccgccgcccgacggctccccgttctcggccacctgggacgagtacatccacaacgaggagcacgaggggtggttccgcgggccgggattcgagggcatgcacgtgcaggggaggcggtggggcggggtcatcaaggagaggtggaaccccaagaagggcctcccgtacaagggctccatctacgacgcgcagcccaccttcgaatcctatggcgtcgcccatggttcctctgatcttgcaaaggctgtgccagaggagcacaagaggtttctgcatgatttggtttggatacatgaagaggaaaatgtgccagttgatatggatggaggacaaatcatctgcaatctgattgctgtccatgctggcctagagaggaccatagatttgaatgagcaacttagagttttaagaactagagacacaagggtgccaaaggttcaaatgcttagtgggaggcaagatgtttgggacacacccaagggtctggccggcaagcagactattattgtaagtggccaccacgggaagctccacatcgacggcctccgatttataatcgacgaaggtggtggttatgaagacaaacctattgctgcgatagtttttccttcaaagacattgatcagaagtaccgaggaagcgggaaccacatcagagaggtgatctagagttctagacatcgtcaggagcagtgaacacggaggcacagttttttctctcttgaagttactgcttgtagtcatgtactcatgtcaaacgacaataggaataacgtccaaaggcaataagttggtgaaccggacctgcgttttctcaatttagtcactgatgactatatgtctatatatattgtaccttgatgctgtcaatttagacgagaccgtacatcctctttttttagggcaataaactttactccctgtcctcaaata

SEQ ID NO: 143 - DNA, 466 bp, Zea mays
cacgcagccggcagcccagagccggagagcccagtgaaacagagccggtgaacgcagcccagtcagtgagccccccgatcccgactccggcgatctccccaaccccatggcctccgccggcgaggcccccagcacgctcctccgcttcctctacttcgtcggcgccggagtaatctgcaccaaggccatcaacacctatcgcgactacgagcacaagaaggagtccaccgccgccctcgccgccgccgaatcggcgttggctgctgccgcggcggccgagcccgctcctgcaaccgccgccgcgaagccctgattgtggacgagggcctgtcttcggcggttagggttctcggaatgttgctctccataggggagatagatattttcttttgtttctgatgtttcagctacgtgtatgtgctcttttggcttgaatcaatcagtaataatacttctcttcctgtct

SEQ ID NO: 144 - DNA, 1035 bp, Zea mays
cacaccatccaactccaaggccggccgtgactgcaactgcaatacatcatctagactagatctctctttttcttgggcgtatatattcctacataagtacgctctgatcttcttccagctcgctcgctcgctcgctcgatcgatcgatcgcgcgcgcctgtagataaatttatatatctatacacgtcatggggcctcagcaaggccggcggtcgaacggcggcgcggcggcgcggagcaagcaggaggaggaggggggcgcgaaggtggtgcggtaccgcgagtgccagcgcaaccacgcggcgtccctgggcgggcacgcggtggacgggtgccgcgagttcatggcggcgggcgcggacggcacggcggcggcgctcgcgtgcgccgcctgcgggtgccaccgcagcttccacaggcgcgaggtggagcagcccgccgccgactgcgactgcgactgctcctccaccacctccggcgcctgaagtgaactcatctacggtgtgaatcgcctcgccggcggctgctggccggccacgccgcttgagtgagctgctcctgctagcaggtgggtggggtgggtgggtgcatgcatggggtgggaccgacgatcatgggggcagggcagggcattcatcaaacggtgtgattagaccggtatagtcgatcgtaggtgcattatattcatcaaccattaccatatatggaccggtgggttttttttttacttcctcctctgcagctctctgctctatttttcttctttctctcctctccatttgttcttggatatggttttcagtgaagaattctgttgtgcgaagcatgtgacataatcgtccgtatatatgtatacatatatatatggtgcttgtacgtgcctgtgctgctaggctgctagctgtgtgtgtgcgtgtgtataaagtccagcggtgtttccatgttactttcctgtatatatatatatataaaatgaacatgaatctctcgcatatgcatactcttaaatttatttaccatacatgtgctctgtgt

SEQ ID NO: 145 - DNA, 1320 bp, Zea mays
cgtctaccttctctatctccacccccaactccccaagagccgatcagaccatttgtaccgacccccgagaggcgaccaggcagtccggaagcgcgtccgtccgttggtgctgctggtgccttgtggtcgagcgatgtcgaacgccgccgacgtggaggcgggcgcccaggcgagggcggcgccggcgacgacggggatcaagccgcccccggggcggtacaacaacatgaccagcaacgggccgtacacgccaccgtcgccgttctactacgaccccgcggcggcgcacgggcggcaccactggtcgtggctggtgccgctggtggtcatcgccaacgtgctcatgttcgtgctggtcatgttctacaacaactgcccgcgcagcggcggggactgcgtcggccgcggcttcctccgccgcttctccttccagccgctcaaggagaaccccctcctcggccccacggccgccacgctgcagagatacggagccctcgactggtacaaggtcgtgcacgggaaccaggcctggcggctggagtcgtgcacctggctgcacgccggcctcatccacctgctcgccaacatgatcagcctcatcttcatcggcgtccgcctggagcagcagtttggattctggaaggtgggcctggtgtacctcgtctctggcttcggagggagcgtgctctccgtcttcttcatcaggaagggcgtctccgtgggcgcctccggcgcgctcttcggcctcctgggagcgatgctgtcggagctcatcaccaactggtccatctacaccaacagatttgcagccatgctgaacctgatcatcatcgccgccatcaacctggcgctcgggatactcccgcacgttgacaacttcgcgcacatcggcgggttcgccacaggcttcctcctcggcttcgtgctgctgatccagccccagttcgggtggctggagcagcccttcggtgccaagaccaagtccaagtacaaggcatatcagatcatcctcctgcttgctgccctcgtcttgctggctgcagggttcgctgttggattggtaatggtgttcagaggagagaacggcaacgatcactgtagctggtgccactacctgacctgcgtgccgacgtcaagctggaagtgtgacaattgaactgatcagagattagtgacgggttagcatgcttgcgtcgtacagaagagaacatgcgtccccaccacgagagacaatgtcaagatagatacgtgcccctcaccttctatgacattgtcaatgtattgctttcaagtttgatttttaaagtctgcattgtacag

SEQ ID NO: 146 - DNA, 437 bp, Zea mays
gcacgggttagctctggctctcctgctatagatatgagatgcaagaggcggccaaggctcggcatggggtggcttcgctccgtgctctccccgctcaggaagctctggtgccgcgtcaacgcggtgcagcgcaagaagagagggatctacatcctgtacgacgacgtcaagtcgtgccaatgcgaggacgtgcacgtgctgtgggcgatcctcgttgagtcccacggcctgccgacgccgacgccgacgccgcctctgctgagcctgaagcgatgaggggcggcgggtgctccgccgctgcaccccctgaataagcgaacggtccatggatatacctcgacatggctatgtcgctgagaggtgaattcaagtagtagcgattctgaattctgatgtacatagggatcaaccgatgtgtgttgtgtcgccggtgtgct

SEQ ID NO: 147 - DNA, 898 bp, Zea mays
ctaacgcaatcgctcgctcgctcgctcgatatttagccgtggagaggggccgagggagggagcctgctccgctctgcagcacgaacatgatgaagccatcgtgtgtactgcttctttccagccttcttgtagccactcttgcagctacttcttcgtcctctcctccgtattccgtcggcaagcacccagggtggctgctggttctaggtcgcaaaggcagagaactcggccagtcgtcagggtaccattattaccagcatcagagcaagcagcccgagctgcagggagtggctatggaggtaaagaaacccgaggaggaggcgacggcgaggcgaacggccgatcagagcggggacgccgagacagggctgatctacagcgcggactacagcagcgtggccatgcatgctgcctctccgccgacggcgaagcccaagcacaggcaccccaccagaccataggaagctgtccttatgtaagccagtcgtatgccgtccgtttcgtgtgtttcttatctcgctggattgtacgagcagaagcacccctgctgtctctgtaaaatataggccctcctgatgtgctgcttctttccttctgttgctctcgctctctgtccctgccattgctgatgagtgctatggcgatatgttgatccaaacacacaaaatgggatggcaacacaattgtacgtcgaatcgtcgttaaagtggccccaaaaaagcaccgtgaaagaaggtagctatgttaggtggcatgctgccgacacacttgcacaacgccgacaagtctactgacatattacattttaaactaaggacctgtttgacgagattataaatctatatgtagctatttggatgactagattatataaatgaagattattgatttttgagac

SEQ ID NO: 148 - DNA, 1478 bp, Zea mays
caacggcagcgctcgcgttcgtgtacgtttatattatttttttataagggagcaagagggctcggcggcagcggcagcggcgacggcgaccgcgacggcagtggcagtggcagtggcaggctgtcagccgtccctatcttgtgtgtcaagcgcgaactccctatctcgtgtgtcaagcgcgttcgcgtgcgttctaggcacaggcagccgaggcgagccccttccgctcagtggccgccgccggaccgtggacgcagctagcccatcagcccatggcagggacggacgtcgcaggctccgcacgcggctccgatgccgcgctcggcaagacgggcgaaccacccgccgcggcgcgctctggcgcagccaagaaggtgactctcgctctgctagcctccttctcggcgctgctgtacagccagattcagccgccgccgtctaagatccccggcacgccgggcgggcctccggtcacggcgcccagaacaaggctcaaggacggccggcacttggcgtacctggaatccggcgtcccaaaggagaaggccaagtacaagatcatattcgttcacggcttcgactgctgtagatacgacgtgctgaatgtctcccaggggctgttggaagagctgggaatttacctgctgtcctttgaccggcccgggtacgccgagagcgacgcccacccggcccggacagagaagagcgtcgcccttgacatcgcggagctggcggacaatctccagctcggccccaagttccatctcatcggcttctccatgggcggcgagatcatgtggagctgcctcaagtacatcccgcacaggctcgccggcgtggcgattcttgccccggtgggcaactactggtggtccggcttcccgccggacgtgttcaaggaggcgtggcgcgtgcagtttccgcaagaccagcgcgcggtctgggtcgctcaccacctgccgtggctgacgcactggtggaacacccagaagctgttccgcggatccagcgtcaaggacggcgaccctgccatgctatccaaggaggacaggcttgtagctgacaagttcgagaagcgaacctatgagaagcaggtcagacagcagggagagcacgactcgctccaccgcgacatgatggtcggtttcgggaagtgggactggagcccgctggagatggagaacccgttcgccggcggccaagacgaggtgaaggtgtacctgtggcacggcgtcgaggacctctacgtgccggttcaactgtcgcggtacatcagcgagaggctcccatgggtcatctaccatgagctcccgacggccggccacctcttcccggtcgccgacggcatgcccgacgctatcgtcaggtcgcttctgctcggagatgagtgatcagtatttaggatgcgcggatccaggacttgggcactttttgcagcttcatcagtaataaaaatacactcggaggtcgagatctgt

SEQ ID NO: 149 - DNA, 1440 bp, Zea mays
tcgtaatcctaaccgccctggtttctctacacgctacgggaccggtaacttctagaacccaccaccttccatccttccttcctttcctctctctctctctctctcctcgcgcccacggtgcccgccagccagatccgcgcgttcaccggcgccatggccgccgagcatgccaccgccgcggtgggtgagccgcctcccgccacgtcgcagccggcggagggcgtgacggcggcggcgggccagaggtccgtgcccacgccgttcctcagcaagacgtaccagctggtggacgacccggcggtggacgacatcatctcgtggaacgacgacgggtctgccttcatcgtgtggcgcccggcggagttcgcgcgcgatctgttgcccaagtacttcaagcacaacaacttctccagcttcgtgcgccagctcaacacctacgggttcaggaagatcgtgccggacaggtgggagttcgcgaacgactgcttccgccgaggggagaagcggctgctctgcgacatacaccgccggaaggtgtcgccggccacgggggcggtcacggtggccgccgccgctgcggccatcccgatggcgctgcccgtgggctctccggtgtactccggcgaggagcaggtgctgtcaagctcgtccccggagcccccgtcgctgcagcagcacccgccggcgccgtccgggtcgggctccggcggggtggtctcgggcgacgtgggcgaggagaacgagcggttgcggcgggagaacgcgcggctggcgcgcgagctcggacagatgaagaagctctgcaacaacatcctcctcctcatgtccaagtacgccgccactcagcagccggacgccgccaaggaggcggccgccgggaactgcaccggcgagtcgtcggatgccgccgcggcgcctccgctcccttcgatcctggagctcctaccctcgtgccgcgccgaccccgcgcccgctgcagccggaacggatcacgaggatgacgaaaaggcgggcgctaggctgttcggcgtctccatcgggcggaaacgaatgcgggacgagagcgaccaccacgccggcgtctgcgcagcggaggtgaaagccgagccggtggacgcgcgtcccgaccagcagcggcagcgcaacgccacggagccgcagtcgtggcccatttaccggcccaggcctgtgtaccacccgctccgggcctgcaacggctcgggcagcgctgggagcgaccacgacgggtccaacgactcgaggtgacgggagcaatcgtcgatctgccctcagtaaattagtattacacttactaatggtactaggtaactatattacaggttaaactaggatgtgagctctaaatctctaattatgtggggatttactgaccgatcctatgtaaaaatctccagtgtttatgtagttgatctcatatta

SEQ ID NO: 150 - DNA, 2024 bp, Zea mays
gttcatctgcctggtagaggtagcacgccagatcaccagcgatccgcacgtcgcagcagagcaaagatatcgcggggagcaagagtagtcaacgcacgaatggtgggcacggtgtcgctagcggcgggctacggctccgatggcgtgtaccgctcgccgcgcctggtggctgccatcgcctccgacccgggcctctccgtcacggacctcgtccttcgccgcgccgcggcgtgcccctccgcacccgcgctcgtggacgccgcgacgggccgcgccctcaccttcggggccctccgatccgcggtgctcgtcgcggccgccgcgctctcctcccgcgcgggcgtccgccgcggcgacgccgtgctgctcctcgcgcccaactgcgtgctctacccggtctgctttctcgccgtcaccgcgctcggcgccgtcgcgaccacggctaacccgctctacaccccgcgggagatcgccaagcaggccgccgacgcccgcgccaggctcgtcgtcaccgtctccgatctcctgcccaagatctccggtctccgcctccctatcgtcctcctcgacggcgacggcgcccccgtgccttcgggctgccccagcagtaacgtcactctctactcggacctcgtcgccggggtgcaggaggcggagtaccgccacacgccgatcgggcagggcgacacagcggcgctgttctactcgtcgggcacgactggggagagcaagggcgtcgtgctcacgcaccgcaacttcatcgcggcagcgacgatggtgacgtcggaccaggacgagctgggggaaggccacaacgtgttcctctgcttcctgcccatgttccacatcttcggcatgtccgtgatcaccctcggccagctgcagcgcggcaacgccgtcgtcgtgatggcccggttcgacgtcgacgccgtgctggccgccatcgagcggcaccgcgtcacgtacctcttctgcgccccgccggcgatgatcgcgctcgccaagcacagcaggggcggcaggtacgacctcagctcgctcagatgcatcggctctggcgccgcgccgctcggcaaggacgtcatggtggctatggctgacaggttccccggtgtcgacattatccagggttatggtatgactgaaacctgcgggataatatccctggagtacgtacagaagggttgtgcccgtcagtttggttcgactggagcacttgtcacaggagttgaagcaaagatcgttaatgcaaagacaatgaagcatcttcctccgagccaactaggagaaatctgtgttcgaggaccgaacataatggaaggctatttcaacaatgtgcaagcgactgagtctacaatcaagaatggatggttgcataccggtgatcttggatacttcgatgaaagaggccagcttcatgttgtcgatagacttaaagaactgattaagtacaaaggcttccagattgctcctgctgagcttgaaggactgcttttgtctcatccagaaatccttgatgccgctgttatcccgtatcctgatgctgaagcgggggaagttcctatcgcctacgttgtactatcaccgaagagttcactggccgaagctgatgtccagaaatttatcgagaaacaggtcgcgcactacaagaggctgaggaaggtaacgttcgtgggcagcgtaccgaaatctgctgcggggaagattttgaggagagagctcatcgcccaagtcagactgtccaagctgtagcagatttaatctcgatttcactgcagcccttgtcgtctgggttctgctggacacagaagtgcagaatctctgctgagcactgtacaagatttgtctatcaagtcactgtcaggaaccacacatttcagtctagacatgccagacactgatttcttttttttgttaaggaataaagcattctggcctctagtatccacggatgaatgatgtatcctatattgcttggattcttcaagaaagttaaagtaatatataatactacatccgtctca

SEQ ID NO: 151 - DNA, 753 bp, Zea mays
aataagccccacgaaagcgcacaccccatctaaaaaaggccgcaaggcaaagagaaaacgaaacgcgaagcaaacccttttcggcgtccggcgtccccatccccaccccaccaggccaccacggcgggatgaggccggcgtcggacgcgcaccagtcgcggctgctctacgagctctgcgcgctcctgctgaccgtcctccgggcgtcgcctgacgacggggcggtggcgcggccgctgctgccgcgacatgtgacgcccgccggggtggcgtccatgctgctgggggcgtccatggcgctgatgctctgcggctcggtcaccttcatgctcggcttcttcctcatgccctgggttgtcgggctcggtttcctcttcctcttcgtcggcttcatcaccaacctctccgggatctggagggacatcatcctctggccctccgtcgcgtgctccgcatcggactcacccaaggaggcaccctccccatggcatatgttttccaagccttcatccatgtcgacgtgaagccaagtacaaagtaaggctcccacggaggtccacagaagcagggagttgttggagcagcagccattgccaacctatattttccttcctggacaacccttcttttacatgtgacaccgcagcaagttgccaagttttaaatggttttgtactgtgtctaggaggatacgggatacttgcttgtacatacggaaaagaaggtcgcgtctaaacatcacgtgcagcttat

SEQ ID NO: 152 - DNA, 1767 bp, Zea mays
ccgtgaacgaattaatgggcaatcgtggcttttcgcttcttcgtgcgttgcctgcctatatatgcagcgtgatggggggcatgtccctccggcctgggccgttactagcttagctcatatacgtacgtacgcaggaaggctgcaagagagaggagcaatataatggctggttcttcgatggacactgaagctgcaggcaaggagctcaagcagggcagcggcggcggcggcggctacaccatgccggctactgctcatgcggtggacacagactcgtggcagcaggtggggctgctcctggtgatcggcttcaactgcgcctacgtgctcagcttctccaacctcatgatggtgcccctgggctgggcgtggggcgtcgcctgcctgctgctcgtcggcgccgccgcgtggtacgccaactggctcctcgccggcctccacttcgtcgacggccagaggttcatccgctacagggacctcatgggcttcatattcgggaggaacatgtactacatcacctggttcctgcagttcgcaactctacttctgtgcaacatgggcttcattttgctaggagcaagagcgctcaaggcaatcaacacggagtttacccacaccccagccaggctgcagtggttcatcacggccacgggaatcgtttacttcgccttcgcctacttcgtgccgacgatttctgccatgaggaactggctcgccacgtcggcggcgctgacgttagcttacgacgtcgctctgctggctatcttgatcagagatgggaaatcgaacaagcagaaggactatgacgtccatgccggatcccaagccgagaaggtgttcaacgcgttgggcgccgtcgctgccatcctcgtctgcaacacgtccgggctgctcccggagatacagtcgacggtgcgggagccggcggttcgcggcatgaggcgggcgctgctgctgcagtacaccgccggcgccgcggggtactacggcatcagcgtggcggggtactgggcgtacgggtcagcggtgtcggagtacctccccaacgagctcggcggcccgaggtgggccgccgtcctcatcaacgccaccgccttcctgcagagcattgtgtcccaacacctgttcacggtgccgatccacgaggcgatggacacgcggctgcagcggctggacgaaggcatgttctcccgctacaacctcacgcgccgcgtctgcgcgcgggggctcgtcttcggcttcaacgtcttcgtcaccgcgctgttcccgttcatgggggacttcgtcaacctcgtcggctccttagcgctcgtcccgctcaccttcacgttccccagcatggccgtcctcaagatcaaaggcaagagcggtgggagatgtaacagactttggcattggggcatcatagttctgtcctcggctctctgcgttgctaccaccgccgccgccgttcgtttgatcttcaacaatgctaggatctaccacttcttcgccgacatgtagcgagcgagtagtagtgggattgacatgtgtatcgtcaccacgaggtgatagtatggccacttcgttctcaattttttgcttggttcaagagtggaagggtacggtggtcacttagctcatgtttgataagggcactacatgattaataagcatgcatcatgtacgtagtcatcctatcaaaatttagaaaaatgagcttattgtgatcgatggaccacctccctctaaccaaacatctctgttttccgtgaaagcttaaaaggc

SEQ ID NO: 153 - DNA, 5123 bp, Zea mays
atggtcttggtcttctccccccacccgctggcggcgaagtagcacgaggaaggggtccaataaaaaaaaaaatcgccaccggcggcgacggcgaggcggcatcagcggatacagcagcgggagccgcggcaggggacaggcgttgccgatcgatcggcctggcctggcgcggcagaggtcaaaagcgaaaaggaggagccgcaggaatttcttggcaccgaggcgcacgcaaggaatccagcgagtgagggatgggacggaagttttcggattcttcctgctgagtcctaggaactcacgcgcacgagcgtggtcaggagggagaggcttacgcggacgcggcggcgctggttttgatgaggaaagctggagcaaaagagggatcaattggatccaagggtgcgattgatgtgaatagtttatctgtttccacagaaatagcaggaaggccatctgatttaatgatcaaatcttgtacttgcactggaaggttatcatcttcttcagctcataatcttacagacacatatatttcaatgacctgcaaaagctgtactggtgaatcaacagaagacagaggtgggccatcgtgtagcggcaagcttaacaatatgggtttggagctcccaaggcctatagatcttgaggttaaatggatgactgtaaaaaaaaggcaaagggacaccaggagagcaagggcttcctttggcgaagacacaagcagggatggaattggatctttctgtttatctggctgtgctacaaatcaagagatggcgcaagacgctccagtctctgaatctgagaagtttggagtatccattcttggtagacgctttagtgatcccatggaaaatgttcctataaaaaagagaagatttcatatggatttttctccatcacctccattcactccattgctagtggatccatatgaaaagataccgggaagctcttctaaagctgtcagatcatatgagaaacattataagcttaagacgcaacaaattgagtataaggtgggaaacaaaggtcgttttggtgacgatgatttttctggtattgatatactagcttctgctgcctgtgaaagtgagatgagtggtggaatattagatggggagtgctcaacgttagctcacctcccagaagaaaggaaactggagaatactactggtagcagcaaattgagtctattacataacatggaggatacgttaaatattcctggtacttcacattgcatatatgatatgcctcttgggtcttctagatctgctccagatatgaagtccttatttgttgccacaccaactatcttagaaaatcttgttgaatcggcatctgctcccaaggttaattgttcattatattctgcactgaacaatgcaaacgaaatagagattgtttctgatgctaagtctacaagtgttgcaattgcaaacagttcagacaatccagaaaaaactataggatgtttaaaggatacagttgtgcaaaccaaccatgccaatgcgactaatgccaagtctacaagtgttgcaattgcaaacagttcagacaatccagaaaaaactataggatgttcacaggatacagttgtgcaaaccaaccatgccaatgcgactcgtgattctaggctgcactgggatcttaatgttgccatggaggcatggggcactgattgcggtgctgttgaggatcctttagttgctactgtaagtgatcatgatgatgccagaaatgacatgaacaaaccagggacatctcatcattttgagtcaagagatggtagtgtagttgatcactctgttgacactcatatggatgatgcactgaaacacgtgtctgctaatacaaaggatacatgtgattctcctgctgacagtccgtctcacccttcgcgcaacttgcagctattggaatctggatatgtagggagtgatgcccttgctgaaacaatggatttgcctgaccagaagaatagcaggttcgcttcagctatggattcacatattagatctgatccagaaccagctcttatcatggagcattttgcttcagcttcacatgtggagaaaatcaatggttcgcatcccgaacctgttcaatgtgatggtttgtctaatatgtcttctgtgaatgtccatattggaagtaattcactccaaacaagtgaattgggcaccacattaaagcctttggctagcatattagtttctgaggaaagcaaaaaccttccaacagtaggcacttcccataaaaaggttactgactttggctggagtgataataagcttgaagaagcttctgaacaaagcatatctgaatctaagaaccaggagcttttggatgttgattcagaaactagtaagaagggtgaacatgacactggtatattttatgccaacgaaaggacaaaatatgcagaaaatctcattcatccagaggacaaccatggatcttctaattgtgatatggctcatgtacatgaagaaaatggtgctgttgcaatgattaattctaaagactctttaattacttgtgccaacagtagcactgtagagacatattacatttcagatgcagctcctcaggttcctgttcccagttcagaatgccacaaactggaatgttttactgatgcgggcagcactgtggattcaaaatctgcagcgcacagctaccagaatggttgcgaaaatgagcttgggaaggtcatatcaaatgttcgttcagatcaatgctatgaaactgacacatcacatattagcaaaaatctagctggggttgaaaaagtttatgtcgaggaggacgattctcaatatgaggatggggaacttagagaatctggtgattgttattgggtggatgatggttatgaagatgttaaacatgccaactggcattatcaggtatcagattacaagaatgaagaagctactcctggcctcacgtctctccatactgattctgttgcaaataatgtggttattcctgttgctaatgacaatggaccacaatctagaaaggaggacattgctgtttcacctgtgtcatctaagtgttcatggttaacaaactgcttagatggtggatctatagctgatggaaagtctcaaagtattcatttgagaggtgatactaacatgtatgggtcaaacccaagccgtgtagcagttagatctgctacaacagtaagccagtctgaaaggtgcaacgatgccctaggtgatatgttaaatatcagaatgaagaacacaggttgggatatgatgcctgaagatcaaaagcactctcaacatgatgcaagggatgtgactgattcgtctaatcggtgtgttttgagctcagatgcggctagagacgatgattcactgcaaaaaaagggactattgaatagagatcttcaaggagtggaacggcaaaaatcatttgacagaccccagaggaatgaattgagcagatctgacgatggttatggctcaggctcaaaatctggaagggcaatggactctcatggatcgcatgacatgtatggcacatcccgtcatgttcagacaagcgctcgggtggagtgggtggaaagttcaaaacgtcctcgttctactcggcacaaatcacctgaatattataattatggcacatcaggtccaaggaatgctgcagaagctgctgtggcaaagatgcagagcagtggctttgttgttgcacgtgatggcactttagtaagagctgttgatgctgcaaatgctggtcagatgcccagaaggatgcgaaatcctttaagtagctcatgccacctgatttctggatggggttccccagttgacagggatgaagcctgtgggatgtccagaggccccgtgcatgctaggaaagcatctccagagcgtcactttggtgcaaatagtaaccggtccagtcgatatggttctgaaatggagaaaaatcatactactgatgcaaatttgagttctgtccattgctcgctgtccagtagacaacgaggcaccccgacatctagagcatcacttaacctttcccgtgctcacagcagatctccttctgggtccaggtctcgatccccacatgattgggcacctaggaacagaggcaagatcatggcaaatggaggttcaactttatggaagcatagtagatctccacctaatcacatgactaaaggtgaaattggtagaatggcttcacctcggagacaacctggatatgatgatcgagctatgtgttacagtccactatcaagaaacaacacatactccaagaatgcttcgacatgggttgatggaaggaatggttcagcagtggatatttctgatgatcataataaaaggtattcaaggagaagctcacctctgagaattacctcacggaatgacagatttgatgtcatggactcccaaggacgaccaaggtctggagaattctaccgtccgacacaaggaagacttctttatggttacaatagggaaaataagcatggcagaaatggtgaagatggaagggaatgcactgatagatatgcgaataattctgtcaagcgatatgaccggagtggtgcagtaaagcaatttagaaatgatactggtgataaatttcggactcgtatttctgctcccagatcgccagatctccaaaggggggtgagtcctcggagatttgacagaagctttgagaggtagctgactagctggctgtgaatttgccttatagaactaaaatggaaaataaagacctgtctggatgattgagccaggaaatgttgcaaaaccttgatggagttcaatcataggggttgatggaggactcttggcagcactgtttttttttctgcttctgctgcatatattcaaggcacagaaatgttggaccatgcacttctgtacggggaattcagattaacttcataattttcctgtttcagtctgtaaatatttatgttggtagcagaattacaatcactcctttcagctttattatagctgttcttttttttaatttctgatactttatcatgtttgtcccttttgttttttcaatgggtattgtccctgtacgaggtccattttaacatgatgaatcaattaaattttgagctcaaa

SEQ ID NO: 154 - DNA, 975 bp, Zea mays
cgacaagaagccgggagagatgccgctggccacaactgctccgacgccggcgccgccctgtcctccgccgagtccagcagcggcaccagtccggacgcagctcctctcctccgtcgcgaagctcgcgctcacggccgcgctcgtgtgcggctctggcggtcccgctgccgtcgtcgtcgttccggccgccgctcaggccgtcccgttcgtccgtcctcctcctcctcccctgcaaggaaggcccttcgcctcctccactccttacgcgcagtcccagaagctgcagcttggcctcgacaagctcggaaagatcaggccatgcccgtccaccaacccggggtgcgtgtccaccaacccgctgggatcctccggctccttcgcctcgccactgctcatcccggaatcatccgcaggggagaagaccgtcgcctcgctgcggcaagccatcgagaagacgcagcgtaatgtggagtttaaggtcgacgaagacactccatatggacactacatcgaggcggagatggacggcggcgtcggccgggacgtgatggagttcctggtgaagaaagacgccggcgtggtggcgtaccggtgcatggccaccaaggtcaccttcgtctaccccttcaccaccgctgtcggcgactccaagggccagaagcagaggatcgcggccatctcgcaggagctcggatggtacgccccggacatccagtcctccatggactccgtcgacgacgtcaattacgttccgtgaagaattaagaccgtattacgaatcgtcacttcatcgatacgatcgggagcagagctaggggcggatctggttgattttgatgccgatggttcttacgatatgaggcgtgtccgtcttcagctctttataaaagggattcagcttttagctcctcacgtggagcgacttttacagtgaaaggtggtagagctgttctgtaaaatgtttgataaagatag

SEQ ID NO: 155 - DNA, 1447 bp, Zea mays
gcaacgcgtctctctgtaaaccacagtccacagccaccaagatcgccgcgctctctccaacatctcctgaccaaagcgaatccagcatcaccggggtccaggaggcagcatggctgacgaccagcagccaccggcgcaacggtactggttcccgtactggaccgcgcctgctcctcggccggtcgcccgcccgcagctgtcgaggcgggaaactcgcccggcaccgtcacctcctgcaacagcgtcgccgtcgcggcggccgtcgcatccgcaacaggcggcgacgccggcatccagaggcgctggcggtggtgtccctgatccacctgcccagccgcagcccacgcggctgtccagcaggccatcgccgtcgccttcccgcgctcagccactgtcgcccattagagagcccaacgcttcaccggcaccggttgccaaagagcacaagcagccttctcctcttcatcataccgagcatggtgttcctaagcaaaaagacatcaccgttccgcaagagaaaaccatccatgaaccgcttgtagcatccaagacacaaacaaagaccccagagaaagaaaaagacaaggaaaagggaaaggagaaggagaaggaaggcagccagctgcacaaggaaaaagataaggagaagaaagacaaggagaaggaaaaggaaaaagataaagagaaggaggatcataaagataagaaagacaaggatcacaaagagaagaaagaaaagaataaagagaaggaaggcagccagctacacaaggagctcaaggcgggtgtcgccgacatggtgcacacgctcagctcttcggcaccgtcatccgggggcggccacgagcgtgctggctctgcggcggcgggaacaacaatcatcacgctggccggcgagaacaagggcacgtccatgaaggtagacagcagcgccgtagcctacggcacggcggacgcggcgggcagcaaggagcgccgcggccacaagctcgacggcagcgtcatcgtgagcgggaaggagcaagctggggccggcaaagggctgacagctttcgtcaacagcaacgtgcaggtcatcaacaactcgctgctgctgcagagctcctgccacggcggcgacctgggggtgcacctcaagctgtccaccaaggccaagaagaaggacggcaaggaagccgggggcaatagtggctctgctgctgcgccaaaaaaatgatcaaccttcatccatatcgctggcgcgctgcatgcatggctatcgagcaatgactaataattatttgttaagtatcaatcaaaacagagagttggacggacctggttagcgtcgtcgattatttatatgtacaacatggatgtgagttcgcaaaaattcgtgctgaatgatgcctgtaaaacctaacaagatgccaaaatgggctaatcaagcaaccaaatctctgtgtac

SEQ ID NO: 156 - DNA, 1590 bp, Zea mays
agcaggagaagagagacgacacagcagcttttttggtttccccttccctttccccgcgcggtgatcgctgggttctccgcgagcgaggcagagcactgcgcgtcctccgtgaccgcctggtgatcgctgggggttctggacgttggcgtttcatttggttggttggtggttggcagcagccgtggcgagatggacctgatgctgccggtgacggtgaaggaggagtggccgccggaagaggaggaggaggaggacgtggacgcggacgcggacgctccgcggccgatggaggggctgcacgaggtcgggccaccgccgttcctgaccaagacgttcgacctggtggccgacccggccaccgacgaggtcatctcctggggccgcgccggcaacagtttcgtggtctgggatccccacgtgttcgccgccgtgctgctccccaggttctttaagcacaacaacttctccagctttgtccgccagctgaacacctatggcttcagaaagatcgacccggacagctgggagttcgcgaacgaaggattcctgaggggccagaggcatcttctccggctgatcaagcgtcgaaggccggcgccaccgccgccgtacctccaggcgtcgcagtcgcaggggtcgtgcctggaggtgggccggttcggagggctggacggagagatggagcggctgaggcgtgacaagagcatcctgctggcggaggtggtgaagctgcggcaggagcagcagagcacgcgggcgggcatgcgggccatggaggagcggctgcggcacgcggagcacaagcaggtgcagatgatggggttcctggcgcgggcggtgcagagcccagacttgttccagctgctggcacagcagcaagcccggcggagggagctggagggcgcggcgctgctctccgccgcctcccggaagcggaggcggcccatcggcgccgcgccggccaacggcggcttgcagcagcaggaggaggagcagcagcagggcgacgacgacgaccccaccgccacgcgggcgctgttcgcggagctggacgagcgagggaccacgtcggagctggagaacctggcgctcaacatccaggggctcggcaagcgcaggcaggacgggagcgagaagcagggtggccgcgcgcggagccagcagcagggcgggttcgagacggcggagctcaccgacgacttttgggaggagctgctgaacgaagggatgaagggcggtgcggaggctgagacgctgccgccggagaggagacgaccggcttggtacgtcgacgcgctggcgcagaagttgagctccatgagcaataacaccacggcgaagtagagatgatcgcgttaattaatcctatacgactagtaacagtagcttaattatccctccgacaggggtcagtgaatactcttagcgatagctccattgttgtagattatagtatataggagtgggatcgtggtggttacactatgtcattttgtgcagagtgcagacgtgtagtgtatatagtattcttggtacctaccctgtgttgtacccagcgcaagtatattccacagtcgccgggccgtgtca

SEQ ID NO: 157 - DNA, 1186 bp, Zea mays
aaatcaaaccgggaccgggtggcctcttgccctcttccgttccgtctcattctcatccccgacccccgcaccgcagcgtaaaccctagtccccggcggcgaccttgcggcctccgctgcgctctgactggtgcgcgtttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaagtggtggttcagcgcattgatgagaggttatctgcccttggcaattgcatagcctgcaatgaccatgttgcacttacgcaccctgaccttgacaaggagactgaggagttcattgcagatgtgcttggggtcgaggtgtttaggcagactattgctggaaatatccttgtggggagttactgcgccttctctaacaggggtggtttggttcatccccatacatccgttgaagaccttgacgagctctccacgctcctccaagttcctcttgtcgcaggaactgtgaacagaggaagcgaggtcattgctgcaggcatgacagtgaacgactggactgccttttgtggctcggacacgacagccaccgagctctcagtcatcgaaagcgtcttcaagctgagagaagggcagcccactgcgattgtggaggacatgaggaagtctctgatagacagttacgtgtaactggggggccagcagatgtgggtcagagtttgcctttgctaaaagatgtattgcaagctatagtcgaattatcagtagcacaacataaccctctgatatgttcgtggtttatccgtggtttctgaattgtagacttctgcgttgaagctcgtgctactgtttgttttccattgtttgttcacaccaacagctatatgcagatacatggcttctcagtgttacgccggcagatgaataagcttggggaaaaaaaggatgttatcttgaaattgta

SEQ ID NO: 158 - DNA, 2042 bp, Zea mays
ggatagtcgcgtctcttctcatccttcccgtctctcccccgctccgctccaccccgctcaaaaaccctaggcggcgcccgaatcccggatcccgcgtccggctcccccagcgcctccgcccgtgctcggcgtccatcgttgccggcctccccgatggacccagcggggccgcgcgtggccacggatcccgccggatcgggtgccgcaccgccgcgcgaggaattggacaggagaggaggggcgtgcagcggcgccgcagcggcggaggggagcgcgtcgcggctcgcgggcgctggactgggagatccgagggctggaattctggaatcttcaggtcaagcagaagcatatttgcacacatgtaccatggatgtttctcagttgactgctgaaggtgtcacccagtgtggagctagagtgtctttattaccccagattggggcacttcagtcagaaactccttgtctgaccttgggccgtgattccagtgcagaatcaatggagaagctgcatggcagtgagtccttgccatgctgtaaagagaacatcggaacagttcgccaacctaagcctgatccagaacatgttgacaataggatgagtgttgcacgtcttgggttggaccttaacacagtagatagttctgatgcagcagagcttaaccctttcttcccttacaagaagctgggacagtcgaaagtcagtgatccatcggaatgtggcagcactactgctgctacagcagaaagtgagtcacacaggaaatggagagaaatgaagcggaatggctttctttcttcgtctcatggaaatgcagtggtgcctaggccacgtggtcggcccccgaaaaggaaaaaagatgatgaattcaaaaggagcacttccacacagcatggccaggctaacaagtctgttaaggttgctgctcctagtggcctattatctgggctaaaccctggaatcattaaccatgtgagaaatagcaagcaagtttactccataataaaggctatggtacactctgagaggcttgagaatgagaagcagcctgcatttactagtcaaacaggtggaagagggagagaagccagtgagggaattcaggatgagaaatatggtgctggtttcaagaagtgccatatgttgatgaaagacaataatgcggtgtttcaccaagcactgcctaccacatcacagttccttgcacaggacggcgataggctcaaactgcaactctcatcagcagtcactatgtcttcagacagggcctgcagtacatcagctgatgatccagcaactaatcatgattacatgactgtactgtcagtaaaagcggcctctgttgcttctcagtggttggaattactgcatcaggacatcaggggacgccttgctgctttaaagcgcagcaggaagagagtcagaaatgctcttcatacagaattgccttacctaatctcgacagaattttcatctaaccaagagaatgaatcatccattgcaaatacgtgtgatgctggatgtactgaaaaagcagtttcagaagcgcatgtggcacgatggaggtctctgtttgtccagatggaccgagcacttcaggaggaagggaaacagctggagaaccggttgaagcaagtgcaagaaatgcaatcgaattgtgataaaggcctcaaacacatgagctgtgaagctcctctgctaggacctattcctgagctatggaagctgaagaacccagatatttctgagagtgagtgggcggtgcaagctgccgccgcatcaatctactcgacctgcaacatggccatgagaacggagaacgtgccttgcttctgacctcacacttgtagttgtagtttagtttcttgcttttgctgatttttacctcaaaagttaggcctcttttattaccttcagtctttgtgaattgtgaccccttgtccatacactagcggcgagtcatgtaacgaggaagaaacttgatgtatgttgtcaccgtcctacgatttcacgggcccgtgaaagaacacattctttttata

SEQ ID NO: 159 - DNA, 2017 bp, Zea mays
ctctcttcctcgcattcgcatcgcctcgattccacccacccacctccgtccgcctccgagcaccaccaaaccctagatctcgcaccggcggcagccatgtccaagccatggggcagcgtcggcgccggcgcgtgggcgctggacgccgagcgcgccgaggaggaagagcgcgagcaggccctgacctttccggcgcccgagccgcccttgcccgcgggcggcgccgccagcttcccgagcctccgggaggccgccgccgcgggcggcgggggcaagtcgaagaagaagaacaagggtaccacgctgtcgctgtccgagttcaccacctacggcgcggccgcggcccagcggcgcgcggcgcccgtcgagcccaagggcctgacccacgatgagatgctgctgttgcccacggggccccgggagcgctcggccgaggagctggaccgctcccgcgggttccgctcctacggcggcggcagcggcttcggcggccccgggggagagcgccgcggcggcttcgacgacgaggaccgccgcgggccgggaagaagctcggatcttgatatgccctcccgcgctgacgaggctgacgactggggcgccaccaagaagtttaccccggctcccacggactctggccgccgcgataggttcggcggcccttcccctctcggccgtgctgatgatattgacgactggtcgcgcggcaagaagccgctcccggcgcgctaccccagcctcgggtctggaggtggcttccgcgactctccagccttccgcgactcaccagctgcttctgattctgaccgttgggtccgtggcgccacccctttgccacacaacggcgagggggcgggggagaggccgcgcatcgtcctgaatcctcctaaacgtgatccgttagttgcctctaccccacctgctgaggtggcccgcaaccgaccaagcccgttcggggctgcaaggccccgggaggatgtgctggcggagaagggggtggactggaggaagtttgagaatgagattgagcacaagaccagccgtcctaccagttcgcactccagcaggccgaatagcgctcattcctcccgccctgggagccctgggtcgcaggtttcggcagttgggagtgaaggagcaccgagggcacggccaaaggttaacccatttggtgaggccaagccaagagaagtggtgctgcaggagaaagggaaggattggaggaagattgatattgagcttgagcatcgtgctataaataggccagagtctgatgaagaaagaaatttgaaagaagaaatcaaccttctgaaggtggatcttaaggaaatcgagagaaacatgagtaatggttctgaccagacatcggtagatgcaaaaggtttgtctgagaagatatctcagttggaaagccagcttgagcagctttcaagggagttggatgacaagattcgatttgggcaaagaccacgttcgggtgcgggcagggttacagcacttgcaccaactagtttaggggaggaaccacatgctacagtggtggacagaccgcgttctcgtggtggtatggagccaccaccaaggcaggaagaaagatggggatttcaaggaagcagagaaaggggctcttttggtgcaagcagaaattcggacaggccaatggcaaggcagagatggtgaaactgggacaacaagcatctcttagggatatttccggttcccagtccctttttttgttctgaaaagatgggcaaaataagtcgttacttatttgtttgtcgtgtttgcttggtctagaagattgttgaggatggagataactccacatgaagttattggtttgtcaactctatgccgtaggatgttttgcatttccctttttgccatctaccatgtcaaaacgatatcttagcaacctccgatactaactgttatgcttactggattccagttcagcatatgtcactagttgattatttgtgcactgcttagtggaaaccttggatttgcactttta

SEQ ID NO: 160 - DNA, 3754 bp, Zea mays
aatcccttcgctcaagtccttctcctaagcaaagccccctcgcttttggcgtatgcccccgctggcgcgcccatgattcccgccgattcctccgcccgttcagtccagcaacccttgctgctgcagtgctgcggctagttcggtggcggggaaggaggaggaggcgagatcttggagtggggcgaagcggagatgtcgttgccgtcgaacaaccggaggacgtgctcccggagcagctctgcgcggtccaagcacagcgcgcgggtggtggcacagacgcccgtggacgcgcagctgcacgccgagttcgagggctcccagcgccacttcgactactcctcgtcggtgggcgccgccaaccgcccgtcggcaagcaccagcaccgtctccacctacctccagaacatgcagcggggccgctacatccagcccttcggctgcctgctcgccgtccacccggacaccttcgcgctgctcgcctacagcgagaacgcgcccgagatgctcgacctcacgccacacgccgtccccaccatcgaccagcgggatgcgctcggcatcggcgtcgatgtgcgcacgctcttccgctcgcagagctccgtcgcgcttcacaaggccgccgccttcggggaggtcaacctactcaaccccatcctcgtgcacgccaggacgtcggggaagcccttctacgccatattgcaccggatcgacgtcggccttgtcatcgaccttgagccggtcaatccagccgacgtgccagtcaccgccgcgggcgcgctcaagtcgtacaagctcgctgccaaggccatctccaggctgcagtcgctgcccagcgggaacctgtcgttgctgtgcgatgtgcttgtccgtgaggtgagcgaactcacgggctatgaccgggtcatggcctacaagttctatgaggatgagcatggcgaggtcatttccgaatgcaggaggtccgatctggagccgtatcttggactgcactacccagccaccgacatcccgcaggcgtccaggttcctgtttatgaagaacaaagtgcggatgatatgtgattgctgtgccactccagtgaaggtcattcaggatgatagcctagcacaacctctcagcctctgtggttccacactcagggcttcccatggttgccatgcacagtacatggcaaacatgggttctgttgcatcacttgcgatgtcagtcactataaacgaggatgaggaggaagatggggataccgggagtgaccaacaaccgaaaggcaggaagctgtgggggcttgtcgtctgccatcatacaagcccgaggttcgtccctttcccactaaggtatgcttgtgagtttctcttgcaagtatttggcatacagctcaacaaggaggtggaattggctgctcaggcaaaggagaggcacatcctcagaacgcaaacccttctttgtgatatgctcctgcgggatgctcctgttgggatatttactcggtcacctaatgtgatggatctagtaaagtgcgatggagctgcattgtattaccagaaccagcttttggtgcttggatcaacaccctctgagtcagagataaagagcattgcaacatggctgcaggataatcatgatggttcaactgggctgagtactgacagcttagtggaagcgggttatcctggtgctgttgcacttcgtgaagttgtgtgtggcatggcggccataaagatctcttccaaagattttatcttctggttccgatcgcacacaacaaaggagatcaagtggggtggggctaagcatgaaccggttgatgcagatgacgatggcaggaggatgcatccacgatcttcattcaaggccttcttggaggtggttaaatggagaagtgttccctgggaagatgttgaaatggatgctatccattctttgcagttaatattacgtggctccctgccagatgaagatgccaacagaaacaatgtaaggtccattgtaaaagctccatctgatgatatgaagaagatacaggggctacttgaactgagaacagttacaaatgagatggtccgcttaattgagacagcaactgcccctgtcttggctgtcgacattgccggtaacataaatggatggaacaataaagctgcagaactaacaggtttacctgtaatggaagccatagggaggcccctgatagatcttgttgttactgattctatagaagtggttaagcagattttggactcagctttacaaggaattgaagagcaaaatatggaaatcaagcttaaaacattccatgaacatgaatgcaatggtccagtaatcttgaaggttaactcctgctgtagtcgggacctttcagagaaagtcattggagtttgctttgtagcacaagatttgaccaggcagaagatgattatggataagtatactaggatacaaggagactatgttgccatagtaaagaaccccactgagctcatccctcccatatttatgatcaatgatcttggttcctgcttagagtggaataaagctatgcagaagattaccggtataaagagggaagatgcgataaacaaattgttaattggggaggtcttcacgcttcatgattatggctgtagggtgaaagatcatgcaactctaacgaaacttagcatactgatgaatgcagtgatttctggtcaggatcctgagaagctcttttttggtttcttcgacacagatgggaagtatattgaatccttgctgacagtgaacaagaggacagatgctgagggtaagatcactggtgctctttgctttctgcatgtggccagtccagagcttcagcatgctctccaggtgcagaaaatgtcggaacaagctgcgacaaacagctttaaggaattaacttacattcgtcaagaattaaggaacccactcaatggtatgcaatttacttgtaacttattgaagccttctgaattgacagaggaacagcggcaacttctttcatctaatgttctctgtcaggaccagctgaaaaagattttacatgacactgatcttgaaagcattgaacagtgctatatggagatgaacacagtagagttcaaccttgagcaagctctgaatacggttctgatgcaaggcattcctttgggcaaggaaaaacagatttcaattgaacgtaattggcctgtggaagtatcatgcatgtacctttatggggacaatttaaggcttcagcagatcctagcagactatctagcatgcgcccttcaattcacacaaactgctgaaggacctatcgtgctccaggtcatgtctaagaaggaaaacattggatctggcatgcagattgctcatttggagttcaggattgtccatccagctccaggcgttccagaggccctgatacaggagatgttccagcacaacccaggggtgtccagggagggcctcggcctgtacataagccagaagctggtgaaaacgatgagcggcacggtacagtaccttcgagaagccgacacctcgtcgttcatcatcctgatggagttcccggtcgcccagctcagcagcaagcggtccaagccttcgacgagtaaattctgaccctcatgctgctggaactgcagcgagtgttctgccgtgtcgaagtctcggttgtagctagccaagtggctgctactgaaacatcggttggtcggttctggtatctagcacggcctgtgtagtgcggatagatttggttgtttggctttggaga

SEQ ID NO: 161 - DNA, 1958 bp, Zea mays
atcctcgcacacggcaggcacgtgaccgacacccccagcgcacgaactccaaaatagcgagccgaagggggccacgaccacgagtcctccacctccctctccgccgcgtcgcacgcgcttgacgcgcgccgagagccgaatcggagccacgaggcagccgccccgggcggatcgatcctagggccagggcatgggcggaggggacgccgacgccggcggcgagcccgcggacgcgcaggccacgctccacatccggtgcaccaacggctccaagttcaccgtgcggaccgacctgggcgccaccgtcggggcgtttaaggcgatcgtcgcccacagctgcgacgtgccggcgccgcagcagcggctgatctacaagggccggatcttgaaggacgagcaaaccctagccagctacggtgtggagacagaccatacaatccacatggtacgtggtgctgtgctatcaccaacatctactgcacctgcagccaaccaagaacctaccactgctgctcctgccagttccccggcaacaggattgggtggcttgttgcaaagtctgggtactacaggcgctgctgctaacagtgaggggttgtttggatctgccccccctggattagaccaaatgcagcaacagctagctgaaaatccgaacttgatgagggaaatgatgaatatgccactcatgcagaatttgatgaacaatcctgaactcatacgcagtataataatgaacaatcctcaaatgcgcgagctcattgaccgcaatccggatcttgctcatgtcctcaatgatccaagcattatgcgccagacttttgaagcagttcggaatcctgaactcatgagggagatgatgcggaacacagacagagccatgagcaacatcgagtcttctccagaaggattcaacatgctccgtcgcatgtatgaaactgtccaagagccttttctgaatgcaacaacaatgggtagcgagggtgatcgaaattcgaatccattttctgctcttctaggaaatcaggggtctaaccaagcaagagactcagctgcaaatggaacaactagagcttcagaccccacatcagggtctccagctccaaatactaatccacttccgaatccttggggctcaaatgctggctctgcccaaggagcagcaaggtcctctcctgctagcaatgttaggagtactacagcaagtggcctaggagggttgggttcagcagatttgggaagtacgcatggtgccagtggtggtggctctgatgctaccttgttgactcaagttttgcaaaacccaactatgatgcagatgatgcagaacattatgtctaatcctcagtccatgaatcagctgcttaatatgaatccaaatgtacgtaacatgatggaatccaatactcaaatgagagaaatgattcagaatccagaatttcttcgccagttaacatctcctgaaacattgcagcaattaatttcgttccagcagtctttgatgtcacaacttggccaacaacaagctggacaggagcggacacaatcaggctctggtgcaggcaatgtcaacctcaacaccttgatgaacatgttcagcgggcttggtgctggtggtggcctaggtgttccaaatgctcctaatgtgccgccagaagaactgtacgccacacaattagctcagctccaagaaatgggtttctttgacacacaagagaacatccgagccttggccgctaccgctggaaatgttcatgctgcagtggagcgacttcttggaaatatgggctaatagaatatgatgatcataactgtactcagatattgtgatttttagttggcattgtgagatcatgtctggctcattggttttacacccgagggtgagaggcggcgtctagattttgtgttcaaggatgaataaagagtgtaccgggggaacctttcatatacatatg

SEQ ID NO: 162 - DNA, 4031 bp, Zea mays
tacgcttccacaatgggtgatgcggattctccgtccaatcacggagacggatttcgccgcttcgctgttcagcaggccagcaggcagtagccgcttaaaccctcgtccccctttcctcctcttcccccaaaccccgctctcctccgccggtccgcccccgccatcgcctgcactcccccggcctccacaataagccgcatcttgcatcacaccgacgccctaatgctctcgccggcctcctctcgctaggccgcgccgcggacgagcgtcccctgcacctgcacacccgcgcgaccgtgctcgcgcctgctccgcgagaaaacggcgcccctcggtttctgcttgtccttgtccgccggcggcgctgcggggaggagaggagccgggtacaacctgaggcggtccgcacggtcgatggtggcggcgcaggtgacgccggcgccactgctgcggcgccacggctcggcgcccccgtggctgtcgtcgtcgccgcccttcctccttcgccgccgcgcctcgtcgcccttctccctgcaccgccgcgcctcgccgccactggcgatttccgggtgcaggaggcaggactattcccattgctcagatatggctgttcgaggaagcagtgctttcaagctacgtttctatcccaacttagaagtacaaaatattgcacaagaatgggttaaagagagtcggaggctgttctatctaagaactgccaacaatgtcacaaataacatctataagggaaacactcctctatggactggaatggtacaaaatgaactctctgaagattgcaggggtttgaactacacttatttgaataatttgagggaacgcgtatcgtccaaatcaattgtaaatagacatggtaataaccgagaactgatcgggcatagtacgataaatcagcatgtgaaatcagtgccagctccagtacgtgttgttaatgatagtgtcaagtgtttcagcatgcctagagcctctaaggtggagattccttggcctgcctattcaccagcggaggatcctttgcttgataaatctaatacagaggtaattttggagcttgaggataaagttcatgatggtgatgacaaaaagaaaaaaactgttgtaaaaaaggtggtttcacctttcccaactaaagcggccttctctgaggaatctttgaaagcacgggaggcacttgctagcatctacgacaaagttttggtagttgacgatatcgagtcagctaggaacattgttaaactgctcactacaaagtacaagagctttattcatgcatgtgacacagaggtagcaaatattaatgccaaagaagagacaccagttggtcatggagaagtaatatgctttagcatctattcagcaaattctgatgtacaggcagctgattttggaaatggcaaaacttgcatttgggttgatgttctagatggtggaaggggtgtcctgatggagtttgctcctttctttgaagattcatcgatcaagaaggtttggcataactatagttttgatagccatgtcattgagaattatggaatcaaaattgctgggtttcatgctgatacaatgcatcttgcacgcctttgggattcatcaaggaaaattgatggtggatattcacttgaaggacttacaaatgaccgtagagtcatggatactgttccagaggatttacctaagcctggaaagacatcaatgaaaaccatctttggcaggaaaaatattagaaaagatggatctgaagggaaagttgtatctgttgagccagtcaagaagttacaaagggaagacagagagttatggatttgttattcttctctagattccatgagcacattgagactttatgacagcttaaaaagcaagcttacaacaaggagatggatcttggatggttgtcctaggggcaccatgtatgatttctatgaacagtactggcgtccttttggtgccctacttgtgaaaatggagacagagggaatgcttgttgaccgtggttacctttcagagatagaaaaggctgctattgctgaacggaaacttgctgcagataagtttcggaaatgggcatctaaatattgtcctgatgccaagtacatgaatgtgaatagcgatattcaaattcgccaacttctctttggtggcattgaaaatagacacaaatctggtgaaacttggccacatagtaaaacttttaaagtgctaaatgaagaaagtgttgctacagagggtaagaagacgtcaaagtatcgtacaatcaaactttgcagtattgttgaagatctgaaaatcgatatgttcaccccgagtggctggccaacagtcagcggggatgcattgagaagtttggctggtaaaatacctacagaatatatttacacaatagatgatattcaagatgatgatgaatataccagtggttcagaaaacccagatgggaattcctcttatggaacagcatatgaagcatttggtggaggaaagaatggaaaagaagcatgccatgcaattgcagctttatgtgaaatatgttctattgattctttgatatccaatttcattcttccgttgcagggagatcacatatcatgtgcagaggggcgcattcactgttcattgaatatcaatactgagacagggcgcttgtcagcaagaacaccaaatctacagaaccaacctgcccttgagaaggataggtataggattcgccaagcttttgttgcagccccgggaaattctcttatcgttccagattatggtcagctggagcttaggattttagctcaccttactaattgtaaaagcatgctgcatgctttcaaggcgggtggtgatttccattctaggacagccatgaatatgtatcagcatatccgtgatgctgtccaagaaaagaaagttcttcttgagtggcaccctcaacctggtcaagagaaacctccagtgccgctattgaaggatgcttttggcgctgagaggaggaaagctaaaatgcttaatttttccattgcttatggaaagacagctgttgggctatcccgggactggaaggtttctgttaaagaggcaagagatacactgaagctctggtacagggatagaaaagaagtgttagcttggcaaaaaagtcagaagaagcttgcaagcgagaagggtgaagtctacactttgcttgggcggtcgcgccattttccttacctgactcagtatggtcctggccaacgaggtcatattgagcgtgctgctataaatgcaccagtgcagggaagtgcagcagatgttgctatgtgtgccatgcttgagatcgaaaggaatgtccgccttaaggagcttggttggaggctcttattgcaggtgcatgatgaagtgatactggaagggccttcagagtctgctgaggtggccaaggctatagtggtggagtgtatgtccaaacctttctacggaaccaacatcttgaacgtcgacctggctgtcgacgccaagtgtgcaaagagctggtatgctgccaaatagactgaggagacgctgtcacctgccacaaggttgatgacaccagtgcaatcgagaccccactgttcggataaaaaatggtggacccgtcgtcatgcagactgcggttccaggaccttgagtttgttgtggtggtaacccaggccctgacaagacaacacgcccatttcttggctgcagcagaacagcggaagacacggaggactctgctgccagcacctggagttgcgcggtgccaaagcataccagacagaattcgagatggcttggatctcgagtgaactagcgcggtgccaaagcatgctgttttgttcataatctcacttgttcagcgtgctggtgcgttaggttagtttacagatttgttctggtgcagtgaggccaattatggtccctgcggttggtatcgatcttggattgtgcattgcatgtagtaccatactgcatctacactgggaccatttttcagataacagaaacattcagcttcatcctcgaaa

SEQ ID NO: 163 - DNA, 1296 bp, Zea mays
catccaactccggctccatgccgctccaacccaagcagccagcagctgcagcctgccctcctctccgactccaacccaatccaatggctctccgcccctgttgtctcacctcacgcgctctctgccctgatctgccgccaggcgccagaacgacgcgctgctccgcaccgcgtcaggtagaatggtagatggaccatggacgatatcgcttgggagcggggaaggaacgcagacgactcttcccgtgccgtgctgacgccaccacgcggccccggtctcctctcgccctcctctccgtctggatctggtcctatcccctccgccgccgtccttgccctcccggcctcagccacgagccagagcgccgggctcctggcctcgtctcgcctcgccggcgacatggacggaggcggggagacgctgctggtgcggaggagcaagggcaagaagagaccgcagccggcggcgcccgcggaggagggctccggcagcgggggcaggttccgcgcgatctggcgggactaccacgacctgctgcaggagactgaggcaaagaggaagaggctggcaagcacgaagcggagaagcctcgccttgcttgctgaagtcaagttcttgagaaggaagtaccagtcctttctgaggggtggctcgcagcagacacattacaggttgaagaagcaggctcggtacatgccatctccattgggaagcaataaggctgcagcgttagccgatcatggtgcaggggacccaagtgccttctaccagcaaaaactcaaaacttgacttgaatcaagactctgttctggcaagtgatggagttcatgaatcgacataaaatgtacaagagaagtgtttttatggcaattaaaagggttttcttgtctgcagaatgatggcatccataagtcgaaaagtttgatcaggtctcaaattatcagtttgtagggataaaggaaactctcctgcaattgaaggtaagaggacggttccatggcaagaccggctagcgttgaaggccgaggccctcagttgatttggccaagaaataagctgcttctctgatagctggctttgcaacagtatccctcagatgcacagtaatgctttgtatagaacaataggacacgatagttatatacatgatacattgcctaattgacaaactcagatggttgcaccatgctcctaagcaagttagacaaataaactgtgattttatgaatggttctgtccagattttggattgactgctttgaacatgccaaatgctttagcatgaacaaggacaaa

SEQ ID NO: 164 - DNA, 2346 bp, Oryza sativa
ctctcttcaactgctactagtactatctcctcccgtctcgtgctcttgcgcgcccccgcatctctctctcctcgcctagggtttcacgccctccgatcccgcggcggcggcgaagcttccactcgcctcggcggcggcgccggccagggacatgggaatggaggttgttggaactgaggctgcaccagcagaggttaaagtaactgatggagaagtgaaccttttccaagagaatgaaagtaaagcaactgccaaggaacgtgaggaggcggttctttttggttcagataacagcacagctacagcaaatggagccgcaaatggcgctgatttggcacccccaaaggatgcagaggaggactggcctgaagctaggaaaacacatagcttcttctttgtcaagatccgcttacttgaggaccctaagctgaaaatgaagattgatcaggcagaaaaggacttccagaagaagattcaagctcgttctcaaatttttgaggctataaaagccaagaagaatgagcgcttcggtattatctcagagctgaagccattggctgctgagaacaagcaatacaacgaagccgtaagtgagaagttgaaggcgatagaacctcttagaaaccgtttaggaaagttccgcgatgaaaacaatgctatccgggcacagggtgcaggcatatgttcttcaattgaagagcttgagaaatcgatcaagagattgaacgaccgcatatctcatgagagcatacccttggatgaggagaagcggttgatcaaacagattagagagcttgaaaagaccagaccgaaagtcatctccacttctgctaaccgagctcaaatccaagatacagtggtcgaaagagacgccatacaggatcaggttaaaatcatcggggagggcattgatggagtaaagaaggagcgacaagcagtcaggtctaaaattaaggtcctggaggatgagctaaaggctattgacatggagatgggttcgcttcaagaagatttaactgctgccaatgccagaaaggacaaggcacatgaatcattggtccaattgagacatgcacgagatgcctataacgcatcattccatcaaaaccgccaacttctgagcaaagctagggatcttgcttctaggagtgagcttgcacaagtgcaagagctctacaagacacaggttgacaaattcgtggcagaatggtgcaacagcaaggccttcagagaggactacgagaaaaggatcctctcctccctcaacagtcgacagcttagccgagatggccggatgaggaatcctgatgagaaacccatatttattgaaacagaggcagcagcaccacctgtagaacaagagcctatccaatcaaaaatgcctgcaaaacaagccaaggaagcgcctgctccccaagcagaggtttctcccaaagatgagtcccgcgtgaaagcaatagctaagccatctaaggctaaatcctctctggatgctgatgatgactatgaggccgagtctcccaaggagaagccaaagcctaaagaggttgatgtagctaagttgaaagagatcaagagacaggaggagatggagaagaatagacttgccctggaaaggaagaagaagctggccgagaagcaagcagcgaaggcagcagcccgtgcacaaaaggaggcagagaagaaactcaagagagaggagatgagggccaggaggagggctggggcagctgacaccgaggcgtccactgaatcggacaacaggtctgatggagcagcggaggcacaagcagaggacgactccgctcctgcttctgctccggtgatgagagaacagagggagagtgtccggtacagcagaaacgtcgtgaccaagagcaaggccccgctgccgaaggcgatcctgaggaggaagaaagcccagtcgtactggtcctgggctggccctgctgctgcagtggccgccgcgctcgtcgccctgcttgccgtgctaggctactaccagtactacctcccagcgagcgctagcaactgatggaaggaaagcaggcagcccccccttgagaattgcttacttgaacaattttgcaggtgagaaacagagtgcgtggtctgctgagacgtggactgaaagactggagatttgttcgttttcgttctgttagtttgatgatcggtggataagagtaaggaaaaaaaaaggatagaagttaattttggttgggacttagaatctcctatatactgcgagtgatctcatgtactcttaaactgaagcataggttgccgttctgaaataaacaatgccgcatgctttaggtttacttatctgttcctatgagccag

SEQ ID NO: 165 - DNA, 2027 bp, Oryza sativa
catctcctctccaatctccatccacatcgcatccatcataaatcccccacacccttctccccaaccaagcacctaccaccattcccaatccccctcttccaatcgccatatgcaagagccccaaatccgctattgcatttgtttcatttcatcggctgccgctcctgagaaacagcaatctggataggataggtggtcgcctgtatttagatccggacttttgctagtggggggagagaggatttaggtgaacgagcatcttgattttgaccaatctttgcctgtctcactgattgaccctcctcctgtgtgcttggttctttaaatcccgcgtggtgggtgtggggaagaggagaggagggaggcaaaggcacgagcaagaacagctgcttccgtcttcttgctcgctggtattcaaaaggaactatcaaggtgttgagtggagatattgggggcaaagtttggattttggaggttattgtttgctttccattggctaaaaatgttgaggcagagctctagtaggaatcacaggtccaaaggtctgaagctgaagaaggctcttcagataaccctcttggttctggtttctgtttggttgatataccaagtcaagcattcatacgagaagaaggcatatcatgaaaatgagcccaatgacctgcataaagatgatgatcaaaaccagggtgagatcagattaggcaggaaggacctgcctactaagctggaggctgactcatcaacgctggatgaacggattgaggatgaagagaatgaagagatggagcaagaaatgaagcacgatgagaatgatgaagaccccattgatgaacctgacctggacaaagatgatgatcttcctgagcctggcgagcactctgctgataaggatgaaagatctgaggatgtgggtgtgtttgaggatgaagagcggaaggagcggtctcaggaggatcaagagaagacctttcatggggataatgtatcaagtgctgtcagtcatgaccctccgtcagcagagcaagatgagctgcttcgtcatgcccaagacaaaatattatatgtggatgatgcttcgacagcagtgcctcatgacaaccaggaagctgaacgcagggaggaggaagctcgcaaagctagggagatgactttcagaggcgatgatgtgtcaagttccgtagatcatgatgcccaagtgacaaaacctctcccagaggagcaattgaagagcatggatagcatatttgaaggcaccacaaatttatcaaacggaataacatttcgaggcccaggagtgaatgaatcaactgctgctagggagcttggggctattccagctgatgcatcttcccatccaaacactagcactgtttcagaaagcaatactgatacagctccggtaaatttggatggcaaccatactggatcagatcaagctaattcgacctctttgaaaggtcaacaagagcagcaagcaaattcaacggatgtgttgaacaaccagataaaactcttcattgacctcacatcagctgctgagttgaattatcgaccaaatgggaccctggcttcggcttcaactgatgctgaaaatgccacttctgtagatagaggccatgatggtaataccggaaccaataaggctgaggaaggagatacaggcaaagacttagatttatcgacaaaaatcatgaacaaggccattagtgaagatgaagttgttcttgaatgataaggagatctctcaggttagcttctggtgtaacctgtaagtctgtaggaccttaagagaaggagaagaaactagtcttctctttctcagtagacttggagatgcaatacaagtaaactatctctattgcccccccccccccttttgtataaatttgatagagatatgctatgtattgcctagcacatcatgctctgggttgagtgatgcgcaaaagggcttgttatggaagtaatatatagccattcagcagctctgaagctttgctgctgcaatgatatttcaacttgtc

SEQ ID NO: 166 - DNA, 515 bp, Oryza sativa
cctgccaggtgcttctgcgtcgcttgccgtgctcggtcattcctgcgatggcatctagaggcgccgtgttggtcgccgtggccgcggcggtggccgtgatgttcgcgtcggtggcgtcggcgcaggtggacgggggcgtgccaccggcgccggcgccggtcacgggcgcggccgcggggggcgcggcgtcggcggcgctggccgtggcgtgctctgccgtgctgtccatcctcgtcgcgggtgggatcatgcactaggcaggcgcgcgaggtggtgatggatggaattggttcgttgatgatctccgatttggacacggctcgtttcgagtcgtttccggctatagagtagtactagtagcagtggttgggttgggtgcgtttccgagtgaggcatgttgtgtttatttcttattcatttgtatcatacattggtctgtgtgtgtttgtatctctcttgttgctgtggattctatgaataaagatggatgatgtgtcttcgtctcattcgtcact

SEQ ID NO: 167 - DNA, 1611 bp, Oryza sativa
gtttcaagtccgtagttgattagtactagttcgaccagtagtttcgccctttccccccttcttccaccatccactaacccccatctcaacgcaaaccaccctctccgccgcgcgcgcgaggcagatctcgacggggagcgcagccgccgccgccagatcccgccccgatcgcccccgcctcgtccccacggtcccgtggatacctctctctctctctctctctctctctctctctctcggatcggtgcgattgcctttctttttgcgcggcggggatcgggtgtgttttggggacggtgaaggagaggagtgaagtgtggaggcgaatcgaatcgatctgattaggagacctgccatttctgtgcttgattttgtttcgatctgctccttgggctgtagatctggaagggcttcgtgggatctgctgctcgagcttcgtgagttgcacaggaaagtcttgggcttttgcgctcagctccaccaccttcacctgttcctcgggccatggctgctctcgtcatctcgaagcagcgcagtcaccagcagcagtcatccgatcgccggaggaagccatcgtcgcacttcgcgtcaccccagtccatgcgtggcttcaatgctgtcaactgccgagccttccactccagcgtcagcattggcatcctgccatccccgcctccacccccagcgcgcacctactcctccccggagccgaagacgcccaagtcgcagccacaccacgggaagaagcggagcagggcaatatctataagcccttcaacgtctccgccatcccggcctgagctctgggctggccccgctttctcaaactctccgcctcccagctcgctgccgatacccaagttctcactccaccagaagcgcagtgtttcactcgagttgccacctgctggccgatcagatgatgtggtggtgcctttgcatgctaagtcagcgccttcgtcgccaaccgcaggctcaggtgtcagcttctttagtgatagtgatactgctatcgcgactgagaatctgaggagaatcctccacctgaaaatcgctgatcactgaatggatgatgggcaggtccttgtacataggctatctgcaaactaaccttggtagtgtgtatagagtaaccgagaatggccatctttcacctggatggtggttctgcatagttcatcaacaggaggtacttcaggcaggcaaagcacctcaagtatgcatggcagcgtgaaactgcggtgaatgacttggtggtgagactgttggttgtctggatgagagcacagcagtttctgggtagcctttgtagcttgtggtcacctctatgttactaatgttctttcagccttttgggtattccttctttaggttttagatcaccattatccatggtctcacatcattaacctttagtcgtagtctgtccttgttcctggtagttcatgcctggcagggtatgatagtgtcttagtactgttcaaatgcttagatgtctgcatctgattatctggcagctatccatgtgtgaaatatctgtaggatagcaatatcttgcagtggatgcattttgcttcaccttgtagacattccttggttcctctggctcac

SEQ ID NO: 168 - DNA, 720 bp, Oryza sativa
aaacccaccacccgcgcgccgcccggcgaccaccaccaccaccattaacgcttaaaccacccaccaccaccaccaccgagcaagcaaacaccaaaggcaggcagggcaagaggcgaccgaatccgaaggagccaatggcgaaatccctactggcggcgtccgcgctgctgctggcgctgctcctggcggtggccgggggagcggcggcggcgggggaggtgccgctcgcctgggagctcggggtcggcggcggcggcggcggcggcgaggaggacagcttcgggttctcctccgaggatgcggcggccgacggcgccgcggtggtgaggcgggtgctgcaggggcaggggtacatcagctacggcgcgctgcggcgcgacaccacgccgtgctccgtccgcggcgcctcctactacaactgccgccctggcggccaggccaacccctactcccgcggctgctccgccatcacccgctgccgcggctaacccacctccgccaccacccgctgctctgctcaaaccgggattattcaaagttcgtttgcctcgtcttctactttttctttttctttttcccccccttttctttcgtttccttgtcgctgttttaaccgtgaaagaattggtctgggtcggtgcccacgaatcgaatcgagtgagaactgagaagaagatgtgtgccccctgtatattgcgattggattcttatattattatg

SEQ ID NO: 169 - DNA, 802 bp, Oryza sativa
tcacacgatggctatatttcgtcggcttattgaaacagcggaaggatgatgatgatgatgatgtcagcagcatcatcccccagctgcctcctcctcctcccccgcccgaccaaaccaacaccaccgctgctcccctccacctcctcctgccgccggccgcctcgctgccggatcagatcccttaggccggagaacccggcgccgcccgccgcaggagtagcgagagcggtcgcctcctcgtcgtctcccatggagatggaggcggcgcagacccaggcgtgcggtggcggggaggggcagcaggaggccatgaggctgctgttcgtggagatgggcgtcgggtacgaccagcacgggcaggacgtcaccgccgccgccgtgcgcgcctgcagggacgccatcacctccaactccatcccggccttccgcagcggatccattcctggggtgaacacggagcagatgaagctgcagatcaagctcggggtgccgaggccaacgcagcacttgctggacgttgagagagtcaaggccgtcttcccctatggtaaaattatcagctttgaggttgtggacggtgggatgatctgttcaagtggcgtatgcctagaagcaatgggagataaaaacgatgattgctatatagtgaacgcagcagtttatgttggttactaatattatctcgatgaatagttcctcttcgttggaacagtaaaaagacagaaaaatgttgtgcgcaataagcatgtcctgaattttctgaatcatcttttcttaatgtgtacaagtgcttatttgctcc

SEQ ID NO: 170 - DNA, 2051 bp, Oryza sativa
gtgtgcgtgcgagagcctacgcctacgacgccaaacacggaaaccaccacgcacgccgagacaaatcccacgataccccgagaaaagcaaaagccaagcccccctctcactcccttctcctcccgccgcgccgcgccgccccgatacctcgcttcttctacaagcttccattcctcggtcggtgccggccgcttcgggcgcgcgtggaggtggttgctgctgctgctgctgctgggggcggcagaagctagtggcggtgggtgtgggatgcccgccgcgacgccgacccgctctcgcctcctcttccccgcgttgcggccgcggccggtggtggttaaagcggacgggggaagcctcgccgctgccggtgactgactggctgactgaccgactgcgccgccgcggtgcggtgggaccacgcgcgacgccatggacgccgcctcccgccccgccgtcgtcatcgacaacggcaccgggtacacgaagatggggttcgccgggaacgtggagccctgcttcatcacccccaccgtcgtcgccgtcaacgacaccttcgccggccagaccagggccaacaccaccaaggggaactggatggcgcagcacagcgccggcgtcatggccgatctcgacttcttcatcggggaggacgccctggcccgctcccgctccagcaacacctacaacctcagctatccaattcacaatggccaggttgagaattgggacaccatggagaggttctggcagcagtgcattttcaattacctgcggtgtgatccggaggatcactattttctgctcaccgagagccccctgactcctcccgagacccgcgagtacaccggggagatcatgtttgagactttcaatgtgcctggtctgtacatagcgtgccagccggttcttgccctcgcagcaggatacaccaccacaaagtgtgaaatgacaggtgttgtagtcgatgtgggtgatggggctacccacattgttcctgttgctgatggttatgttataggaagcagcatcagatcaattccaattacaggcaaggatgttacccagtttattcagcaactcttaaaggaaagaggtgagcacattccaccagaagaatcttttgatgtggcaaggagagtgaaagaaatgtactgctatacatgttcagatattgtgaaggaatttaataagcatgacagagagcccaataagtacataaagcactggagtggcatcaaaccaaaaactggtgccaaatacacctgcgacattggatatgaacgcttcctagggcctgagattttcttccaccctgagatttacaacaatgacttcaccactcctttgcatgtagttattgacaagtgcatccaatcatccccaattgacacaagaagggctctttataagaatattgtcttgtccgggggatcaactatgtttaaggatttccacaggaggctgcagcgggacctaaaaaagatagtggatgcacgagtccttgcatctaatgctcgacttggtggagatgcaaaggcccaacctatagaagtaaatgtagttagccatcctattcaaagatatgctgtctggtttggtggttctgtgcttgcctctaccgctgaattctacgaggcttgccacacaaaagcagagtatgaagagtatggcgcaagcatctgccggacgaatcctgttttcaaagggatgtactaaaccacggcgcaaagcttctgtagacatcaccagtggcacccccaacgcgatccagctgcactgcccagcatggtacaactgacgttggggaccgagggggatcctgcagtagcctcgctgttatgagttgtacaaatctagcaggcgcatagatagatccactctttcggtaatacattccacatgttcatcagtttttgctagcctagcagcaaaaacaatatgaccgaacggcatgggcaaaatatatgtttcatgctgctgtataatctttgttggtgacggtgtagcattacgacattgttttttttgttggtgatttggttttgatcttt

SEQ ID NO: 171 - DNA, 668 bp, Sorghum bicolor
gcggccgcctgcaggaaaaacacacagcagcagcctcgctcaccacaaacacagtgtgtaagcaaactgattcacactagtggagctagctagtagaggttgttaataatcaccaaacgatacgatgaggccactccttgtttcgcttgctctgattttcgtggttgccggtgtggcgcatggcgccggggagtgcgggagagcctccgctgacagggtggcgctgaggctggcgccatgcgtctcggccgccgacgacccgcagtcgacgccgaccagcagctgctgctccgccgtgcacgccatcgggcagagccccagctgcctgtgcgccgtcatgctgtccggcaccgccagggctgctgggatcaagccggaggtcgccattaccatccccaagcgctgcaacatggccgatcgccccgtcggctacaagtgcggagattacacgctgccctgaccacatcgtcagcaagccggccgtgtgcagtgttatgacgggctgatgaacgagccacgcaaggcgttgtgttggaaaagtcgaatccgctagaataaataagtacgtggacgatgggctcttgctgtgtcactactggactttgcttgtgttgtatgtcaaaaataataataaatatgttccgttccatattgcttgtgacactata

SEQ ID NO: 172 - DNA, 749 bp, Sorghum bicolor
ttagccgcgccgacgcccaccagcacctgcccccctcgccgtcgccgcctcgcctcgcgcgaccgatccaccgccgcggccaccatgtcgctgatcgccggtgaggacttccagcatatcctgcgtctgctgaacactaacgtggatgggaagcagaagatcatgttcgccatgacctccatcaagggtgtggggcgccgcttctccaacatcgtctgcaagaaggccgacatcgacatgaacaagagggccggcgagctgactcctgaagagctggagcggctgatgacggtcgtggccaaccccaggcagttcaaggtgccggactggttcctcaacaggaagaaggactacaaggacggcaggttctcgcaggtcgtctccaacgccctcgacatgaagctcagggacgaccttgagaggctcaagaagatcaggaaccaccgtggtctgcgtcactactggggcctccgtgtccgtggccagcacactaagactactggcaggcgtggaaagactgttggtgtctccaagaagcgataagctagcagcggcttatggcaacagcagcagtgaacaagccttaccttccaacatatcttatgaaaggtttctgtttagacagtttcctgaaattatgttttgccctaggataatcttgcagttatggaaccttaatatattgtatcctgcaatgtgttttttccaacttctaagagtaattttattttgaatgagacttctgctga

SEQ ID NO: 173 - DNA, 1026 bp, Sorghum bicolor
aaggcatcagccggcagtacccaacatttctcacaaaaatcctcgcacaaataaaagtaaggggaaaaaaattctcgtctccttcccccagcttgccagcagccgaagtcggcgagcgagagccagcagccgaagtcggcaagcgcgagcggcgatgggatcgagcgaggcggagaagccgctgcgtcggatcgcggcgtcgttcgaggagctcgccgccgtcgccaagcagcagcccccggcgtccatggacgcgggggccttttcgcgcgcctgctccaacgtctccgtcctcttcggctgcctcggcatcgccttcaagttcgcggagatggactacgtcgccaaggttgatgatttggtggaggcgtccaagtcaattttgacattgccttctatggttgagctagacattcagactgacactgtcaggaaaccagggagccatacaaggaatctgcttagagtaaagcgtgggattgatatggttaaagtcctctttgagcaaattcttgtcacagagggcaactccttaagggatgcggcatcagtagcttatgctcaggtttttgctcctcaccatggatgggcaataaggaaagcagttgctgctggaatgtacgcccttccctcaaagtcccagctgttgaagaaattgaatgaagatgaggaatcagcgaaggttcaaatgcagaactttgtcaggtcatcagctccagtaatctgctatgttgatgaccttttcacctcaaggaatttgggcatagattggtgaggaaaactatgcatacatttccttgatgtactaatcgagtcagatggtgtgccgtgagctgggctcggaaaacctttttctggattccatgtctccaagttgtaaccaaatctataagtttcggtctaaaactacttagcgatcctattatggagttgttggtgatggttcttgagtacgcatgtgacacatgcatagatgatgagaaaatatacgtgtcggctcattgaaaaaatttctccttttttccg

SEQ ID NO: 174 - DNA, 861 bp, Sorghum bicolor
gccatcccccgaaaccatccgtcacatatacaactcctccatcccaattcccattcccaggcgcagcgcgacaagaagaagatcaagcagcagcagcaaaagctagcggcaaggcaaggagatcaagagaaatggcaacggcggcggggagcatccagcagggccacggcgcccggttcgcggcggcgtgcgacgtgctgagccggtacgtgaaagcggcagcggcagcgacgacgacgacgccggtggagcagccgcggccgttgccaggcacggtagtaggggtggtactccctctgatgcccggcgcggacctgtccacgcaagcagaggagctggccgaggcggcggatcaagcggggccggcgccgagagcgcagcagctgatgaccatctcgtacggcgggcgtgtggtggtgctcgacgacgtccccgcggacacggccgccgagctgctccggctcgcggccgccgccgccgcgccgcgggtgctgcgagcgccggatgatctgcccatggcgaggaaggcgtcgctccggcacttcatggagaagcgcaagggccgggtcgccaagcgcgcttcgccctacagccgtccgggtgatgctggagccgccgcggcgtcgtcgttcccggaccatctcgccctctcgctctgagacaatactagtacatacagtacagtttgtactacccctatactctagtaggtgtttgttgattgtacaggccggggaaaaactctactatttcagttctgaggctttgtttagatctgtagcactttcatttttatttgataaatattgttcagttatagagtaactagacttaaaaagattagtcttgcaatttacagac

SEQ ID NO: 175 - DNA, 1443 bp, Sorghum bicolor
gcgacacgcacaagcgcacagccacggtgagaagaagaagcccatccaccaggcaccagcacaagggacaaacgatccggagcggagttcagtccagtctcggtctaggtccatgggtgcgggaaaaggaggagacggcggcggcggtggcggcgaggcggccgcggcggcgcctgaggccgcgcagcccgtcgtgctgaagatggaactgcattgcgccggctgcgcgcacaaggtcaagaaggctattaagcgcgttcctggtgtcgagtcgatcgtgacggacgtcgcggcgaacagggtcgtcgtggcggggacggcagacgccggcgcgctcaaggcgcggctcgaggcgaagaccagcaagcccgtggaagtcgtctccgccggcggcgcccccaagaaacctgctgccgccgcggagcacgccggcgccggcgagaagaagggggacaagggcgtgagccccaaggaggaggagaaagagaaggacaaggagaagaagcaacaggcctcggaggagaagaaacccaagcaggtcggtacgcggcagccgcaggagacggtgctgctcaagatccgcctccactgcgacggctgcgccgaccgcatcaggcgacgcatctacaagatcaaaggcgtgaaggatgtggtgctggacggcaatgccaaggacgaggtgaaggtcatgggcaccatggacatccccaacatgctctcctacctcaaggagaagctcaaccgcgacgtggaggccgtggcgccgcccgccaagaaagacggcggcggcgagggcaaggacgacaagaaggacagcggcagcggcggcgacaagaacaagggcgcagccgaggccggcggcgacgacaagaaagacaaaggcaaagggatcgacgtgtcggcgggcccgtccacggcggccgccgcggcgttcatggctgcgccggcgggggcgagcacgtaccacgtggcgccgccgtacgggtacgtggcgtaccagcaggcgccaccgccgccccccgccagctactacccctacccgtactacggcaatggcgacggcatgggccacgccaacccctcctactaccaccaacaaccgcagcagcagcccgacgtcaaccagcagccgcagatggcgtacccgccgtacccgtaccgtttcgacatggcgccgccgccgcagctcttcagcgacgagaaccccaacgcctgctccgtcatgtaacggaaacggccgccggcggcggcggcggcggcggtgggtgtccctagcttggttgcgtcagcgagctcactgatccgtcgtcagctttaacttagccgtccggccgggaaaaaactcgacctgtacatatcgtcgtcgatgaggattcagccttagtccagagctctaggattaattttctgatgaaattttgcttcatttgtttaatccttccg

SEQ ID NO: 176 - DNA, 1692 bp, Sorghum bicolor
ccctgctcactcacattggcaccgccgcagccgtagctgccatggcagagcacggcaacagggctctggcgcggtggcggcggtgggtgctggccaacctgggctccttctccgccctcttcaccaacaccaacttcggctcggcgtggctcatccttgcgccggtggtgtcgctggtggccacctacgcgccgcggcggctgttcctgacctacttcaacctcttcctccggcgccgcgcgcggcgcctgctcaacgccgtcgacccctacgtgaccatcgacatctcggagcccggcggcgaggtccggtactcccggtacggccccgtctccgacagcgacaccacctacgaggaagtgaaggcgtacctgagcggcgccgcgtgctcgcaggacgcgcgcgagctccgcgccgagggcgcccgggagggcaacggcctcgtcgtcagcatgcgcgacggccaggacgtcgccgacgagttccgcggcgtctcgctctggtggtcctccgtcatcgtcagggacgtccagggccagcgcaagggcgacaggcggttccagcggctcaccttccacctccgccaccgcggggtcgtcgtcgacgagtacctgccccatgtccgccgccagggccgcgagatcctcttcagcaaccgacgccggcggctctacaccaacagcaagtcacgagatccctacagctacgagtacaagtcatggagctacatcgacttcgaccacccgacgacgttcgacacgctggccatggacggggccaagaagagggacatcatggacgacctcgacacgttccggaacagcagggacttctaccggcgcgccggcaagccgtggaagcgcgggtacctgctgtacgggccgccgggcacgggcaagtccaccatggtggccgccatggccaactacctcgactacgacatctacgacgtggagctgacggtggtgcacaccaacagcgacctccgcaggctgctcatcgagacgaccagcaagtccatcatcgtcatcgaggacatcgactgcaccctcgacgtcaccggcgaccgcgccagcagcagcaggccgcggcggcgagaggcggccgacgagaagccgccgccgccgccgccgcgcgacacggtgactctgtccggcctgctcaacttcatcgacgggctgtggtcggcgtgcggcggcgagcggatcgtcgtgttcaccaccaaccacgtcgagaagctggacccggcgctgatccggcgcggcaggatggacatgcacatcgagatgtcctactgcaggttcgaggcgttccagacgctcgccaagaactacctcgacgtcgacgaccacgagctgttcggcgccgtcgaggagttcctgcgggaggaggacctcacgccggccgacgtcgccgagtgcctcatggtggccaggcgcgcgggctccggcgagccttctcgctgccttgagatatcgatcgatgagctgaagaagagagcggcggagaaggccaaggccgaggcagaggccaaggcgagagcagaggcggaggccatggcgtgggcggcggaggcagaggccagggcggcggtggaagcaaatgcggcggccgcgagggaccgtgggaattcgcggtaattttgaacacgacgaacagaaagtttggatgtgtgggaatttactagtagca

SEQ ID NO: 177 - DNA, 776 bp, Sorghum bicolor
cggacaccaacaaaacaaacagtgcccaacacagacaatacgagactacaagagctcttcccagtccaaggatccaatccaacagatatgagcgtggagatcgtggacgggcggacggtgcagagcttcgtggaggacgagcgcgcgttcaactcgtgcgtggacgcgcggttcgcggcgctggacgcggaccgcgacggccgcctctcgtacgccgagatgaccggggagctcatggcgctgcgcgtgcgggaggcgcacttcggcgccgacgcgccggcgcccgacgccgagctcgccggcctgtacggggcgctcttcgcgcgcttcgaccgcgacggggacggcgccgtggacaggcacgagttccgcgccgagatgagggaggtcatgctcgccgtcgccagcggactcggcgtgctccccgtgcagatggtcgtcgaggaaggcagcctcctcaagagggccgtcgacagggagctgctggcgaccactacccctactaccactaccctggcagcttgaccagctccatcggctccatgtcacctggccactatcatgacagggagctggccactatcacactgctagccgaatggcagtttcatcacctgcctatgtaaccgtacgccgagggtgtccttttaatttggacccgtctaatcattcgtgtttgtcgaactgatgacacgagtatataatgtacgtactgaatctattttatcagttatcaaaaaaatatttttatcagaccttatttagttgaagaggtg

SEQ ID NO: 178 - DNA, 1746 bp, Sorghum bicolor
atctcgtgtgtcgtcccatctgttcttcgcgaggcgcaacgcaagttcgcaacaaaggcacaaacccctcaccttcctcaaaccctagccctcgcgcccccctcccctgcttgcccccgtcgccgccaccatgggctcagatgcggacatggaggattacgggttcgagtactcggacgaagaacctgaggagcaggacgtcgacatcgagaaccagtattacaactccaaaggtttggtcgagacagacccggagggtgcacttgctggttttgatcaagtagtcactatggagcctgaaaaagctgaatggggatttaaagctcttaaacaaactgtcaagctttactataagctggggaaatacaaagaaatgatggatgcctatagagagatgttaacatacataaaatctgctgtcacccggaactacagcgagaaatgtataaacaacataatggattttgtttctggatcagctagtcagaacttttctcttctgcaagagttctaccagacaacactgaaagcgcttgaagaagcaaaaaatgagagattatggttcaagaccaacttgaagctttgcaaaatttggtttgatatgggtgaatacggtcgcatgagcaagatattgaaggagcttcataaatcttgccaaagggaagatggttctgatgatcaaaagaaaggcacacagcttttggaagtctatgctattgaaatccaaatgtacactgaaacaaagaataataaaaagcttaaggaattgtatcaaagggctctttccatcaaatcagcgatacctcatccaagaatcatgggtataattcgtgagtgtggtgggaagatgcatatggctgagaggcagtgggctgaggctgcgactgatttctttgaagctttcaagaactacgatgaagcaggcaatcctcggagaatccaatgcctaaaatatcttgtccttgccaatatgttgatggaatctgaagtgaatccttttgatggacaagaggccaagccgtacaagaatgatcctgaaatccttgcaatgacaaacttgattgcagcgtaccagaagaatgacatcatggaatttgaaaagatcctgaagagtaatagaagaacaataatggatgatccttttatccgtaactatattgaggacttattgaagaacatcagaacccaagtgctgctcaagcttattaaaccatatactcgaatcaggataccattcatttcacaggaactcaatttcccagagaaggatgtcgagcagctgttggtatcgctcattctggacaaccgtatccaaggccacatagatcaggtcaacaagctactagagcgtggagaaaggtccaaggggatgaggaagtacagtgccatcgacaagtggaacacgcagctgaagtccatttaccaaacattgtccaacagagttggatgagacggatcgtggctgctgtatgctttgcacacctagaattgttgatagcctgttttggggatttgagggcaactgcaaagaactgtctggcaacgcttgcagtagaattctggatctgggtaaagtgaaatatccatgtaaacgcttgatctggtggattatattcgctttcttcagttatctggcgttttgggagtgcaagacttgaccagtggtcgaaagccagttgtagagtggggaaacatatgacgattttttgattgcaagttgcagttacggcgatgacggtctttacc

SEQ ID NO: 179 - DNA, 4111 bp, Sorghum bicolor
cgcccccgcacatctcgatctcgccgtcgtctccccccggtggcatgctccgcttccgctagactagatccgatctatctatggatacccgccgtcgtctccccatcctcctcgccctcctgctcgccttcttctccgccgttgccgcctctgacgagatccacggttgcggcggcttcgtcgaggcgagctctggcttggccaaatcgaggaaggcgtcggattccaagctcgattactccgacatcacggttgagctctgtactgttgatggtttggttaaagaaagcacacagtgtgctcctaatggctactattttatcccagtttatgataagggttcattcatggtcagagttaaggggcccaagggatggtcatggaagcctgaaactgttcctgtcatcatcgatcacaatggctgcaatggaaatgcggatataaatttccaattcactgggtttatgatatccggtaaagtagtgggagctgttggtggtaagagctgctcaaaagggggaggacctgctggtgtgaaagttgagctgatgacagattctgatgagttgattgcatctgcttcaacatcatcatcaggagaatattcatttacaaacataattccagggcgttacagattacgtgcttctcatcctgattacaaaatcgagttgagaggctcaccagaggttgacttgcgatttggaaacgtcgtggcagatgatgtcttctttgtatctggatatgacatttatggcactgtggttgcacagggaaacccgatagtgggagtccacctatatttgtattcaaatgatgtaacggaggtcccttgtccacaaggtttcagtgatgcacccaaggaaggtgctctttgccatgcaatatctggtgctgatgggaagttcacgtttagatcactaccttgtggtagctatgagctgctgccatactacaagggggagaacaccgtctttgatatttcaccatcttcacttcctgtttctgttgagcacagtcatttgaccattccccaaaaattccaggttactggattttctgttggagggcgtgttattgatggttacggtgctggtgtggagagtgccaatgttatagttgatgggcagtcgagagccataacagatagtctcggatactacagacttgatcaggttacatccaagaagtatactataactgctgagaaggatcattataagttcaatcgtttggagaattttatgattttaccaaatttggccagtattgatgatatcagatcagttagatatgatgtatgtggtattgttcgaacagttactccgaattcaaaagcaatggttactttaacacatggaccagaaaatgtaaagccacagcggaagttagtgggtgaaaatggacagttttgctttgaggttcctgctggtgaatacgaattatctgcattacctgtagattccgaacgctcttctagtcttatgttttcaccaggatctattagcatcaatgtaaatagcccattgcttgatctcgaattctctcagtcacaagtcaatgttcatggcaaagtctcatgcaaagagcaatgcaaccagaacattcttgtctcgcttgttagattggctggcggtgttgagcaggaaaagaagacaactacattggagcaagataatgtcagttttgtgttcaagaaagtatttcctggaaaatatcgtgtagaggtgaagaattctttacccgagggctcagctaaggatgattggtgctgggaccaaagtaccttgaatatagatgttggtactgatgatgtgagagacattgtgtttgtacaaaaaggctactggattgagctagtttcaactcatgatactaaagcttatattcagcagccagattcttctagacttgatttgtcgataaagaaaggatctcaaaggatttgtgttgaaacttcagggcaacacgagattcatttaactaatccttgtatttcctttgggagctcgtctgttttgtttgatacagctaaatcaatgcctattcatatcagcgcaaagaagtatcttgtaaaaggtgaaatccatgtggacatgagctcccttcaggaaaacattgattccaaggatatggtcgtggatgtcttgaagagtgacgacagtttcatagaaaagatatccacttcacctgttattggaaaggataatcaaaatgactttactgcctttgagtactctatttgggctgaccttggggaggacttcatctttgtcccccatgattctagcactggaaggaacaaggtcctattttatccagcaagacagcagtattcagtgtctatgaatggatgccaagatactgttcctctaatcactgcaaaaactggtctataccttgaaggatcagtgctacctgcaacttctgatgttgacatcaagattgtagcagctggaaagagcaactatgcccatctgaacaaaggggatgtagcaacagagacaaagacagattctgaaggatcattttttgcaggtcctttgtatgatgacatagtatataaagttgaagcttcaaaggatggttaccatctcaagcaaactggtccatacaccttttcttgtcagaagcttggtcagatatcagtgcggatttatggtgaaaattcagagcttttaccttcagtattattatctttgagtggcgaggaagggtacagaaataactcaattagtagttctggtggaactttcacctttgacaacttatttcctggaagtttctatctccggccacttctaaaggaatataaattcaatccatcagcagtagctattgatcttaattctggagagtctagggaggctgaatttcgtgcaaccagagtggcttacagtgccatgggttctgtaacactattaactggccacccaaaggagggtgtttttgttgaagcaagatctgaatccacaggtttttatgaggaagctaccacagatgcttttggtaggtttcgtcttagaggacttgtgcctggatcaacttactctataagagtggttgcaaaagataatcttcggtttgcagcagttgagcgtgcttcacccgaatatttgtcggttaatgttggtcgtgaagacataactggtattgattttgtggtttttgaacacccagaagtaacaatcttgagtggtcatgtggaaggagacggcattgatacgttacagccgcatctctctgttgagatcagatcagcagcagacccttctagagtagaatctgtacttcctgttcctctttcgtactattttgaagtgcgagatttgcccaagggcaagcatcttgttcagcttcgatctggccttccatcacatacacataggtttgaatcagagttagttgaagtagatctggaaaaggaaccccaaatccatgttggccccctcaaatataaaactgaagagcgtcatcaaaagcaggaactgaccccagcaccagtttttccgcttattgttggagtttctgtggttgcactggtgatcagtatgccaaggttaaatgacttgtaccagagcgctgtagggatgacttctctgggttcggggatggcaccaatcaaaaaggagccgcgcaagaacataattagaaagagagtgtaaacggcagattagcttagccttaggggtcgagaaatgagcactgacaaattgagcatgtcaagagtggaaatagctgctggtttaccctttttttccgaaaacgtgcgctgcacgtgcctcattaagaagagagttaaaagttacctccctcgttccaaatggtgaggtaccattggcacggcgggcgacacgagttacaataggcgccggctactacggcggagcgttgttggttgtactttctaggcgaaaagctgcacgttgctggtttaccctcgtgtaattttgccaacgaaaaggaatctgacagttttgataccatgctggcttcaagtgttgacgccaaagctgagcgtgtagctcttcgatccaattgttgtacgatagcactatgtacagttttttcaagccctagataatgacgttaatatacttgtaatcgggga

SEQ ID NO: 180 - DNA, 1786 bp, Sorghum bicolor
gggctagaagcattaaaaatatccctccgttaactctccagactccaacccctcttctcggcctcttcatttccaattccggcttcttcttcgcatcacaaaattccgattgcggcgcagtcttggattgctagctccagccccaaatgatcatcatcagcggcagcaacttcccaacggattcgtgatcctcccgcgatgggtctcatctccaacgatgcgtggcacaaacggttcttcagcgttgcgccgcccgcggcgctggtcttcttcttcgtgctgatattcgtcgccggtgcaattgtcacgctcgatcataaggagagtctgtccatattgcagttgcaaccgaaaggagtgattgcagcagtggagatgaggcctccagccactagcgagctgaggtcttcagcgacgaccgagccgcgtgctgagccagcagaggaacccgacatctgtgagaataaatgtagacctccaggcagcgagcccttgccgaggggcatcgtgcaggacaagtccaacttcgagatggagtcgctgggtggcaatcctgaacggaaggagaacggcaacggcaggcagccaaaaagcctcctcgccatccccgtcggcatcaagcagaaggcgatcgtcgacaagctcgtctccaagtttccggaggccaagttcaccgtgatgctgttccactacgacggcgaggtggacgggtggcgagacctcgagtggtcgcgccgcgcgatccacgtcgccgtgcgcgaccagaccaagtggtggttcgccaagaggttcctgcacccggacctggtggcggagtacgactacgtcttcctctgggacgaggacatcgaggtggacagcttcgacccgctcaggtacctgcggatcgtgaggaaagaagggctggagatctcgcagccggcgctggaccggcggtcgcagatccaccaccggctcacggcgcgcgcccggagcggcgacgtccaccggcggtactacaagacgaacgggcacgacaggtgctacggcaacagcacgggaccgccgtgcacggggtgggtggagatgatggtgcccgtgttctcgcgcgcggcgtggcggtgcgcgtggcacatgatccagaacgacctcgtctacgcctggggcatggactacaagctcggctactgcgcgcagggcgaccggagccgcaacgtcggcgtcgtcgacagcgagtacgtgttccaccggggcatccccacgctcggcgacgacggcaaggcgacggtgtcggcgtcgtcgttggggagagaccggttagcggtgagacagcggtcctacaccgagctgcaggtgttcaacaggaggtggaagaaggccgtggcggaggacgggtgctggaccgacccttacccgaaatcggcggcgaccaccgcctgatcgttggacgggacgaggcaccgcagtgcagggaagtacagtagttggtagctgtcagattgaccttgcctagaagatggtagcagatcatacatcatacaccgcattagtttacaggttcagagagttctatatatgatgtacagatatttttttttcatgtttcatgcccgtggtctatacaagggaataagcatgcatggataaagaaatttgttgtaattttttcttaaaaaaaataaattgtgagatgatgaatacagtttcagcatacacaattgacaatacatgcacaactagaactacaatgaacttcaatggaacaagcattcctcctccaatttcaactaaaaagagaagttcctcg

SEQ ID NO: 181 - DNA, 1680 bp, Sorghum bicolor
tcttgaaattactggaaaggaaacgtggcgtgccgggccccgcgacaagaaaccaaaccacccacttcggaaaccaaacttacgaccgcgtcgtgtataaaagcccgcaagccaccaaactccgcctcctgaattccctcgtctccgcacggaggccgtcctccccctgacccctctgcgtccgccgccgccgccgctcaccggccgcccgcacgcacgcgcgctccattaccccggggtccccggcgggcgatggccagcctatccaacgccggctccaccaatcaggcctaacacgagcagccacagcctccgggcgcctgatctctcctcgtcgggcgggattcgggtcgacaggagatggaggccagcgtgggcgtccgtgcgccggcgcgcggccgtgcctgggccggcatcgagaagccgcacggcgcttactccgtcagagtcccgccggtaaggctcacggcggacaggctgcggctgcctccgccgcggaggctggtgctgggcgccgatccgtggaggaccgcgggtcctgccctccgtcccgcaaagctgagagtttcgtgctccgcgaaatcggcaggaacaggaaaagtccactattctactgacgaggctctcatactacagcaaaaggcccaggatgttctcccttacttggatggccgatgcgtttatcttgttggaatgatgggttcaggcaaaactacagttgggaagatattagccgaagtattaggttattcgttctttgacagtgataagctggtagagaaggctgttggtatctcatctgttgctgagatctttcagctccatagtgaagcattcttcagagataatgagagtgaggtcctgagggatctgtcatcaatgcatcggttggttgttgcaaccggaggtggtgcagtgatccgaccaatcaattggagttacatgaagaaagggctgactgtgtggttagacgttccactggatgcacttgcaagaagaattgctgctgtaggaaccgcatctcgaccactcttgcatcaggaatctggtgacccttatgcaaaggcttatgcgaaacttacatcactttttgagcaaagaatggactcgtatgctaatgctgatgccagagtttcacttgaacatattgcattaaaacaaggccataatgatgtcactatacttacacctagtgccatcgccattgaggcattgctaaagatggaaagttttcttaccgagaagaccatggtcagaaactgattgcttgtatgtgagcaaaaggatgctcacaacatatggcccttgtttgtttaattgtacatatacctttgcataaactctttctgcagtgttgttcaacatgaaagaggaccgtttgagtttgtacttgtgcaaatgaataagtaaatagctttcagttaagacaatgctaatttgttatttatctcaatgaatggttgatggggacattagggcatagcatggtattgtcatttcaattttcactatgtcagattgtgaaacaagcaatgacatgaatccatgtttttgaggcaaaatgcattacagcattatttttatgttcacatagattaagtttgtcagttacaccatatgtgcatagcaacatgggccatttacaatgcctgttgtagtttgaaaaatatgtacatagca

SEQ ID NO: 182 - DNA, 800 bp, Sorghum bicolor
attaataaatgataaataataggagcaatagcacactcaacaaggcaagtcacccactaccatatataaagtaatacaaaacaatgagaccaccctgtcaaattagatacaaacattcaagaattgagaaggatcgcctacaaatcaagcaagcaaaggaataggggaaaggaagacaaggcagcccgtcatgtgctgctgcggcgacggcgacgagtgccggccgctgggctggctgctggggctgccgttcgcgctgctcgccgtcctcgtctccatcgtcggcgccatcatctggatcatcgggctgcccatctcgtgcatctgcccgtgctgcctctgcgtgacggtggtgctggaggcggcggtggagctcatcaaggcgccgctgcacgtcatgacctggttcacctccaagataccctgctagacaaagtactcggagtaccacgtctaggcttcattgtttgctactagctccatgtacgacgggtccatgttaggcgaggatgattcatgtgagataaattgacttctgaatgtttctgtcgatcagtattcctctgcttcttgtgttgtttcctcttcttcttgtattgtttcctcatggcttgatgatttgaagttgagaagttagtctgatcactaatgcgactgcttatcgcagacgtgaacaatcaatttgttggaggtgactggtaactgaattaattatagttaattctatgcttaccttttttttttccttcgtttccgctcttgtcagtttcgattgtaactttccatggtgatgagcacac

SEQ ID NO: 183 - DNA, 1041 bp, Sorghum bicolor
ctattaaagcccccggccgcttcctccttcgtccgagcgcagcgccagcctgaggccagccgccgcgacataacgcgaagccctcgctctgctctctgctctctcctctctcctctgccccccagtctcttcctccattgccgccgcagctctccgagccgcgcgccgccgccgccgcctaggaagtcagcacagcgcagcagcgtcaggaaggaaggaagaagaagaagaataccaggacgatggaggtggagacgatgctggaggacgacgtgttcttcgccgagctcagcaagcggatatcgctgctcatcaccgacgacgacgagggcggcgcggacttcgccgccgccgcgaagttcatccccgcctccgccgccgcgacgcccctcccggggttcgcaacgtcgcgcggcgcccatgtgccatcgcagcagcagcagcagcaggattggggcgcgtcgttgctggcgccaccggcctacgcgttgtaccaccacggcgccagctacggcggggcggcggcggcgtggcagcagctgcagcagcagtgcggcagcaagggcaccggcgtcttcatcccgcggtccacgcccgggtccgcgcaccccaagaagaagggcaagaacaggggcgccgccgccgccgccgccaaggccgccgcgcgggcggcgcaggctgccggcgcgggcgcgccaaccaagaagcgcgcctgatttctacttgaggagagaaggggagaaaaaaaaggagggcaaaaaaagcacaactactaactccaggatgcagtgcaacacggtgctgaacgaagtgctcgtcgatcgggatcagccgcattagcttaatctgtttaattaattaattaattttcagtattattattactgcaattcttatatggtaaataataaaaccactgccactcccctgggttaaaaatgtactataatgtgagccctaggggaggacgactgtgggctgctggggcaccacgccacacgaataatctctgtgtatagtataagctagcggttggtggtg

SEQ ID NO: 184 - DNA, 2146 bp, Sorghum bicolor
gtacgcttctgcttcagtgcttccggcagcaaagcgaaactagcgctgctaaacctcgggccatccccccgcgagcgcgacacacccaaaggccagcaggctccgtcccgttcccgttccgtgtcccgatcgctccgctgcgctccccacgatggcgtcgcacatcatcctgccgccggacgacgccgacgagaaccacaaccaccaggccgaggaggaggagcgggaggagctggggcgcgacgaagacgccgacgacgaggagcacgggcacgggcaccccccggcgctgccacccaaggcggcgctgccgttctcggccacgtgcgtgcggatctcccgcgactcgtacccgaacctccgcgcgctccgcaacgcctcctctgtcagcctcgccgacgccgcctacgtcaagatctccgagggcgactacgggtacgtcctcgacgacgtcccgcacttcaccgactacctccccgacatcccgacttaccctaatccactacaagatcatccagcctattcaactgtcaagcagtattttgtcaatgaagatgacactgtacctcaaaaggttgttgttcagaagaacagtcggcgtggtgttcacttccgtcgtgctgggcctcgtcagaggatttattttggcaccgatgaagtgaaggcctgcattgtaacttgtggaggcctgtgccctgggcttaacactgttatcagggaactggtgtgtggcttgtcacacatgtacaatgtcagcagcatttttggaatacagaatggatacaagggtttctattctagcaactaccttcccctgacaccaaagagcgtcaatgacatccacaaaaggggtggtacagttctaggaacatcacgaggtggccatgatacaaaaaagattgttgataacattcaagatcgtggaatcaatcaggtgtatatcatcggaggagatggaactcagaagggagcatatgagatcttcaaggaaatccggaaacgtggcctcaaagtttctgtcgctggagttccaaagacaatagataatgacattgcgatcatcgacaagtcctttggttttgatacggctgtggaagaggcccagcgcgccattgattcagctcacgtggaagcttgcagtgctgagaatggaataggtttagtaaaactgatgggtcgttatagtgggttcattgcgatgtacgctactcttgctagtcgagatgtggactgctgtttgattccagagtctccattttatctggacggagagggtggattgcttcaatatgtagaaaagaggctgaaagagaacaagcacatggttattgttgttgctgagggagcagggcaggatcttattgcgaaaagcatagccacatcagatcaacaagatgcatctggaaataagctgcttcttgatattggtctgtggctgactcacaagataaaggactacttcaaaagcaaaaagatggagatgacgattaaatacatagatcctacatacatgatccgtgctattccaagcaatgcatcagacaatgtctactgcacacttctagctcacagtgctatccatggcgcaatggcggggtatagcttcactgttggaatggtcaacggaagacatacctatatacctttctatcgggtgacatccacaaggaacaaggttaaagtcactgacaggatgtgggcaaggcttctgtcgtccaccaaccagccaagtttcctgagtcagaaggatatcgatgaagcgagtgaggcggataggctggcaaacaggccaccactgccaacgggtgccagctctcgcgtggcgaggtctttcgatcaatcttcgtcgtgttcttcaaatggagagatctagtgattgctggtgcaccacaactgtgtacagaaactactacaatggttctgagctcaggtgcctgggcagcttggcgacgcaatgagttttgctcttgttagttgttatgcatatgccttgcgtataggggccacacggatatgaccctgttagcacgtgtaataaagaaacgccattgatgaagctacttcctggaggctccatctatcatgtatttgctgcagaatatgagttattatgcaatcggcagatgatctatatgatcttcaccta

SEQ ID NO: 185 - DNA, 3583 bp, Sorghum bicolor
ccagcccactctgagtctggtcgcgaatctcagcggtcccgacaggaatccaacggcgttgggcgacggcagccctacgcgcggcttcgcggagtgccggagtcgcgaggcggctcggctctacaccctctcgcgctcgctctcggcctcgcctcttccctcacacgactcgccgcgaggagtttcccccttcctccgcgcgcatccccgcgagagctcgctcgaaaacctagccgccaaatccatggctcgacgcggccacgacgacgacgacgagatcgaggaggaggaggacgaggaggaggcctacgacctggacgaggaggaagaggaggacgaggaagacgactacgaggaggaggcgaggcgcgggaaggcctcccgcagcggcggcgccggcggcggcaaggggggcggcggtgggcggaagcggtcgcgcgaagacaactttattgacgactcggccatcgaggacgacgacgaggaggatgacgacgacgacggcgggggccggccgaggaagaaaggcggcggcggggtgcgagggttcttcgacgaggaggctcaggtcgacgaggatgaggaagaagaggacgagggcgagggcgaggacgattttattaatgatgctggggccgaccttcctgatgaggatgttgttaggggctcaagacgtcattctattcctatgagggatgaagaagaggacattgatgagattgagagacaagtgcgggagagatacgcaagatccactcatattgagtatggtgaggaagcagcagaagtggaacagcaagctctgctgccctccgtgaaggatcctaaactatggatggtcaaatgtgcgattggacatgagagagagactgcaatttgtctgatgcaaaagtacatagataggggagaccttcagataaagtcagtcgtggcattggatcatctaaaaaattatatttatgttgaagctgaaaaggaggcccatgtcaaagaggcttgcaaaggtctacgaaacatttatgcttcagcaaaaataacattagtgccgataaaagaaatggcagatgtcctctctgttgagagcaaatctgtcgatctttcaagggattcttgggtccgaatgaaattgggcatatataaaggtgaccttgctaaggttgttgatgttgacaatgtacgtcaaagagtagatgtgaagctgatccctagaatagatctacaagctttggctagtaaactggaagggagggaggctgtaaagaagaaagcatttgtcccaccaccacgattcttcaatatcgatgaggcgagggagatgcatattcgtgtggaacggaggcgagataaagaatctggggagtactttgagtgggttgataatttgaagttcaaagatggtttcttgtacaaatcagtctccactaaatcaatccacacaaataatattcaaccgactttcgatgagcttgagaagtttaagaagcctggtgaagacatgaatggcgacatggctagcttgtccactctgtttgcaaacaggaaaaaagggcattttatgaagggtgatgctgtcattgttgttaaaggcgatttgaaaaatctggaggggtgggttgagaaagtagaggatgaaaccgttcacatcagaccaaaaatatctgatcttccgaaaacattagccttcaatgaaaaggagctttgcaaatatttcaagcctggtgaccatgtcaaggtgatctccggtgttcaagaaggtgctactggcatggttgttaaagtggaagggcatgtcttgataattttgtctgacacaactaaagaacatatccgtgtgtttgctgatcatgtcgtcgaaagctctgaaattaccacaggaatcaccagaattggtgattatgaactgcatgatcttgtccttttagacaacttgtcatttggagtaattataagggtggaagctgaagcatttcaggttctgaaaggagtgccagatagacctgaagttgtgctcgtgaaattaagagaaataaaaagcaaaattgataggcgctcatcagctaaagatcgttctaataatattatctctgcaaaggatgtcgtaagggttattgaaggagcatgcaaggggaagcaaggacctgtggaacacatacacaaggggatactgtttatctatgacaggcatcaccttgaacatgcaggctttatttgtgcaaaagcgcaatcttgccttcttgttggtggatctgctggtggccgtcgaggaaatggtatggacacagctgatgcacggcttggtgctttgagatcttcagcaagcattctgcaatctccaggaaggctgcccccaagaggacctaatatgaattatggtggaaggtttggaggcggccgtggtggtagaggacatgatgccttggtgggtaaatgtatcaaaattaaatctggcccttataagggataccgtggccgtgttaaagaggtgactggtgcactcgtacgtgtagagcttgattcattgatgaagattgtcacagttaaaagagatgatattgctgacacacctactgttgcaacaccattccgtgagcctcgttattcattgggcggtgaaacaccaatgcacccgtctcgaacaccacatcatgcttatcagactccaatgcgtgaccctggagcaacaccaatacatgacgggatgcggactcccatgcgcagtcgagcctgggctcctatgagccctccgagggataattgggaagatggaaatcctgctacttggggtagcagtccagcttaccagccaggaaccccacaagctcggccatatgaagcccccacacctggatcagggtgggcaaacactccaggagttagtttcaatgatgcccctactcccagggataactatgcaaatgccccaagtccatatgtgccttccacgcctgttggtcaaccaatgacaccaaactcggctgcatatcttccgggcacacctggtggtcaaccaatgacccctggcactgttggactggatgcaatgtccccgatactaggtggtgagggtgatggtacatggttgttgccggatgttatggtcaatgtattgaggggaggtgatgatggtcctggtgtggttagggaagtactcggggatggatcttgccgagttgcacttgggtcgtcgggcaacggtgacatggtgacagtccttccaaacgaggtcgaggtcatcaggccaaagaagagtgacaagatcaagatattgaatggtaatttccgtggatacacaggaaaactcataggtatagatggttctgacggaatagtgaggcttgacgacacatacgaagttaagatattagatatggtgattttggccaaactggcgacttgaaatggatatatatattctgtaacgtgtccatcatagaacataattgtaacaatgccctcgtttgcaataaagctttttgttgcttatttctgccatcattttccactacttgtcaggcgtttgccaaactctgctcgttttctccagctgttgttttggacttttggttgagaggactttcactta

SEQ ID NO: 186 - DNA, 3003 bp, Sorghum bicolor
agactttggttgtctcgtggagtcaggacgcccagtacctcagcggctcaaccagcgacgagtcatcgactcctccgtcttgctcgcggcgaaggtatatatttatattatcacaaggaattcagacatggcagatgccctatttgtagttcttaggaaacttgctgattccctaggagaacgggcactagagaggattggcacagagctggttcaagcagcaccagtttcgacagattatgagcatagcatgaagcaaatcgaggccgagctattgattctgcaggcttttattgctcaggctggggcaaaggtcggtgataaggcattcgatgcctggctggaccaagtgagagatgttgcccatgaggtagaagataccattgatgagtatgcttaccttgcggttcaagccgtggatactggcagcttctttaagaggaagttccgtcagataaaaaagtttgcagcatggcagaagtttcatagccagatcagtcaagtagaagctcgaattcagaggctaggcgaaattaggaatcgatatggcatcttggcaggtgaaatagacaggagtaacaaattgaggaaacccaatcagctctttatgtcagattcttcttacttaactgatagctctgaaatagtggggtatgttgatgaaattggaagattgacacaatggttacttgaggacaaacaagagcgaactctcattgccatctttggtatgggaggtctaggaaaaactactattgcaagcagtgtgtacaagaatcagaatatcacaagaactttcaactgtcacgcatgggttactgtatctcagacttatcaagttgaagaactactaagagaaatcataaatcagctaattgatcagagagcaagcatggcaagtggtttcatgaccatgaaccacatgaggctagttgaggtaatacaaagctatttgctagacaaaaaatatttaattgtcttggatgatgtatgggataaagatgcatggttatttctaaaccatgcgtttgtcagaaacaactgtggaagcaaagtgctgataactactcggagaaaggatgtatcttgtttggcagtagatcactataggattgaacttaaaactcttcaatatgctgaatcctgggagcttttctgtaaaaaggcatttgttgcattaaaagatagccaatgtcctgaaaaccttaggttttttgcagagaaaattgttgccaggtgtcagggattgccactggctattgtaaccattggaagtactctatcatatcgtgaattcgaggagcaggggtgggaatctttctacagccaacttagctggcaattagctaacaatccagaactgaattggatttctaatgttctgaatatgagcttgaatgatctcccatgttatctgaggagctgcttcctgtactgcagtctctatcctgaagattacaaaattagaagaaacgtgatttccaagctttggattgcagaaggttttgtggaagatagagacgatggaacaacaatggaggaggttgccaattattaccttgtggagctcactcagcgttgtcttcttcgagtcacagaaagtaatgcatgtggaaggcctagaacatttgttatgcatgatcttgtgcgagaagcaacctctgttattgctaaaagggagaagtttggtattgcatatggcgatgctagtacaacccaagttccccatgaagtccgccacttatgcatacaaagaggtgcccagaccttgaattttatagctagttcacggctccgctcatttattttgtttgacactgaagtaccatgctcttggatagatgatattttatcacgtttcagactactgagggtcctatgtctaagatttgcaaatattgaacaagtgcctggcgtggtcaccgaattgtataacttgcgctatattgatttttcatacacaaaagtgaagataataccagcatcatttggtaaacttgttaacctacaagttttggatctcagattcacatacgtggaggagttgccactggaaataactatgttaactaatttacgatatttacaggtgttcgtagtgcatgatcttctacaaagatcattggattgctttagtgctacaaaaattcctggtaacatttgccttctgaagaatctgcaagctttacatactgtttcagccagtaaagatttagtttcacaactgggtaacttgatgctgttgagaagtttggctataatgaaagtgcgtcaaagctacattgcagagttatggagctccctgacgaagatgcctaactttagcaggttgcttattttcgcaattgatatggatgagattcttgacttgaaaatgctcaagcccttacccaatctgaagtttctctggcttgctggaaagttggatgcaggtgttcttccatcaatgttttccaagtttgagaaattagcatggttaaaggtggactggtctggtcttaagaaggatcctattatctccttttctaacatgttaaacctagttgatttgaggctctatggggcatatgatggggaacaactgaccttttgtgcagggtggttccctaagcttattcgtctggaattaggtgacatggaacatctggattggattgagatagaggacgggacaatgataggtctacatgatctagaacttgttggtctagggaatgtaatggcagtacctgcgggcatccagtaccttaggacactccaccaaatgtttctgacagatatgtcgaagggattcatacaaagactccaaggaagtgacaattacattgtccaacatatacctaacattcatattttttactcctctgattctcaagcagtaaataacctccatcttgtgccatggcttgtgaagaagtacggtcctggtgcagccaagcatgcccccacatactgggactcatctggcacatgacacttgattgtaagcttactgtgggaaat

SEQ ID NO: 187 - DNA, 872 bp, Glycine max
actgccgagcaacagtgaatttggccaccataccataccatgagcataagggcgcgcgcgcgcaaaggattagggtttcgaacgtagcgcttttggagcttccatttcgatttatacttgcgcacgatcaggagggagggctttggagttgaatgcattgctcgtttttactgaaaggagaacccgcgctctctttggttgccgctttttttctgtgttctgaattcaatcagcactgagcattgatcattgagcattcagcattgagcagagtatggatatatcaaatcctgcagccttagtcaatgcggaactgttgcacttctatgttggaagaagggtaaggatcgtggtgcaggttgtgcgatctgatggtggagttgtcattggaaaatcaacagatgagaaacaactagttgtaaaaggatcacccccacctgctgctcctcttacaacttttgttgaagtttatggtcttgttaacagtgataagtcaattggtgctgagatatggaccaattttggtgatgccatcgatatggatagctacaataagctttgtcagctcgcaaatggagaatttaaacacttgttcctgtgagttctaacaagcttgtctgatgatacagaggcctttctatcatttggaatactagaggagacataatcaatgtgttggcaacaatgtttttcattttttttttcctgatataatggtgacaatagggttgatcttatgtaaaaatgtaaaaactacccaagcccatcagcactagcccaatggacaatggtcacagtcctagtggcttaactagctgcaattttttataatttgttttggattctcttggtaaatatagtttttactggtt

SEQ ID NO: 188 - DNA, 840 bp, Glycine max
taggtgtgacagaacagcagaagggaagaagatggacttactggagttatgggcaattttcggccccggcgtcgccggcgctgtcttcggcgccggatggtggatctggcttgacgcggtcgtctgcagcttggtcaccgttcccttccttcactaccttcccggaattttcgcatcttttgcggctttgatgttcaattgcgttagaaaagaagacatcgattattctccatatgacgaaggcgagtggagactgaagctgtggctcttcattgcatatgttgtatcctttgtttctttagctggatcagctggcctactgatccaagattcacttgataaatctgccccttcagtttggactggagttgcaggtgttttgcagtgtgtttttgtcttgatcagtggactggtatattggacttctcatcctgaataagttgcaccaagatatgactcggagcttcaaactataccaggttatgcccacccatgtattgtcttgtttgttttatgtgatgttaagtcgctggcttcatgtaaatcagtaaatgtaaattgtgctaacaatcttgagcctctgggtagatttatctctcttgtttcgtatagttgatcaagatctattaccaatttcagtcgcttggtgttgacatctatgaagattccccccacccctcgttttctcagtagtttgaactcacagcatacaggaaaggaaaccctttatggttataactgagaataactctgttgactgcatctatgttttgactagaaaaacttactcgagaattcagattggttatgtacgaaagtttgtgtaaataacattattcg

SEQ ID NO: 189 - DNA, 913 bp, Glycine max
actctcgtaaatacaacacaacaaacatacatagagaaattcactcatataaaaatcatcacttcaaataaagctagacctagaaagatccagaggtagctacggagagaaacaaagctcatggctggtttgcaaagatctgaggtgtctttcaggagacagggttcatcagggcttgtttgggacgacaagttattatcaggggaattgaacaagaacgaagacccaaagggtgctcatggtggtgaccttaaccttaaccttaacgttagaacaacaccacccatccagagaagtcgctccaacggcggctaccgcaccggaaaagtctcgccggcgatcgagcctccctctcccaagctctctgcttgcggcttctgcagcgccttcggaaaaacaggggaaaagggtcgtcgcgcaaagccccgtgcaaagcatcgatcaaggtaggttttttctggtcgccggagatgctcttcaacttgtcatgtttctacccagttttatagaagagtgtagggtttgagtttgagttcatataaggaaaaacagaattgtcaattgtagctctccgtttctcttctgagtctctgtttacgagttttagtttgtttttcgtttttcttttgtttctgtggaagaagatattatgatggtttgtggtgggtgggtgagtttggttgtaattatgtgtgtgtatatatttgttgggtcaaccaggaattttggtctctgtacaaagtaaaatctccaacaagatctatctttcacagatttgggattggtgcaatatgggcacgtgatttagtaatcaactccatatatattgtcattcaccaaaaataaaactccatacatatattgtatgagatcatatatatctgataaatatgaggaacttaaatttctatca

SEQ ID NO: 190 - DNA, 1313 bp, Glycine max
agaaacgcaaagggaaagagaggaaaactgagaatgctggaggggagtattcaacacccactgcacacggcttcataactaaaccgccatcgctatcttcgactttctgcgccccaaagatgagaaaacgcaccgtttacgcatggcttgtagcacttctttgcttcctagttctcatgatcgtcaccccatccatcccccagtcccaagaataccatgatttcgccgaccaccgcaccttcctcggtattcctaatgcacttaacgtcatatccaatttcccttttctggttattggcctcgttggacttgtgctctgttatcatggaaattactttaggctcagcttgcaaggtgaactatggggatggacatgcttctatgttggtgtggctgcagttgcagttggatcttcattctatcatctcaagccagatgatgctcgccttgtgtgggatcgcttgcccatgactgtcgcttttacatcaatcatggcaatattcatcattgagcggattgatgagaggaagggaacagtttcaattatacctctagttttggcgggtataataagcattgtgtattggagattctttgatgacctgcgcccatatgctctagtccaatttgtgccatgcattgtcattcctctaatggctattttgttgcctccaatgtacacacattcaacatattggctctgggctgcagggtcttatcttctagctaaggtgctagaggctactgatgatgtgatctacgaatggacgcgacatattgtcagtggtcacacacttaagcatctggttgcagcaatggttcctgtcttcttaacattcatgcttgctaagaggagtgttgaacctgagaggcaaagtttgcttaaaacgtggagggtttcctggacgaagttcagagagggcaactccaacactgaaagctactcttactcttacacaaatgtgcaggctgtggagccccagtgatgtgctactttcccatagaacaaaaaataataaaggcttatactggattacggaatattgttacacttgactgtggactaggtaaaacaagacataccaagttagcttttacacaaaaatattaactgtaaactttgtatagttcccgatctttatcacatagagaggaccattttagatctgtgattctgtatgtgttgtctattttttgttcagcatggttataatctgcacaccttcaaagttcaaactcttgtagtgcttgacatgggaaatcatactaactgatattaattaggaatttaggatattcctggtaaattactt

SEQ ID NO: 191 - DNA, 870 bp, Glycine max
gtatagacataaaagcaatagattaatgaagtaggttgaaaaggcgtgcgtgctcatccctttagggtgaaagaagaatggtgctttcggaggaggaaatcggtcgtctataccgaataaggaagacggtgatgcagatgctgagggacagaaattttctggttggtgacttcgagatcaacatgtccaagcacgagttcaagtccaagtacggcgaacacatgaagcgcgaggacctcgtcatcaacaaatccaagaaggacaactccggcgaccagatctacgttttcttccccgacgaacccaaggtcggcgtcaagaccatgaagacctacaccaaccgcatgaactccgaaaacgtctacagagccatcctcgtcacccagaccaacctcacccccttcgccagaacctgcatcagcgaaatctcctccaaattccacttagaagtcttccaggaggcggagctgctggttaacattaaagagcacgagcttgttcccgaacatcaggttctcactgacgccgagaagaaaaccttgcttgagagatacaccgtcaaggaaactcagttacctaggattcaggtcacagatcctgttgcgagatattatggattgaagcgtggacaagttgtcaagattatccggccaagtgaaactgctggcagatatgttacgtaccgatttgttgtataggaatttgctttaacatattggcaatattgccagagtgatggatagggatataaagccttctttttttgcatgggggaactcttgatttacaagaagtgaaatgtctgattgttgaaacttttggaatcaaaactatatatttagatgattatatcataaattggttgacata

SEQ ID NO: 192 - DNA, 3062 bp, Glycine max
agaacacaacacaaaaataatacaaataatttctctgaaatttctctctgcactcaaattcgtggccttactttttccatttacactcactcacgcacgagcttcaaaaccaaaaccaaactctgttctaacctccaaacttttatgccattcatgactcataacatcatagaaaaagaagaactactcacgaaccgcgaccaccaccgacaataaaaggacaacaacgtcagtgtttaaaagcatgaaaatgctgccacctcccaccgccggaggtgcctcccacagcggcgccggtgaccgcaccgtggtggtgggcatgaagatggactctcacagcaccgagttgctcacttgggctctgttcaaagtggctcagcccggtgatgttgtgcttgctcttcatgttcttgggaatgatgaaattgtgaatcgagaagggaaatcctcgttgttttcacttgtcaaagcatttgactctattcttgccgtttatgaaggattctgcaatttgaaacaggtggatcttaagttcaaaatatgccggggttcatcagtgaggagaattttggttcgagaagcgaatgcttattctgcaacacacatcatagttggaagttctcaaggtcttcatataattcggccatgtatatctgtggcaaggtactgtgctaagaagttaccaaaggattgttgggttcttgctgttgataatgggaaaatcgtgttcaagagagaagggtcacccgcaactcgtgctgaattgaaaggacttgaccaggatcacaaaactcggttgctcggttcgattcataggacaatcagcaagggttcaaaagtgctagatgatgatggtacagggattcatgaaaagggttgtggtaatggtgaatattcagatcacagtttggctaaggcttttttggattctaaagaattcgttgagaagaagaggtgctctatttgtgcttcagaagaagagtcttgtggtgatgcttctgatgagaataaccctttggcaatagtgcctgtgcagaccaacgatgctgcttctaaaccaggttggccgctgcttcgtaagacaattgcatctgacaagaaatgttccgaaaaatcactgttgcgccagatctcggtggtacaatgggcaatgcagctaccctctagagatctttcatatgctgcacatcaagaccataaagcaaacaattgtgaccaaaataaggatcagtttttggctctggatagcaagagtggtgctcttgttccagtggatgccgaaataggaactgcttcttcgcctgaacgcaattcgagaagcattcctaaggaattggagggccttcatgagaaatattcttccacttgcagattgtttgagtaccaagaacttgtattggcaacatcaaatttcttgccagaaaatttgattgggaaaggaggaagtagtcaggtttatagaggttgccttcctgatggcaaggaacttgctgttaagatcttaaagccatctgatgatgttttgaaggagtttgttctagaaatagaaattatcactaccttaaatcacaaaaacattatttccctccttggattctgctttgaagatggcaatcttcttttggtctatgatttcttatcaagaggaagccttgaagagaatctccatggtaataagaaaaatccacttgtgtttggttggactgagagatacaaggtggcaatgggtgttgctgaggctttggagtatctgcataataatgaaggccaatctgtgatccatcgcgatgtaaaatcatcaaatgtgttgctatctgaggattttgaaccccagctctctgactttggacttgctaaatgggcatcaacctcatcatcacatataatttgcacagatgttgctggaacctttggttacatggctcctgaatacttcatgtatggcaaagtaaatgacaagattgatgtctatgcatttggtgtagtgcttcttgagcttctttcagggagaaagcccataagtggtgattatcccaaaggtcaagagagccttgtcatgtgggcaagtccaattctaaatagtggaaaggtgttacaaatgttagatccaagtttgggtgagaactatgatcatgaagagatggaaaggatggtcttggcagctacactttgtatcagacgtgctccaagggctaggcctctaatgagccttatctctaagctccttggaggtgatcctgatgtgatcaagtgggcaagactagaagctaatgctttggaagcaccagaaatgcttgatggtgaagcttgtccaccttccaatttgcagtcacatctcaaccttgcattgcttgatgtggaggacgactcgctctccatgtgcagcgttgagcaaaacgtctcgttggaggactacttgagaggccggtggagtcgctcatcaagctttgattaagcaaactactagcaaattgctagaagaataagaaggattgtgttttttgaaatctaaatccttttgtagataattttgccgtgttgcatgtgctgtgaatgtttttatagatgggtttaggatgagaggttgtttgtgtgtgccctcctccttcccttgattgtcaaggaaactatgccttgtaatttgtaaggctagatatcctttgtcgttttactttaattacttggtgctagtttcaatccttaatctcaatttgattgagtgtaatatgttctggtgcgaagaataaaagatgaaaaagttgtatcttaaaactacataatgagtactgttctcatgcattttaatcaagttaatggcaatttcttctctggtgtttggattgtttcctttcgctgtgtttcaacccggttgtgtgtttcctaatacgtttaggattatttggttgtaattgtgatctatgaagcatagatgtttgctatcaaccatagattgcgtttttaaggggggaaaatgtcaattgtgtagaaatattattaaatgatgtcgaataattcatgtaattgatcttacttaatgaaatgagattgttgttttcctgttg

SEQ ID NO: 193 - DNA, 5979 bp, Glycine max
tttgcttttggatatggttctcaccagcatcatagatcggatggaatgttaacaaggctggtcaatgagggactcataatgagagggcttgggtggaatcacagtccatgggcaccccggacaagaaaatatctgactttgttgatgtagttaggtcttggatccctcgaagggcggaaccactaaatgtgtcgagggacttctggatgccggatcagagttgtagggtatgctatgagtgtgattcacagttcacaatattcaaccgcaggcatcactgtcgaatctgtggtcgagttttctgtgcaaaatgcactgccaattctgttcctgttccatcggatgaggcaaatactggccgcgaagattgggagaggataagggtctgtaactattgttttaaacaatgggagcaagtaacaacagttgataataatggcagtgcagatccttcggctaccccttgtctcagcccttcaccatctacaacaagcttggtcagcactaagtccagttgcacctgtcatagtagcagcagcactgctggttcagttccttatacaactgggccttatcagcgtgtgccgtatagtccccatcaatcttcgcaaatgaatcagataacagatgatcaagaaaatttaaattctgggaggagtacaaatccctcagaggctgtagggaatgtgccttctaaccaatttggccattgcttcagcaggagtgatgatgaggatgatgattatggtgtttatcattctgatacagaatcaaggcattattcccatgcccatgactacgacgatccagttaacattcatggtgttgaccatgtctatgggccacatcaaatgcatcctgatgaagataacattcaggaaaaaaacttgagttgcctaacccaggcacagaatcttgatccagaaggtgtaggtggaattcaagtacctgggaaagaagacgatgagcatgatcatgctgatggatgtgaaacttctccttatcatgaggagagcaattatgcggagcctgtggattttgagagtaatggactactgtggatacctcctgagccagaagatgaagaggatgatagagaagctgttctttatgatgatgacgaagatgaaggtactactggaggtggggaatggggatatctacgatcctccactagttttggctctggagaatgtcgtagcagagataaaacaagtgaagatcataggaaggccatgaagactgtagtggaaaggcattttagagccctggtagctcagctattacaagtggaaaacctaaatacttgtgatgaagatggaaaagagagttggttggatataattactgctttgtcttgggaagctgctacacttctgaagccagatacgagcagaggtggaggtatggatcctggtgggtatgtaaaggttaaatgcatagcttgtggacatcaaaatgaaagcatggtggttaaaggagttgtatgtaaaaagaatgtggctcatcggcgaatgacagcaaaaattgataaaccacgttttctaatacttggaggtgctttggagtatcagcgtgtttctaaccagttgtcaagtgttgatactttgttacagcaggagatggaccatttgaaaatggcagtagcaaggattgatgctcatcaccccaatgttcttttggtggagaagtcagtatctcgttatgctcaagaataccttcttgctaaagacatatcgcttgttctgaatattaagaagccacttctagagcgtattgcccgttgtactggtgcacagattgtcccttcaattgatcatctgacctcacagaagctgggctattgcgaaacattccacgtagacaaattttttgaggagcatggtagtgctgggcaaggtgggaaaaaatcaacaaagactttgatgttctttgagggttgcccgaaacctttaggttgcactatcttgctgaagggtgccaatggggatgagttgaagaaggtgaaacatgtgatccaatatggaatctttgcagcctatcatctggcactggagacatcttttctggctgatgaaggtgcttcacctctagagtttcccttgaaatctcccataactgttgcattacctgataaaccatctagtattgtgagatccatttccactatccctggattttctgttctcactgctagagagtctcagggagcaaaagcttttaaagaagaaccacaatctaatgacatctacaagacagaaagaagcccatctagctgctgtgagtccactgaaagatcattggtgggtgactcaatccatatgcatgaagtgtctggaggtattacccaatcagctcaggatatgccatcttccaactgcaatagtttcctttcaaatacttcttctaaggaggatgataagaaatgtcccatggaattttttcaatacagactagatgagagaagggaaactatgttgaacaatgatcttatttcagattcttttggtacttttgagtcttcacagcaagatggaaatagccacctcagagctgcagcattgtctgcttatcaaggagctaaccctgagccaccttatataaaacatgatactaataattataataacaataataatcatgatgacatgatacattcaaaagaagattttcctccctcaacttctgaccatcagagtattttggtctttttatcaacacgtgtgtggaaaggaactgtttgtgaaaggtcccatcttgtaagaattaaatactatggaagttctgataagcctttgggacggtttttgagagatcaactacttgatccgagttacacttgctgctcatgtgagttgccatcagaagctcatgttcattgttatactcatcagcaaggcagcctgacaatttccgttaagaaatcggagtttgctttaccaggggaacgagaaggtaaaatttggatgtggcacaggtgcctgaaatgtcctcgcatacatggttttcctcgtgctacacgaagagtagttatgtctgatgctgcctggggcttatcctttgggaaatttttggagctgagtttttcaaatcatgcagcagcaagcagggttgcaagttgtggtcattctctccacagagattgtttaagattctatggttttgggaagatggttgcctgctttcgttatgcttcaattcaccttcattctgtttatcttcccccacccaaactggaattcaactatgatagtcaggactggctacaaaaagaagcaaatgagctgcataacaaggctgaaatactgtttagtgaagtgtgcaatgtgctgcatcaaatttcagagaaggtttcaggtcctgtgttgcaggagggtggaaatagggtgtcagattttaggaatctagttgctgaacttaaagggatgctgctgtatgagaaagaagaatttgaggactcattacaaagattgctgcataaagagggcaaagttggtcagcctgtgattgatattctagagctcaataagttgtgcaggcatatccatatccattcttatgtttgggaccagcgcttgatatatgcatccaatctaagtaaaattattcttcaagaaaacttgaagagcttaaatcatagagagaagttgcttggttctagggaaaaggttatcgaagcagatgttgccactaggccagcaagaggccatagcagttgtgattcctttcttttgggaacaaaacctgatggaaacctaaatttagaaaacactagccaccttagccaccctgtggtcaaaagtgaggacaagggcaaagacacaaatcatgataaggttgatctttctctttctggtggtgccaatatcaatgataaatctgattctgtggagtttggaggggctgtacggagggctttgtccgagggggaatctccttttgtggctaatttatctgatacccttgatgctgcatggacaggtgaaggtcatccgacaaatttatcactcaaagaaaatggttgtctacctcctgatgcagcagctgtggctgttcattcacctgtggcaaatatagttacatcaaaatcaaattctgatatttatagtgctaatataggtgggattgaggcaggatgcactaattactctaaattgctttccaaaggacttgatactaaatggaaaggaataccttttgcaaatgtctttggttcattcaacaaaacttcttccttcaatactgagaagcttgttgagtacaacccagttcacattttatcatttcgagagctggagcgccagacaggtgctagattgcttcttccagccagcactaatgataccatagtgcctgtctacgatgatgaacccactagtgttatagcgtatgtgcttgtgtcaatggattatcatatgcagatgttagaatatgatagacctaaagagagtggagacagttcaatttcattgccactctttgattcaacaagtctactttctctcaactcttttgatgagacaattactaatacctacagaagtcttggctcttttgatgagaatgtgttacccacttctgggtctcggagtttgccggctggggatccattctcatacacaaaggatttgcatgcaagggtttcttttactgatgatggctcccttggaaaagtgaaatatactgtaacttgctactatgcaaaaagatttgaggctttaagaagaacttgttgcccttctgagttagattttgtgcggtcccttagtcgttgtaagaagtggggagctcagggaggaaagagcaatgttttctttgcaaaaaccctggacgatagatttatcatcaaacaggttacaaaaacagagcttgagtcgtttactaagtttgcaccagcttattttaagtatttatctgagtcaatcagtacaggaagtccaacttgtcttgcgaagatcttggggatttatcaggtaacatcaaagcacctcaaaggagggaaggaaacaaagatggatgttttggttatggaaaatcttctttacaggcgtaacattagacggctttatgatctcaaaggttcttctcgttcacggtacaatccagatacaagtgggagcaataaagtgctgctggatcagaatctcattgaagctatgccaacctctccaatatttgttgggaacaaggcaaaacggttgctcgagagggctgtgtggaatgatactgccttccttgcatcaatatatgtgatggactactcattgctggttggcgtggatgaggaaaagcatgagttggttttaggtatcattgattttatgaggcagtatacatgggacaaacaccttgaaacttgggtgaagacctcaggcatccttggtggacccaagaacacttctccaactgtgatatcaccacagcagtacaagaaacggtttaggaaagccatgagcttatattttcttatggtgccagatcaatggtcccctccagagttacaccccagtgggtcccaatctgacatttgtgacgaaaatgcgtgaggcatgggactcatttcattgatgtggtcaaagtttgaatcttgtaaatgttaccattccagcatacatcattgacacgggtctctccttccttatgcccttaatatttgtctcctgcataatgcagctgctgttgatttgtgtcccttaagcaatggaggtgcacctcctgttaccagagattgttgaaagggtaactaagtgtacagcgattctcctcctctttcttttttatacatttttttatatcatgtatttaatctcttgctttcataatctgtcgtaaatttgatttaaagttcacaacctattattgaattgcacaccgcgtttctttttctacgcatgtgaaaggcgttgataaattcttacctcactgttatatgacccgtgtgaaagtatatatttgaaaattgtttctttctaatttaca

SEQ ID NO: 194 - DNA, 1231 bp, Glycine max
caagaatctcaatctggtcctctagggtaagtttacgtacacaaagcaaatcccacgaaaaccaaagcaatcaaactggcatcaatgtcagagcccccaaaaaccagagcagtcatctgcgtgggcgacatccacggcttcataacaaagctccaaagcctctggaagaacctcgaaggcagcctcgaccgatccgaattcgaaaccgcaaccctaatcttcctcggcgactactgcgaccgagggcccgccacccgccaagtcatcgacttcctgatctccttaccctcgcgttacccgcggcagaagcacgtgttcctctgcggcaaccacgacttggccttcgcggccttcctccgcctcctcccggcgccggcggatgggtgtgggttctcggaggggtggagggaatacgaggcgagcgaggagcgcgaagggtggttcaagggggaagggtacgaggacatgcacctgcaagggaggaggtggagtgggaagataaaggtgaagtttaacacggttaaggggacggagtatcagggctccatttatgacgctggaccaacctttgagtcctatggagttccccatggctccgccgatttggttaaggctgttcctgatgatcacaagaaatttcttgctgatttggtttgggtccatgaagaggacgatgtctttgtgaacactgatgatggagttaaatgctgcaaattgattgctgttcatgctggtttggagaaaggaaaagatgtgaaagagcagttaaaacttttgaaagctcgggatactcgggtgcctaaggtggaggctctaagtgggagaaagagtgtttgggatattccagaggaactaactgcaagtccagccattgttgttagtggtcaccacgcgaaactccatgtagaaggcttaaggctgatcattgatgaaggtggtggatataaagatagaccagtggctgcaattattcttccttcaatgaagattattcgtgatacagatgaattagcaaaatagtttcatatttgtgatattttttgcttttatacggcgtagtcaagctgttcagcttttagatctcatgagctcatagagatgagatattgcgtgttgttgatctgaaacacgagatacatttagatggcttatcctcttgttctgatttttaatgaagctctgaactattcctttcatcaacgctatggatctgagtctttcgcctttgaaa

SEQ ID NO: 195 - DNA, 2156 bp, Glycine max
gggagaagaaaacaaaaacatgattttttgcgccttggtccgcaatgtatcgatgatgttgtgtccccatcacaagttgattgtcagaataaaaacattaaattcatccaacattgggaagaagaaataactgagcagcaaagaaagcgagtaatcttttccgtgagatcggtgtgtgaattgtatattcccatttcaatgcagagatccggttatgggtccgacggaatatacaggtcactcagaccttccatcgtttttcccaaaaactcaaacctctcactcgtttcccatcttttcaacagagtcgcagcctttccatcaaaaccagctcttatcgatgcagactcttcagaaacactttctttcgcggaactcaaattgctaactgttagggtcgctcacggcctccttcgtctcggagtgaccaaaaacgacgtcgttctcttcctcgctcccaacgacatccgctacatcgtctgcttcctcgccgtcgcctctctcggcgctgccgtcaccaccgtcaaccccgcctacaccgccgccgaagtctccaaacaggccaacgactccaaacccaaacttttggtaaccgtcgccgaattgtgggacaaactcgaacacctcaaactccccgcggtcttcctacgttgttccaacgctccccacgcgccatccagcgcgactagcttcgacgcgctggttcaactcgccgggtcggtgaccgagtttcccgaaattaaaattaaacagagtgacactgcggcactgttgtattcttcgggtaccaccggcttgagcaagggcgtggttctcacgcacgggaacttcgtcgcggcgtcgttgatgattggcttcgacgatgatttggcaggggtgttgcatagcgtgttcctctgcgttttgcctatgtttcatgtttttggtttgatggtcatttcgtacggacagcttcagaggggtagtgcggttgtgtctctcaagaagtttgagtttgaattggttctgaagaccattgagaagtttaaggtgacgcatttgtgggttgtgcctccgattattcttgctctcgcgaaacacggtttggttgataagtatgatctttcgtctctcaagcatattggttctggcgctgctcctcttgggaaagagttgatgaaggagtgtgctaaacgttttcctcatgccattgtttctcagggatatggtatgactgaaacttgtggaattgtttctgtggagaatgcaaggatgggaattcggaatagtggctctacgggaatgcttgtcgccggaatggaggctcaagtagttagtgtggatactctgaagcctctccctcctggacagttgggggagatatgggtacggggccctaatatgatgcaaggttatcacaacaatccacaagccacaagattgactatggataaaaaagggtgggtacatacaggagatcttggatattttgatgaggatgggcaactttttgttgttgaccgaatcaaagaactgatcaagtataaaggttttcaggttgcgccggcagaacttgaagggcttctggtttctcatgctgaaatacttgatgctgttgtcatcccatatcctgatgctgaagctggtgaggttccagttgcctatgtcgttcgttcacccaatagttcactcacagaggaagatgttcaaaaatttattgctaagcaggtagcgcctttcaaaagaataagaagagtgacattcatcaatgctgttcctaagacagcatcaggaaaaattctccgaagagagcttattgagaaagtaagatccaaaatatgatgatatcatggtgtaatttttttgtgtgttttcaaaaccatttcggggtttaaattcagaagtagaatgcaagtccagagcgaatccggaaaggtatgatggttgtcatagtggatcaaatatgtatctggctgggaacagtacttactgttgggtctagcatatttcaatccattttataaatgggtcaattcattctagttcacttaaggttgaatctttaaaaaaatggtctgatgtgacctaccatggattggtgagataaacaggttgacccatcaatttacctagaattatttttttacttaaaaaaattcaacaaaaagttaattttt

SEQ ID NO: 196 - DNA, 3315 bp, Glycine max
gaaccgtttctcctcgatcccatatgtgttgatagtgaaaggcatcgtcctcatcatcatctatcatggcatggtttagagctggagcaagcatagcaaaacatgcaattaggagaactctttctaagggtggatccacacaccttgtgtcaagggcaagggtccttccatcgataccatcatcacatagcagaagcttccacagctcggttttcaaggagcaagctgcacctgttcctcgtgcggttcctctttcaaagctaacagatagtttcttagatggcacaagcagtgtgtatctggaggagcttcaaagggcttgggaggctgatcccaacagtgttgatgagtcatgggacaatttcttcaggaactttgtggggcaggccacaacctcacctgggatttctggtcagacaattcatgagagcatgaggttgttgttgctggtgagggcgtaccaggttaatggccacatgaaggcgaagttggatcccttgaatctggaaccaagggaaatccctgaggatttggaccctgcactttatggcttcactgaggctgatcttgatagagagttcttcttgggggtgtggaggatggctggtttcttatctgagaaccgccccgtgcaaacccttagatccattttgacaaggcttgagcaggcctattgtggaagcattggatatgagtatatgcacattgctgatcgtcacaagtgtaattggcttagggataggattgagacccccacccctacacagtttaatagggagaggcgcgaggctatctttgataggcttgcttggagttctttgtttgagaacttcttggccaccaagtggacctctgcaaagaggtttggacttgagggtggagagactcttattcctggaatgaaggaaatgtttgatagggcatctgatcttggggttgagagcatagttataggaatggcacatagagggaggctgaatgttttggggaatgtggttaggaagccgctgcggcagattttctgcgagtttagtggtggtcttcagcctgagggggaagttggactctacactggaactggagatgttaagtatcacttggggacgtcgtatgatcgccctactcggggtggcaagaggattcatttgtctttggtggcaaatcctagtcacttggaagctgttaatccagttgttgttgggaaaactcgtgccaagcagtattactcaaatgatgtggatagaacaaagaacatgggtgtgctgattcatggagatggaagttttgctggacagggtgtggtctatgaaaccctgcatttaagtgctcttccaaattacactactggtgggacgattcacatcgtgtttaataatcaggttgcatttacaactgatccaacgtctggcaggtcttcacaatattgcactgatgttgccaaggctttggatgctcccatctttcacgtgaatggtgatgatgttgaagcagttgttcatgcctgtgaacttgctgctgagtggcgccagactttccactctgatgtggttgtcgacttggtgtgttaccgtcgatttggccataatgagattgatgaaccatctttcactcagcctaaaatgtacaaggtaatccgaagccatccatcaactcttgagatctatgagaagaagcttttggaatcaggggagttgacacaagaagaaattgataggatacacaagaaggtcacatcaattctaaatgaagaatttttggctagcaaagaatacattccaaaaagaagagattggctttcagcgtattggcttggtttcaagtcacctgaacagctttcacgtatccgaaacactggtgtgaaaccagagatcttgaaaaatgttggaaaagcaatcacaaccatccctgaaaatttcacacctcatagagcagtgaagaggatatatgaacaacgggcccaaatgattgaaactggggaagatattgactggggatttgcagaggcgcttgcttatgctaccttgcttattgaaggtaaccatgttcgattaagtggtcaggatgttgaaagaggaacttttagtcaccgccatgctgtagttcacgatcagacaacaggagagaaatattgtcccctggacaatgttataatgaaccaagatgaagagatgtttaccgttagcaatagttcactttctgagtttggtgttcttggatttgaattgggttactcaatggaaaatcccaattcattgataatttgggaggctcagtttggtgattttgctaatggtgctcatgtcatatttgacaatttcttggcttctggtgaggctaagtggctccgtcagactggtcttgttgtgttacttcctcatggttatgatggccagggcccagagcattcaagtgcaagattggaacgctttcttcagatggctgatgacaaccctcatgttatccctgagatggatccaactcttcggaagcagattcaggagtgtaatttgcagattgtgaatgttacaactcctgctaattttttccatgttctaaggaggcaggtacatagagaattccgcaagcctctcattgtaatgtcccctaagaacctgcttcgtagcaaggcttgcagatcaaatttatctgagtttgatgatgtccaaggccacccaggctttgacaaacagggaaccagattcaagcgcctcataaaagatcaaaatgagcacaaagatgttgaggagggtattagacgtttagtactttgctctggaaaggtttactatgaacttgatgaacatcgaacaaaggttgatgcaaaggatgttgcaatatgtagggtggaacagctttgtcctttcccttatgaccttgtccaacgagagcttaaacgatatccaaatgccgaggttgtttggtgtcaagaagagccaatgaacatgggtggatacacttacattttaccccgacttatatcttcaatgaaagctgtaaataggggaggttatgatgatgtcaaatatgttggtcgtgctccatctgcggccacagccactggtttcctcaaggttcaccagaaggagcagactgagattgctgaaaaagcccttcaacaggaaccgatcgacttcccattttgaaaaggcatttgcacatgcatccatcttttttgagagtgataataatgcatttagtttaatttatccaccacgtaaggagctatagttggaaggaaggtgacttcatacatttgctttcgagttttgaccttttatgatcttttggttccttgcaaaaagtcagctaagctga

SEQ ID NO: 197 - DNA, 1264 bp, Glycine max
atttttcggtgtttgctttagaaggggagagtttggtctacacacaccaccacatgaagagcatggtgacgccattgacgagggtcttaccctttcgtcacccaaatggccataatacccttccattttctcttacacgctacccttcttcaccaaacttctccttctcccctctcactctcactctttccatggctgcttcaccccaatcctccgctccaactgtgtcgcctggtgatgttaacatcgacaaagatggtgtatttcaattgattcaagctcatcaggaaaaagctgctagacttccaccagttgaggagattcgaactgtccttgatcgtagcgtgcgcgggatgctctctacattctcaaagaagtttgatggttatccatcagggtctatggttgactttgcatgtgattcaaatggatatcctatattagcagtgagcgacttggcagttcattcaaaggacctaactgccaatcctaaatgttcattgcttgtggctagagatcctgaagataggactgatttagtgattactgtacatggtgatgctatctctgttcctgaaaatgaaagagaagccgttcgagctgcatatttggcgaggcatcccaatgcattttgggttgactttggagacttccaattcttgcgcattgaaccgaaagttgtacgatttgtgtcaggtgttgccacagctttgttaggatcaggagagtttagtggagatgagtataaatctgcaaaagttgatcccatagctcagttttccaagccagtggcgtctcatatgaacaaagatcatgctgaagataacaaagtgattgtgcagcattggacctcagttccagtggactttgccttcatactagatttggatagtcttggtttcaatgttaaggctggttatcagggtgatactttcaagcttcgtgtacctttccctcgatgtgcagaagatagaaaggatgtgaagactctcattgttgagatgcttcaagctgctaggcctaaagttgattgatcacttcacagatcaatgatgaacaggtgctcctagaatcttcatataatccatcaattcaattcatgtgtttcagcctccaagatttgtcattttttcttcattctgagattagttggctatgccttgcaactagatattcatataccacataattattaacactatttatgccaaataaatacttgcatacgtattggtaacatttttgtctgctacttttaaaccaa

SEQ ID NO: 198 - DNA, 1171 bp, Glycine max
gtagttgaccaagacttgggagttatggagaaatgagataagcaacctaaagttgcagcttcagcttcacaatattcttgtctgaataataaaaagaaaaaaggttcatagttgatatctccagcggaacgatgaagtttgaagatttggcagaaggatgcatggcaaaaatactgtcctacaccactcgtgcggatgtatgcaggctttctctggtttccaaagcctttcattccgcggctgaagccaacactgtgtgggattgctttctcccctctgatttgtcctctatcatctccccttcttcttccgttcctccctttcgctctattaaggatctctatctctatctctccgatcgtcccaccatcatcgatcaaggtataaagagttttcaattggagaagcggactgggaacaagtgttacatgctttccgctagagatctgagcattatatggggtgacactactcattattgggagtggacaaccctaccagagtccaggttcgaagaagttgctaggcttcgagctgtgtgttggtttgacattactgggaggatgaacacccgcgttttgtcgccaaatactaattatgcagcttttcttgtgttcaagatgatcgatgccggtggatttcactacgatcctgcggtgttatcagtaggtattttgggaggcaatagcagtaccaaaaatgtttgtttggatcccaacttagtagataatcgacttgatgatagattccatggactccaacgtccaactgtgaggagcgatgggtggctggagattgagatgggtgagttcttcaatccaggcctagaagaagatgagttgcagattaaagtctcggagacaacaagtaattggtggaagcgcggtttcattcttgaaggaatagaagttaggcctaaacatgtttgatccatcaaattaatatacttaacttaggcctatcaaagatatgtatggaatggaagggtgatctttgccaagaatggagggagaaaccggaaacatttgttcttttcttttgttttatttttcttcttttttcattgatcatttctattttgtttttgcatttaggtataatgaactgattgcttgtattgtttcctcattaaatgtggggtttgagtagtttatatttcagtttttttaaa

SEQ ID NO: 199 - DNA, 725 bp, Solanum lycopersicum
aattagcaattttttctagtacaaagatgtctggggaagaagaagaaaacgccgctgagctcaaaattggcgatgagtttttgaaggccaaatgtctaatgaactgtgaagtcgcattgattcttgaacacaagtatgagcagatccagcagatgtctgatgatccaacaaatcagatttcgcaggtatttgaaaagtcgctgcaatatgtgaagcgtttcagtcggtacaagaaccctgatgctgttagacaagctcgagaaattcttagtaggtatccacttgctgaattcgagctctgtgttcttgggaatctttgccccgaaactgttgaggaaggtattgccatggtcccatccatcaagaatagaggacgtgcacttgacgaggaagcaattgagaaaatgctaactgacctttccctaataaagaaattcgagtagtcctattatagtgcttgtcttgctatgctgcagcagtctctgcttccgaacctgtacctccatatgtttattagtagcagctctgtaatgctaattgggctctggcattatgttgaaaactttatctgttgattgaagaagaaaactctctctggacccttttttttctttttggtagctggttgtaaccacaatcctttggtgcacgggctaaatcattgtaatgacatacatggtttgtcgtttcgcttttgtgaaagacaaataagagcataccttgat

SEQ ID NO: 200 - DNA, 663 bp, Solanum lycopersicum
gggcaaaatattttcagttctatttggtttcaaagctgcgttctctccgtattacacaaattgaaaagaaagctttgacgccgacgcaacaatggcggacgatgactatgatatggacggaggatacgtggacgagccaatggatcctgaacctgatgaaggagcagagattgaagaagataatggcaacaatgacgacataccagatcccctgatgggtgaaggtgaggaaaaaacagagcagcaagagcctgtggaacgacctcgtaaaacatcaaagtttatgacaaaatatgaacgtgcgagaatcctgggcactcgtgcactccagatcagcatgaatgcacctgtgatggttgagctggaaggagaaactgacccacttgagattgcaatgaaagagctccgagagaggaagataccattcacaattcgccgttacttgcctgatggaagttatgaagattggggagttgatgaattgattgttgaggattcatggaagagacaagtcggaggaacttgacagcggaagtccctctttgcttgttgctgcagacttattaggaatgttatccgtcgtttctgattgtcttactctgctgaattgttgctgacttaatattactatgaatatattttggaaaactcaagtgattagtc

SEQ ID NO: 201 - DNA, 1272 bp, Solanum lycopersicum
aaagtttacttttagaatccccaaatcacccccggcaatccctaactccttcctcactgatcccgtttctctacggtcgccgcgattcatattttccggccagtgaacttcacaatttttctccgaccaccgacgtatactccgccgtctccgtctccattgcctgtggattttgaagcacaagagaagaagggccctggattgaccattccaacaagttgtccacatagctttctgggttgcgaactataattgagacataaggaagcgtctgcactaggcagactccatatggggatgatcttttactagtcaagtcgaggaatgaatgcctgttaaggacttgattagctgatctgccatagtagggttccatcctcaagctattatcagcttgggaaaggacgaattcgcttcattttgaagtaggcgcgctatggaattgaatgctagtgtgtccacaaaaaggacaatgaaccctaggaagacagatattggaggtaaacccttcatactcatcatttgtggcagcctcgtttactaccactgtgcctatcggaattctagtcttgtctctctcatctcagacgtctttattgtactcctttgttcccttgccattctcggactcctctttcgccagatgaacatctcggtacctgtggatccgcttgagtggcagatctctcaggacgctgccaacatgttttttgcctgcctcgccaataccgttggtgctgctgagtctgttctacgtgttgcttctactggccatgataagcgcttgttccttaaggttgtggctgctctgtatgttctatcatctctgggaaggatagcttcgggtgttaccattgcgtatgctggtctctgctttctttgcctttatatgctcgctgagaacttgcaattgattagctcgaggtatcctaggagaagagacagcacagacacagttcaggacgactaaattgatttgatctggttcaaaagggatgaaggaaggagtcaatgcattatttacagctcttgcttctagttatgccaggttcatcgcgtgttatttgccttattaatgtgatttctctttccattcatgtctgcagccttgtgatttccttacatgtccctgtaatatattcccagtcccatgatcattgtttccctatttaacatggatacatgatataagttgttagctcactgttaaaaaatgaaaagaaaagaatacacttgtgatgtgaattgaaagataagtattttttctaaatt

SEQ ID NO: 202 - DNA, 1035 bp, Solanum lycopersicum
acgaattcaaatttaatcgagacatggaaaaaaaatttaaatttttgataattagccattgatggtcaaaaactagttgagctaagcgaaaggacataattggtcttcgtgtcccaattgagtgtagagctcagctgtttcaacattttcttgtgcttcccattcatttcttgaagcagagctggaatttgaattctgagggatgctaggaaaatcatttgctactcctgtgctgacctttaactctgcatcatgcttctcctctcctggttgtgattccgtctcaacaacagctaacactctagtagggtatgtaaattgctcgagtagcattacatttaatgttactaggggatcttggacgtccaattatccattcaagaaatggacgttgcattcaacagctactgacaatatagtattaactgaagaagagaagaaaacgtggaacgatagcagacaagctctttctgcgttaaaatttagcccagaggaagaagacaaaatattaggaaaagcatttggccacatacattcgccttactggtatgaagaacggaagaaagaggttccacgactagaagttgtgaacgagatactggattatctaaggagtttaagccttactgatgatgatctcactaaacttgtcaagaaattcccagaagttcttggatgtagccttgaagatgaaatgaaaaccaatgtcgaaattctggaaaaacaatggggaattgaaggtaaaactctgagaaatttgcttcttcgaaatccaaaagttttaggctacaatgtcgattgcaaaggtgattgtgtggctaaatgcactcgctgttgggctcgattctagctgcattcttgtgtttcatcctctatacctttctttatgtataactttcgccaaccattttatctaattattcaaaatcgaaagtaaattcatacaagtctgtattgcactgatatgtgactcaagtttagatcacaaaggatgttacagagacaatgaaatgaaaaaaatcagagcaattttta

SEQ ID NO: 203 - DNA, 900 bp, Solanum lycopersicum
agaaacccaaaattgaaacaaaaaaaaatcagtcttcaatggcttctctgctgaacccacctctcactctgcctcaaaacaagctgaaccctgggggtgtcttatctgtatctactagtggaataccaaacaaaatttttcaaccatcttcaacacgatggagccacaggcggcgtttgatgacgagagctaaaccatcggtggaaatggatatgctggcaaaagattctgtaggcaccgacgctgttgatgataaggattttggagttgtttgcatgcaccacgttgggatactatgtgaaaaccttgagaggtccttagacttttaccagaacattcttgggctagaaataaatgaggcaagaccacatgacaaacttccctatagaggtgcttggttgtgggtgggttctgagatgatacatctaatggagcttccaaatccagatccttatactggtaggcctgagcacgggggcagagaccgtcatacttgcatagcaattcgcgatgtgtctaagctgaaagctattcttgataaagctggcattccctacactcttagtcgctctgggagaccggccattttcactcgagaccctgatactaatgcactagaatttactcaagttgatgcttgacaggatctggactgcttgctctccaatttgtaatccttatatatagttaaatatacagctattgtgaatatataaataggggatattcaacaagtagaatctattggaagcacttcagctattagtggttatggcttatcaatccccacaatgtcatgtgctatttatgtgatttaaacatctgtggttgatacaattttcgcgaacatgtgtactgtttactcctatttaaataacaccatctgcagagatttatgcc

SEQ ID NO: 204 - DNA, 560 bp, Solanum lycopersicum
tgatcgcaattcaccaatttccatagcagaggaagaagaaagagtttactccaatggcgtctggatggggaattacagggaataaaggacgatgctatgatttctggatggatttcagtgagtgtatgtctcgatgcagggagcccaaggactgtgtacttcttagagaagactacttcgagtgtcttcatcattccaaagagtatcaacgtaggaaccgaatctacaaagaggagcagcgccaattgagagctgcttcacaaaagaaaaaggaaggtgtagatggtggtggtggtggtcatcactgacctttattattcttgatcaatcatggttttatcaaccaaaagacattgaagtaaactgtatgtcgttttgaattttgaaataaagaattatatcagttgcatttgatgtgagttgcatcattgaaatgactcagttcagtttctttctcatatggcctggccttcgttttgttggtgataaggaacatatgttttaagggcacatttacttcttaccattggcactagacctatgatatcagttctttcttt

SEQ ID NO: 205 - DNA, 3667 bp, Hordeum vulgare
atcgcaaagttcatcagaccctcgctcgccagctctggtcgagcaagggcgagaaaaataacactactactctatccactccagactctagagagagagaaaaaagaaagaacataaaagccgcggctcgccgggcctccattccgttaattatagtcgtcgtcgtcgtagatcccccatcccggagcaccccggcccttccgatcctcaagagccaccgccgcacgccgcccgaggatcaatcccgcctcctgccaccgcctctatactctctccgcccgcccccgcgttcgtctttggcaatccggagtttccaccactctctttcttgctgcttcttaatgctggtccaggggatggtcggcggcggcgttttctgttgtccggtggcggcgatccgtcgacgtagcgggaggaggagcacctgaggatggcgtcgctgccgccgtgttccctttgaccgaaaggtgccgctcctttccggaaagggggaatttgtttctgcgtttctggcgacttccttgcgccgattccattcctcgcgtcgctaaatctcgccgggatttcttcccttcctccttggactcccggtcgcagatccttttcctccctgcccgcttgcccattcttgctatctgcttgttcggtcgctctgcaattgtctgcaaccttgggttcgaacttgttgctgctgaggggctgtgagtttgctggtggagggtggtgaggaggatcgcatctgggagaggatcttggtggtttggtggcggacgggatggcctcgagatcctactccaacctcatggagctcgccgccggcggtgaccgcgaccagccgacgctgccgtcgctcgggcagcgacgggtgccgcgggtggtgacggcgtctggcattgtgcccggcctccactgcttcgacgacgacgctggcaccgcctcggtggcctccgaccagccaaaccaggcgccgcgggagcgcaccatcatcgtggccaatcaacttcccatccgcgccacccgcggcgccgacggcgcctgggagttctcgtgggacgaggacagcctcctgcggcagctcaaggagagcatgcgcgggcaccagggccgcgtcgacatggacttcgtctacatcggcagcctgcgcgacgacatcccggcggaggagcaggagaaggtcgcggccgagctctacgatcgcttccgctgcgtgcccgcgttcctggccgccgacctccgctcccgcttctaccacggcttctgcaagcagcagctgtggccactgttccattacatgctgccactgtcgcccgagctcggcggccgctttgaccgcacgctgtggcaggcctacgtgtccgtcaacaagatcttcgccgacaagatcctggaggtgatcaaccccgaggaggacttcgtgtgggtgcacgactaccatctcatggtcctgcccaccttcctgcgcaagcgcttcaaccgggtcaggctgggcttcttcctgcacagccccttcccatcatcggagatctacaagactctgccggtccgcgaggagctgctccgggcgctgctgaatgccgatctgattgggttccacacatttgattatgccagacatttcctatcatgctgcagcaggatgcttgggctcaagtacgagtcgcagaggggatacattgcactggactattacggacgaactgtcaccatcaagatactgcctgtggggatacatttagtgcagctgcagtcggtgctcaacctcccggagactgggctcaaggtcgccgagcttatgaagcagttctgtggtcggggccgcatcttgatgcttggcgtggacgacatggacatcttcaaaggtatcagtctgaagcttttggcatttgagcagctgttggtgcagcatccagagtggcgagggaagctggtgctggtgcagattgccaatccggcgagggggcggggaaaggatgtgaaggatgtacaggatgagagctatgcgatggtgaggcgcatcaatgaggcatttgggcagccagattaccagccagttatactgatcgacaggccactgcacttctatgagagaatggcatactatgttgtcgctgagtgctgtttggtgaccgcagtgagggatggcatgaatcttataccctatgagtacatcattgctaggcaagggaatgacaagattgacaggatcctgggtctcagcccttccacaaagaagaaaagcatgcttgtcgtgtcggagttcattggctgctcaccctccctgagtggcgcgattcgggtgaacccttggaacattgattcagtgactgaggcaatggagaaggccttgtccatatctgactgtgagaaggtgctgaggcacgagaagcatcacaaatttgtgagcacacatgatgtcggatactgggcaaacagcttcctgcaggatctgttgaggagttgccaagaccataacaagaggcgctgttggggcataggatttgggctaaggttcagggttgtggcccttgatacgagcttcaagaagctcgcggctgagcagcttgtctcagcctaccggaaggcaaccacgcgtgccattctcttggactatgatggtacgctgatgcctcagacatcgttcggtaagaatccgggctccaaaacgatagacatgttgaacagcctttgtcgcgatgagaagaacatggtcttaatcgcaagcacaaagacccgggcgaccttaagtgaatggttctcaccatgcgaggacctaggccttgctgctgagcatggctacttcctcaggctgaaaagagatgcagaatgggagacatgcggcattgcaacagactgcagctggaagcagatcgcggagcctgtgatgaaaacctacaccgagacaacggacgggtcagtcatcgaggacaaggagacagcaatcgtctggtgctacaaggacgccgaccctgattttggatcttgccaagccaaggagctccatgaacacctggagagtgtcctttccaacgagccggtatcggtcaaagctgacgtgaaccatgttgaggtgaagccacagggcgtgagcaagggcctggtggcgaagcggatgctgtcggcgatgcaggcgcgagggctcctgcccgacttcatcctgtgcatcggggacgaccgctccgacgaggacatgttcgaggtgatcaccaccgccgtggacggcccctacctgaaccctgaggcaaaggtcttcgcctgcaccgtcggccgcaagcccagcaaggccaagtactacctggacgacaccgcggacatcgtgcggctgatccaggccctcgccaacgtctccgacgaggtgcagggcggccctccttcctatttcttcgcctgcgccggcaccagcaccgacgacagggcgctgaattgagggggaaagccggcaaagaagaccagcaccagcacagccccggcctgaataagaccgcgcttcaggaaataccctaggactaatggaccgtgccgtcggctcgcataatcgtgtgctgtgctttagtattagtagtagtagtggtcggtcgtcgttgtcgtggtggtgttgttgtttcgccgttgtgtacatagactccgttgaacttggtttaattgccgactaaatttgcagcccccagct

SEQ ID NO: 206 - DNA, 1187 bp, Brachypodium distachyon
gggacgtgtctcgccgcgcgtccaccagcttcgccccgcgcctctcaggcgccgtataaagatccacctccccgagccgggcatcctcactcaaacaacaccagccaccagctcatctctcactgaccttaccacttgaattgggatcgaaatggccgcgtcggcgctgcaccagaccaccagcttcctcggcaccgccccacgccgcgatgacctcgtccgcagcgtcggcgacttcggcggccgcatcaccatgcgccggactgtcaagagcgcaccccagagcatctggtacggccctgaccgtcccaagtacctgggcccgttctccgagcagacgccgtcgtacctgaccggcgagttccccggtgactacggctgggacaccgcggggttgtcagctgacccagagacgttcgccaagaacagggagctcgaggtgatccactctcgttgggcgatgcttggcgcgctcgggtgcgtgttcccggagatcctctccaagaatggtgtcaagttcggcgaggcggtgtggttcaaggccggctcgcagatcttctccgagggcggcctggactacctgggcaaccctaacctcgtgcacgcgcagagcatcctcgccatttgggcatgccaagttgtgctcatgggcttcatcgagggttaccgtgttggtggaggccctctcggtgaggggctcgacaagatctaccccggtggcgcctttgaccccctcggtctcgccgacgacccagacaccgccgctgagctcaaggtcaaggagctcaagaacggccgcctcgccatgttctccatgtttggattcttcgtgcaggccatcgtcacgggcaagggacccgtcgagaacctcttcgaccacgtcgccgacccagtcaacaacaatgcatgggcctttgctaccaacttcgcccccgggagctaaatgagaattagcagctagctgtagtatatatcggtccatccatcggacgatcgatatatgcatgcatgtgtacttgtacgccgtagatcaacttgtacctttgtctagttatgtgttgatttgtaccatggtggagtgaaccccgcgcaatgtaattaagcatgaggtgcacgagtgaatgaatgacggaagaatcgtgaatcgtgtgtaccattagtcaatccaatcatccactgatcgtacc

SEQ ID NO: 207 - DNA, 1485 bp, Brachypodium distachyon
agccggccggcgtcatcgttgtctccaaagcgccgagtgcctatacctagcttccaaaactggagtccaatacagacagacgccacagccaacaattaacctcggcgcgcacaagcacagtacgcccaggagcacgcccaggcatggacgtggaagcgcccaaggagccgctccccgtgggaggagcggcgcgcggcaccagcagcaacaacaaggcgatgcactggctcatggtggcgctcaactgcggcatgctgacgctgggcacgacgggcgggccgctcctgagccgcctctactacagcaagggcgggcagcggcagtggctgtcggcctggctcgagacgggcggctggccgctgcttctcttccctgtgtccttctcctacctggcccggcgcgcccgcgacgggcccggcgcgcccctggtgctcacccggccgcggacgctcatggccgccgcggcgctcggcttggccacgggcgccgacgacttcatctacgcctacgggctctcctacctgcccgtctcaacctccgccatcctcatctccacgcagctcgccttcaccgtcttcttcgcgttcctcgtcgtgcggcagcggctcacggccttctccgtcaacgccgtggcgctgctcaccgtgggcgccgtcgtcctgggtctgcacgcctcgtccgaccgccccgcgggggtcaccagggggcagtactggctgggcttcttcctcagcctcggcgccgcagcgctctacgggctcgtgctgccgctcatcgagctcgcctacaagcacgccgcgggcggcggcagggaagtcacgtacgcgctggtgcttgagatgcagctcgtcatggggttcttcgccaccgccttctgcaccgtcggcatggtcgtcaacaacgatttccaggcgatctcgagggaggcgcgggcgttcgagctgggggaaacccggtactacgtggtgctggtgagctgcgccgtcctgtggcagttcttcttcctgggggccgtgggggtcatcttctgcgtgcacacgctgttcgccgggatcctcatcgccgtgttcatcccggtgacggaggtgctgggcgtcatcttcctgcacgagaagttcagcagcgagaagggcgtggcgctcgtgctctcgctctggggcctcgcctcctactcctacggcgagtacagcgacgccaaggccaagaagaagaaagccgccctgcaagcccaagatccgtagcattgtatatttgtttttttttcctctttcgaagtttcatatttcagtttgtatgtgtcgtatatgtgggctcgtcgtagccatgggctggctagcagatgtatttatcgatttatgtgtgtgactgaccagtgaccagatgagatagcaaactcaaaattttacagtggaagtgtacaacacgtaagggaatacgtgacattattttttgaataacaccgtgcgattcagcaattatgcaaaa

SEQ ID NO: 208 - DNA, 2265 bp, Brachypodium distachyon
tgccatttaccagctttgccatccagagcgagcgcggctgctatacgagccagtacgagtggtagctacctaaacaggttgactcctggacagagtgagcggagacagcgagagaagctagctactaaaaaggaattcaactattcaagcatggacgtggagagctccgcggcgcacgaggtctccgtggactggcggggccgcccgtgcgagccgcggcggcacggaggcatgcgcgccgccgtcttcgtcctagggatccaggcgttcgagatcatggcgatcgcggcggtggggaacaacctgatcacgtacgtgttcggggagatgcacttcccgctgtcggaggcggccaacgtcgtcaccaacttcgtgggaaccatcttcctcctctcgctcgtcggcggcttcctctccgactcctacctcggctgcttctggaccatcctcaccttcggctttgtcgagctctcgggcttcatactgctgtcagtgcaagcacacctgccgcagctgaagccggcgccgtgcaacatggcgtccatggacggcagctgcgagcaggcgaggggcttcaagtccagcatcttctttgtcgcgctctacctggtggcgctcggcagcggctgcctcaagcccaacatgatcgcgcacggcgccgaccagttcgccgccggtgccggggtcgacaatgccaagaggctctccacctacttcaactcggcctacttcagcttctgcctcggcgagctcttcgcgctcacggcgctggtctgggtgcagacgcactctggcatggacgtcggcttcggcatctcggctgccgccatggccgccgggctcgcctgcctcgtgtccggcgcggccttctaccggaacaagcctcctcagggcagcatcttcactcctattgcaagggtgtttgtggctgccttcaacaagaggaagcaaatctgccctgccagtccagccaacgtcggagtctgtgagccggctcgcctcgacggcaacttccgccacggcaacaaattcaggttcttggacaaggcgtgcatcagggaaaacgcagggcagcagcagggtcaggacggcaacacgaagccggagagcccgtggcggctgtgcacggtggccgaagtgcagcaggccaagacgctcctggccgtgaccccgatcttcgcctgcaccatcgtgttcaacaccgttctcgcccagctgcagacattctccgtgcagcagggaagtgccatggacaccgccctcggcggccacgggtccttccgcgtcccgccggcgtcgctgcaggccatcccctacgccatgctcctcttcctcgtcccgtgctacgagctcctcctggtcccgctcatgaagcgcctcacgggcacccggtccggcatcaccccgctcacccggatcggtgtgggcctctgcaccgtcgccttctccatggtcgccgcggccaccgtcgagcgccggcgccgcgacctcgcgctctcgcccgggggagcgcagcagaagatgtccgtgctgtggatcgtgccgcagttcctggtgttcggggtgtcggagatgttcacggccgtggggctcatcgagttcttctacaagcaggcggccgcgtccggtgccggcatcggcatgcagtccttcctcacggcgctcacatactgctcctacgccttcggcttctacctcagctccgtgctcgtcaagctcgtcaacatggtcacggcgggccacggaggcgccggcggatggctcggggacaacgacctgaataaggacaggctggatctcttctactggatgctcgctgtgctcagcgtgctcaacttcttctgctacctggtatgcgcaaggtggtacaattcgggagcggacggccttgatgccgcctctgctcagattgctgctgaaggcgacggcaaggagatcagctgaacaactgcaacaagattgaaactgtatatgcgtataggtttgaaaaaatagtggtgggggaaggagtactagttctaagatgagtaaaatgcagtcgcagtcattgtatttgaaccgtattctcggtttagtcactgtattttgaaaaccggaaaatacggtcactggactcgacgaaatatcccacatacggtcaccgttacgagattcatacgtatttgtacatctcggttgacacgtaggcgtggcgtttttgcattccggcccttctcggaaaacaatagccaaacagttcgtctttgtcgtcagagaaaaacagaa

SEQ ID NO: 209 - DNA, 1680 bp, Sorghum bicolor
cacgccgctgtgatgactgcagtgcatgcatgcaccggaaccgcaaggaaacttgggcgattccccccgacagctacgtgtcacccgcgcgcgccagtggacgagcctgccggaccccatccatcccatcagccatggccatcacttgacccagctctctcgggttgcctgcccatcccatcctcctctccttgataaactccgtggtccgcaccgagccgagccacgcacaggcaggcactggcacgctcgcacgcacgcacgcaccagcaccacatgcatggtggagcctagcacgggcagctagctatagctccccgccgccggcgacgaccaccaccaccacatgttgcatgagcagcaggcaccgccatcaccaccgccggaagtagaagcagcgccaccgcccgtgccatcggcgccgagcccggccaggaaccaccaccaccacgacggcgacggcgacgtccacgatgtcgaggtcacgacgttccgcgacatccaccctctgacgcccgacgtgccgacgccccccgcgcgcaccaggtcctgggacaccgccagccaccgctccttctcgtccgaggagcagttcatgacgatgagccgcgagttcacggccatggtcgccgccggggcgaccatgcagacaggcggcggcgccaacggtaacggcgggtacgacggcgaccagctcaccagcatcggcgaggacgagctggaggagaccaacccgctggctatcgtccccgacagccaccccatcgccacgcccgccaggtccagggcgtccgccgccgcctccgcctccgggctggaggtcgtgccggcgccgacgccgacgccgcagcagccgcccgcgcacgtggaggccagccaggtgaagaaggaggaggtggagaccaaggtgtcggcgtggcagacgaacgaggtggccaagatcaacaaccgcttcaagagggaggaggtggtcatcaacggctgggagaccgagcaggtggagaaggcctccgcatggctcaagaagatcgagaggaagctggacgagcagcgcgccaaggcggtggagaagacgcagaacgacatcgccaaggcgcggcgcaaggcggaggagaagcgggcgtcagcggaggccaagcgaggcctgaaattggccaaggtgctggagctcgccaacttcatgaaggccgtcggcagggtgcccaccaagcgctccttcttctagccggccgatctatccctggcacctccgatccccagtgctgctgctactgctgctgcctaaagctacgaccatagctagctctctctgtgtccctgcgtgatcgatgtacgctcgacgctgcatccgagaacctaactgtaaaaaagaaaaattgtaagctgtatacgtactgcctgctggttccctgtgatgcctgtgatccatcacagggtggccgttcttctcctttttttttttgctggcttgtactatatatcgatccatatggtggtgcttgaacgaactgtttgcttaaccctgcaaacatacagtactccattacattcagaaaccacaacactgcaactaagagctgtttgttacttgttcaggaaatagaatacggccacattgcatcgctgcagtgggtgaaggtttttctttgaaatgaacgtgaaggtttttttcttgcggtt

SEQ ID NO: 210 - DNA, 1252 bp, Solanum lycopersicum
gaactggtgttcagcgtctcttctctgtgtcttcctggagaagaaaaaggtaggttttggaggtgtaagttaaattgtctgactccgcaacatggatggtatgaacagctattggcaattcggggatgagcttcgaggacaatcaaaagtatcggaggatcatacatggacaacgggtactgtaaaattggctgagcagttaaggtccaagggtgagcgggtgaataaccttgacctttcgaaaagctcagctgaaagtaggttcagggtttatcttggtttacaggaagataacaagtgggaaaaccaatacctcaacatgttgaattttgataccaagataactgacaatacgaccaagagctccttcagtaatgacattcacaacgttaattctgtttgtccgaaatccaatgtcaacagcttgggaaatatgtcatttagcaagttcagtagcaaccacacaaatgacgctagcagctatggcaataacaaaaacactgagagtatcaacgggaacaatgctgttgacaaaaggtttaagactttgcctgctgctgagacactgcccaggaatgaggttcttggtgggtatatctttgtttgcaacaatgacacaatgcaggaagacttgaagcgccagctgtttggtctacctccaaggtacaaagattctgtgagggcaataacaccagggttaccgttgttcctctacaattacactactcaccagttgcatggtatctttgaggcaacaagttttggaggttctaacattgatccaactgcttgggaagataagaagtgtaaaggagagtcgaggttccctgctcaggtgaagatccgtatcaggaaacttggtagggctttggaggaagatgcttttagaccagtgctgcatcactatgatggacccaaatttcgtcttgagctctctgtgcccgagactttggacttgatggatctctttgaaaataccagcgtgttcgcgccagtctgaagtcatggatttattatttattagcatatattatgaactcatgaatattgtagtttagtagtagaaacgtgttctccacagatttccaaagcacaattttggtgtaaagtctggctgagagaggttctgaatagcagggttggctaatttagccaatgaagtgtgattttgtttggagatgcttgaatatgagcctcccaaatttagtgttgtgatcttataatgaattagagaagtaatgattgggtgaaa

SEQ ID NO: 211 - DNA, 1531 bp, Triticum aestivum
aatcaatcccaacctccactgcctccatagctggctggcagcctagcttagctcctgctctgctctgctgtctccgccggccggttagtcaccgatggaagccccgctcctcctccccgtctccaccgccgcctcctcctccacgtccatcaccgtcgacgatgacagccacggcacggcccacaacgtctccccttcccgcgcctcgccatccggccggagcatcgccgcgcgctacctcgccgtggccctcgtcgccgccgtctcgctgttcgcgcagcacgaggcgtccaagggcttccgcatcgacgtcgtccggggcggtggcacggccggtgccgccggccggcgcttcgacctcctcttcgtcgccaacggccgcgccgagcgcgtgctccaccgcgccagccgccgcgtcgaggagacgctcttcccagacccctcgttcccgcgccgccgggtcgcccgcgtcaccgtgcggctgatggccggcggcaacctcaccgccgatgacgcgaccgtcgacgctgtcacggacgtggagtacgtcatctcgctgagcccacgcctcctgtcgccgtcctccggaggcagcagcagcgccggggccgccgacgctgtcgcctccgcggtgcgccgcgccgtggcgcgcatgtggctgtgggacggccgcggcgccgcgccggcgcgcgttacggagtccatggtggagtacctcgccaccgccgtcccggacgagtcgtcgtcgccggcggaggagcacgcgtcggcgtcgaacacgcactgcatctcgccgcggttcctgaagcacctggagcggcggcgcgcggggttcgtggcgcggctgaacagggcaatgagggaccggtggagcgacgccgcggtggacgccgcgctcggggcgccggcacggcccgtctgcgccgcctacctcgcggcagcgacggaaaccggcggccaacgaccggtggttggctccgcggtggcggtttgagagccagcaaggcgtcggaacagcgcacgaagggcggtttgcgagagatcgcacatgcacgccgtgcttgtcacgtgactcggtcggtcactcccttgtacgtaaatgtaattcatccgccattatcggtgagtggttaattaagtaatgggatgagacgagtcagcggtcgctactgctacaaatgaagtttttaggggaactacaaatgtagttaagcacaagccttctttgtaaatccacagtagttcttcatgtttgtgtggtggaatatatggcgatctcaaataattgtagaacgctcaagagaaaacaagccgaccattctatcgatcacttttgatttatggtctttctagttctaggtttttggtcccttataatcgatagtgtttattccccagaaacttaatagatctcataatagggttacagattgtctggaaaggtttggcagaggacctccatgtattgaggctctcttgctggaagattgtaacactatcttaatggaataaactactatttatctcacaa

SEQ ID NO: 212 - DNA, 1414 bp, Zea mays
tccgtggttgccatcgccgtctccactagaggtggatctacagtgtgggcaacgtgggtcataaccccacctcagattttataatattcataataccatagaagattagagggagcaggagatctcagccgccgagcgcagcgtctgagcagcggccacccattcgttgttcacccagggagtctcaggtcttccgtcggctggcatcggccaccgttccatcgcatcgccgaccgccgccccacatcccaccgcggcaccgccccacagacaaagagatattcaaatcccttgatgatgagactattactagaagattccagcgtcttaaaactagaagaatgcacttgcctcgagtcataactacaagattaacaacttagtgattggatttttgtcggtgattttggtgccgcactgcagattaagagagaaatttcgtcttgggcagttcggctgacagaccaacctacggcctggattggagacttatccgcgacccctcctccccacttcagcttcagcgcaagccatcttcccgccacaggctcaaaagcaatcaagcgactcctcccacagtcccacttccactcccacccacccacacgcacggccgcaggcagcagcaccatgtggtcggcagcaacggcggcggcggcgcgcgcggtgtccgtgtccccagtcccggcgccttcgctcctcagcggccggcgcggcgggtcgcggggcggccgggggtcggtgtcggtgcgcagcacggtgtgggacttcgtgggcggcgacctggtgcggccggacctgggcaagtggctggacgacgtggagaagcacaaggcgctggccatctacccgccgcacgagggcggctacgagggccgctacctgaaccgcctccgttaccagggctactacttcctcgacctctccgcgcgggggctcggcgacccggagaccacgctcaccaaggtccaccccgtctgcccgcctagcctcggcaggcagccggtggcgcggtggtacttcccgccggaggtggactacaggctcagcctgctgcacccggacgccaaaggcctcgtcgtctggatcatcgaagccaaggttctgtccaaggctgagctgcagttcctggccatgctcccggacatccgccccaaagtcagggtgatcgcagaatgcggcaactggagaagctttgtttggaagccactgaagcagatcgcaggcctcgagccggacccggacgcggaggaatgatcaagcaagcaggtctagctagttgtctaccagactggctactgctactgctacactctccaattgcttctgggacatctctccctgccattcctgcagctttgcactgaatgagagaggcaattaataaagatatacatacatttttttggcacga

SEQ ID NO: 213 - DNA, 2163 bp, Zea mays
gaaaggtagatattttttcccgtctcgctcaatgattcaccccatcgcagccatcgatcagaaaatttacggctcataattctcgtctgcttatccgctcccttctctccctcaacttcagcaagttccccgcaaaaccgcagccggaggtcgccggtcgccaccaccaatggggccacccgccatggcgttccaagccctcaccctcacgccactccccttctcactccacagctcgagccgccgcgtccgcgtgcttgccgttgcggccgaccagactcctccgcccgcccccccttcggagccggcgaacagccctagccgcctccttcgcgagctcgcgcagcggaagaaggccgtatcccctaagaagaagcatccgccgcgtcgcttcatcctgaagccacctctcgatgacgagcgccttacccggcggttcctcagcagcccgcagctgtcgctcaaggcgctcccgctgctctcttcctgcctcccctccgcgccgctctccaccgccgacaggacctggatggacgagtacctcctcgaggccaagcaggcgctcgggtacccgctcgcgccctcggagacgctcggcgaaggcgatgactgccccgcgcgtcatttcgatgtgctgttctacctcgcgttccagcatctggacccctctagcgagcgcacgcggatgcggcacgtacggaacggccactccaggctctggttcctgggtcagtacgttctggagctcgcgttctgcgagttcttcttgcagaggtaccccagggagtcacctgggccgatgagggagcgggtgttcgctctaattgggaagaaagtgttgccccgatggctcaaggcggccagcctgcacaatttggtcttcccctatgatgatttggataagatgatacgaaaggaccgggagccaccgtccaaggctgtattctgggcaatatttggagctatatatttgtgctttggaatgcctgaagtctatcgtgtcctttttgaggcatttgggatggatccagatgatgagagctgtcagccaaaattgcgtcgtcaactagaggatgttgattatgtttcagtggagttcgaaaagaggcagctcacttggcaggatgttgctgcctacaggccgccaccggatgctctttttgctcatcctaggcttttccgagcttgtgtgccaccaggcatgcatcggttcagaggaaatatttgggattttgacagtagacccaaggtcatgactaccctaggatatcccttgcccatgaatgacagaattccagaaatcacagaagcaaggaatatagagcttggacttggtcttcagctgtgttttttgcacccatcaaaacataagtttgagcatccaagattttgttatgagcggcttgaatacgtcggccagaaaattcaggatctagtaatggcagagaggctactcatgaaacacctcgatgcaccaggcaggtggctggcggagaagcatcggaggacgttgatgaacaagtattgtggacggtacctgcgggacaagcacctgcagcactacattatctacggggagacagtgcaagacagattcgaacacaatcgacgtctaaggaatccttcaacgacctctgtccagcaagcgctacatgggcttgcatactgtgtgtatggcaaacctgacgtgcggcgtttgatgttcgaggtgtttgacttcgaacaggtccagcctaaagcagtctgaggatcttctccattggtaccgatgctagagttgctgaatgctgaccaacaagaccccaatggcagtggtacaaatgctgtagattcttgaagtcgtccattcgacaggagatctttcgattctgaagcctgaagccctgaaccctgagctgggacagctgattagccactgggtcctgtctctcctgaaaccgtcactgttccaaccttcttgtccgtcggaaatggtagactagtgatgatgtggatcggaggctgctgttgtttgaacttacaattttgataattcgttgtaaattcctgtttgggcagaaacgcaaatagcagcagcatggcagattcatttcctatcagaattgtagtccgtaatcgagaagcagtaagatgaataatataaagatattcattcgtccgcca

SEQ ID NO: 214 - DNA, 3639 bp, Oryza sativa
caccaaacgaaacgatcccgagctctctctgcctcctgatatacgaaacctacgggggcgaagaagctgaagccgaggcaaacgcccgctcgctcccgttcgtttcgtttcgtttccatcagacgcgcggccgcagccgagcgcgagcgcggaggccgcgatccggctcgcctccccaccacctcccgttccgctccctcccccccaacccccgcatgctgcctcctccccgtcgcctcctcgccgccgccgccgtgtagctccgtccccgaccatgtctgcctattccgacaaaggggagggggatttggagattgggttggcgtcgccggaggcggagggagggggtcctggagggccggcgctggacctgtcgccacccagggcggtgaggcggccggggctagtgatgtcccactccgggaagcggctggaccagtcgccggcggcgtcgccgtcgccgtcgcggccggtgctggtgatgtcccactcgagcaaccggctggaccagtcgccggcgcggccggtgctggtgatgtcccgctccagcaaccggctggaccagtccccggcgtcgtcgccggcgtcctccaggggccccgtgctggtgatgtccggctccggtaaccgcctggacagctcgggcccgtccccgtcgccgtcgccgaccgccgcggcggctgctgcgccggtgctggtgctctcgaactccggcaagcggatggaccaggcggggcggaagaagtacgtcaagcaggtgaccggccggcacaacgacacggagctccacctcgccgcgcagcgcggggaccttgaagctgtgcgccagatcatcgctgaaatcaacgcgcagatgaccggcaccggggaggagttcgacagcgaggtcgcggagatccgcgccgccgtcgtgaacgagcccaacgaggtggaggagaccgcgcttctcatcgccgctgagaaggggtttctcgacatcgtcgtcgagctgctcaagcactccgacaaggagagcctcacgaggaagaacaagtccggattcgatgttctacacgttgccgcaaaagaaggccaccgagatattgtgaaggtactcctggatcatgatccatcccttgggaaaacgtttggccaatcaaatgtgacacctctgataactgctgcgattagaggccacattgaggtagtgaaccttctactagagagagtttctgggttggttgagctatcaaaggggaatggaaagaacgccttgcattttgctggccgtcaggggcatgtagaaattgttaaggctttgctggacgcagatcctcagcttgctcggaggactgataagaaaggccagactgctttgcacatggctgtgaaaggaactagtgctgcggttgttagggcactagtgaatgctgatccagctattgtcatgctgcctgacagaaatggcaacttagctttgcatgttgctaccaggaaaaaaagatcagagattgtaaatgagcttctccttcttccagacatgaatgtgaatgcacttactagggatcgcaagactgcgtttgacatagcagagggtcttccactttcggaggaatctgcagagataaaggattgtttgtctcgtgctggtgcagtcagagcaaatgatctaaaccagcctcgagacgagctcagaaaaacagtgaccgagatcaagaaggatgtgcacacacaacttgagcaagcaagaaaaaccaacaaaaatgtttctggcatagcaaaggagctgaggaaactccacagggaaggcatcaacaacgcaaccaattctgtcactgttgtggctgtgctctttgctacggttgcatttgctgcaatcttcactgtgccaggcggtaacgataacaacggcgtggcaatagctgtgcatgccgtatccttcaagatcttcttcatcttcaatgccattgccttgttcacatcattagcagtagtggtggttcagattacacttgttaggggagagactaaagcagagaggcgggtagtagagattatcaataagttgatgtggctggcttctgtgtgcactacagtggcgttcatatcatccgcttatattgtagttgggaagcacttccagtgggcggcgcttctggtgaccctaatcggcggagtgatcatggctggtgtgcttggtacaatgacctactatgtggtgagatccaagcgcacacgttcgatcaggaagaaggtgaaatctacaaggaggagcggctcaaactcatggcagcaaaactcagagttttcagactccgagatagaccggatatacgccatatgaagctcattctggttagttgatctctcagctttttggcagccataacacccgaatgtaaaaatgaaataggatgttataaacagaatgacccttgagattattattaggggttaactgtatacgttccaataagctggtgtaatctgccatttcctgttcttgaatcagcaggagctagccgacagtgctgttgtatactagtactacagatagactggttatcagaatatgcagcctccgctgtgctccatgtgcattgccttcagcttcatatcttcttttttgatactacaacaatgatgatagcagaatgatatgtatgctcctctgttctatcgttggctatcctaatcatgttctgtatccagtgtctctagaagcatttatgtttttcctcttgaacacaataatcttattctgattaagatcaaactattctataaaattccttttgttccaatggaatcatagccttgaaggagacatccatggtggagagggctttctcctctttgtccatggcacgtgagaagatgagaatatttccatgtcgacatgccggattttctaccagagaggacaagcctggatcagcagcagtaatcttcagaacagccatctcgacagggacggggcaaattgccgaattaatttcaaaaaaagcaagtatgatggagacggagcaatcaggctactgagcccggccgcaacttgatcgccgtcagtagtctctcttgcttgtgggcttcaatcatcagagcgtctgaaaccgcatgcgtgtgggcgtcgaacagtaaaggtcaagtgaaacggtgtgtggggtgtggcacattcactcactactccattgcagataaggcattgacgctttggccccagtagactgattggttgacctgacgcttggagtcgtcgttcctcacgcatgatttattgccgaacagttgaattaaaccactacaattgttgccacagatcgtcagaaactgttgtaccacggcctaattaattttgtgcaagtactacaactcatctgaaaggaacagactgcagggaccaaagcaaattaatgcagaagctcttgaagacaatcagatggaggaggtggatttttgtcgtcctctcgttctttttcatgtcgtttaaaagtcataaaaaattgaaaaaaaatcgagggacatagactttcccccagatggaaagatatgtgaaggagaaggctttatggtagctgttctttagcaatctttagatggtgtgatgatgtggaaggctgcaagccgaagaaggcctggtgtgccgcactatcaagtagc

SEQ ID NO: 215 - DNA, 1629 bp, Oryza sativa
ctccacctctccacgccctccctccctcccttctctctctcccgcgcgtgacgacgaggagactcctcccaccgaatcgaacaaccagcgtgctctctcctccgaatccgccgtcgacgatgccatccgccgcggcgggcgacggcaagggtaagcggcggttagtggggatgccgccggcgagggcggcggcggcggacttcgcgatgggcggggcggcggcggtggtggcgaagacgggggcggcgccggtggagcgggtgaagctgctgctgcagaaccaggccgagatgctccgccgcgggagcctcacccgcccctacaggggcatcgccgacgccttcggccgcgtgctccgcgaggagggcgtcgcggcgctctggcgcggcaaccaggccaatgtcatccgatacttccccactcaggcttttaacttcgcattcaagggctacttcaagagcatctttggctacgacaaggagaaagacggaaaatggaaatggttagctggcaatgtagcatctggcagtgctgcaggggctacaacctcatccttgctatatcatctggattatgcacggacaaggctagctactgatgcaattgaatcacagggaagcaaacgtcagttcagtgggctgcttgatgtctacaaaaagacacttaaaactgatggtattcgtggattatatcgaggtttcagtgtgtccattgtgggtatcactctatatcgaggtctctattttggaatctatgataccatgaagcctcttattctagtgggaccactgcaggaaaatttcttcgccagttttgccttgggctgggcaataactacgttctctggagcctgcgcctatccatttgatacactccgtcgcagaatgatgttaacttctgggcagccattgaaatataagaacgccttccatgcagcaaaacagatagtttctactgaagggttcttcacactattcagaggggtcggcgcaaatattctctcaggaatggcaggagctggagttcttgctgggtatgaccagctccaccggtttgcaggtcaacatggttacaattttgagagcaagatgaaaggggcattgaaatgatgtgcaaatggggataaatagaggcatatccttggttgaagtttggattggccaaatgggatgtatgagcttggataatcaagcgggcgaaacagaactccagatactcctgcagttgataggattgacggcgaagagaacagcttttgcaggatgtatactttcaaggagcggagatgaagtcagaatcaaaagatagctcttgcggtagaaagaatgtcaataattctgaaacctgattcttgaagtgtgaatatcgatcgaaagttagatcgtactcgcgctaccaatgccttgatgtgaactgtaaatagaacttgtggaattgctccattgaataacctttctggtgtagtataccacatttgtactactgtatagccaaaaacaaattaataacaaacctctgggtgttccgaggattggagtcgggtcccaaagcgagaatcataccatcagaatctttcacaccatcctgtttataatggcccgcaggaaatcaagatagttgattcgacca

SEQ ID NO: 216 - DNA, 2183 bp, Zea mays
tgcaggatcggcaccgatgcgattcaaccgcggcctcgcatccggtgcggaggtctgcaattggggggaggctcctctccgccgttggaaccgctgcggcgtcgcagcctgtgcgactttcctgctggttcctcatccctcagggacagattttgcattctttggcattactgtttgatggcagacagtagtgctccttctctgtggaggcattggggcaaaaggcagttgaactgaacgggcacatcaatagtctctggcctccaagggaaattgggaaattcagattgaacgtggctgcatcatttttcctttcattggtcttttcagcaacagcgatccattctcgtaggggggagagagagagagagagagagggagagaaatcaaagaggagagtgatcatggagcatgtgatcggagggaagtataagcttgggaggaagattgggagcggatccttcggagagctatatctcggtgttaatatacagaatggagaggaagtgggaataaaattggagcctgtgaaaacaaaacatccacagctgcactatgaatctaaagtttatatgctgctgcagggtggaaacggtatcccacacctcaagtggtatggtgttgagggggagtacaatgttatggtgatcgatcttcttggcccaagcttggaagatttgtttaattcctgcaacaggaaattttctatgaaaacggtgcttatgcttgctgatcaactgataaaccgagtggaatacatgcattccaagggatttattcatcgtgacatcaagccagacaacttccttataggcttaggtcggaaagctaatcaggtctatatcattgattatgggcttgctaagaaatacaaggaccttcagactcataaacacatcccatacagggagaacaaaaatctgactggaacagcacgttatgctagtgtgaatactcatcttggaatagaacaaagcaggagagatgatctggagtctgttggctatcttctgctatattttttaagaggaagcctcccatggcagggccttaaagctggcactaagaaacaaaagtatgataaaattagtgaaaagaaaatgcttacctcggcagagattctgtgcaaatcttacccgccggagttcgtctcatatttccactattgtcgctccctgcgatttgaagacaggccagattactcttcaatgaagaagctctttcgtgatgtatttatacgggaaggataccaatttgattacgtatttgactggactgcactcaagtaccctcaaatgggctccaacaacaagcttgttcaacaaccaagtgcaagaatggctggagttggaccatcagttgagagaacagacaaagcttccatgggacaagagatccgggataggttcactggtgctgttgaggcattcgccagaagaaatccaggctctgggcgccctgcagatcattccagtcattccaggcacaaaagctttgcagattcctttggaacgtccaacgaagcagttgccgactcatcagagaaaacgcgcatcttgtcccggggagggagctcgtcgaaaatgcccgcagctccgtccacccggccgacctcttcgggggactgcagtgaccagaaccgccggtgggtctccggcagcagtggcggcagcgggcgcccgtcccccgcgcagaggctccaccactcgggaggcgccgagaacagcaggtcgtccccgcgctcccccgtggcccggaacgcggccgggaggggaggctccgcctcgcgggacaacacgacgttccgcagcctcgagcgcctcaccatcaccaccagcaggaggaagtgagctgccgaggaccacgccgacgaattctgagagtggaaggcggttactaggccgaggaacttttgcgggatccttgctctctgcagctaaagcaaatcggcaaatagatgatggatggatggttacaaggctgccatgaaaatgcaccctttccccaaaccccagcgtatagtataacgctctccccaaactccaagagggaagacaactccaaagtacaatgcaatcttgattctgtcgatctggcactagttttaaggtgttattgcagaatccctccatttgaccataaattttaaaaacgtatacaagaatctgagttaattttgttta

SEQ ID NO: 217 - DNA, 1887 bp, Sorghum bicolor
aataattcacacgacaacataaggacactcacaataaataataaaaatcagttcaagccgatttcgtcagcggaagtgagaaccgagtggcgactggcgagagcgacacgaaaacgacgggtgacggctggagcctggagctccggtgcccccgcacccgtagcttctttaaccggtgaccgtcagacagcacacggaaacaggcgggcgacgcacgccagtgttgccaatggactcgcgctgcccccacctactcctgctcctcctggcggcgctcctccccccgccgtcgtcgggggcggcggcggcggcggcgggggtcatccggctgccgacgggagggagagcgggggccgtggcctgcgcgccgccggaccccgccctgtacgaccgtcccgtcatcggcatcgtctcgcacccgggggacggcgcgggcggcaggatcagcaacaccaccgcgacctcctacatcggcgcctcctacgtcaagttcgtcgaggccgccggcgcgcgcgtcatcccgctcgtctacaacgagcccgaggagcgcctcctcgagaaactgagtttgttgaatggagtgctgttcactggtggatcagagaagcaaggtgtatattttgagacgataaaaaaagtgtttcagtatgttttggacaagaatgacgcaggtgaaccatttcctttgtttgcccaatgtcttggctttgagctaataagcatgattgtcagcaaggacaataatatcttggagacgtttgacgcccagaatcaagcatccactcttcagtttcccagctatgctttggagggctcagtgtttcaaaggtttgaccctgccctcataaaaaaagtcagcaccagctgtcttgtcatgcaaaatcatagatatggtatatcaccaaggcgatatcgagagaatgatgcactatcaagtttcttcaaaatcttgactacatcacctgatgaaaacggcaaggtctatgtctcaactgtacaagcctataattatccaatcacttccacgcaatggcatcctgagaaagccatttttgagtggaggaaaccaatgattccacacagcgaagatgcagtacaggttactcaacattttgccaatcattttatcagccaagcacgcaagtctccaaacaggcctcctgccgacaaagtgctggataacttaatttacaactacagcccgacatttagtggaaaaaaatcgaaatcatttgaggaggtctacatctttgcctgagactgaagtggacgtctgggtgtcttcaggaatcagcactgcattgctatttgtatcgaggtccattgtattgtgattgtgtattacgcgtggtacctggaagtgtacagatttcgttgactgcctgtattgcagtaacctttccgggtagctctgtaattaatatgtatgtatatataagcaggaataataatgtaatgaactgtaaaatacttgtatggagattttctgaatctaaaagtgtcttcgaatcaggtgaaggttgaatgttcttggatcagattcatgaaatccatcgaaactgagttgaatattagcagcagtagcggggcataggattggttcatgctcgcttgagcttatcatccgaatctgtcaatcattcagcagtgtttttctcttacaacaaatcagtgaacggtactttctgctatggcttatcagttaaacgaacaagatggcccctgtgttggatcgtacctattgatggtaatctgattgtttgcactacggcagcgttcactttacccgggtttgtatccaccacggtctggtcttaattctttaggaatcgcaccccattaccttgtatatctcaggatagttttagacgccaaccatatgtctcc

SEQ ID NO: 218 - DNA, 1244 bp, Sorghum bicolor
agaccaccgagccacgtctcgccgctactagaggcgagccacacgggtagagaaagaagctgggggtaattaggtgtctagctaataagtactccgtagctagctagtgttcttccacaaatggacgctcccgcggcggccgagggttccggcaacggcggcaagcacattgtgctggtccacggcgcgtgcctgggcggctggtcctggttcaaggtggccaccccgctgcgcgcggcggggtaccgcgtggacacgccggacctggcggcgtcgggcgtggacccgcggccgctgcgtgaggtgcccacgttccgggactacacccagccactgctggacctcctggcgtcgctgccggagggccaccgcgtggtgctcgtcggccacagcctcggcggcgtcaacgtggccctggccgccgagacgttcccggacaaggtcgccgccgtggtgttcctctgcgccttcatgcccgactgcacggcgcggccgtcgcacgtgatggaaaagttcgtggagggcaagtggctggactggatggacacggagatgaagccccaggacgccgagggcaagctccccatgtctatgatgttcggcccccggatcatccgagaaaagttctttcagctctgcgagcccgaggacatcacgctcgcggcatctctaatgagggtgagctcgatgtttgtggaggatcttgtcctccagcaaccctacaccaaggaaaggtacgggtcggtgcgcaaggtgtacatcgtgtgcagggaggaccacgccatcgtggaaaagttccagcgctggatggtggagaacaaccctgtggacgaggtgaaggagatcgtggcggaccacgtcgttatgctctccaggcccgacgagctggtgcgctgcctcaccgacatcgccaacaagtacgcttgacgacgctatcgatcatcagccgctgttcagcacatctacattgcttctcgatcggcagttatgcatgtcgtcgtgttttaattcatccccaaattctccactcgtgctgtgaaattgtgtacaacgctattgagtcttgttaataatctgtattcgccgacaaaaaatgtgtttactgaggctcctgttccggatatttgtaacaattagcagttttcgcttgtgattatctgccgatttatcagttaacaatatttttctttcacaataaatcagcaaacagtgaataatattttaaccatggctatcagtcaaac

SEQ ID NO: 219 - DNA, 4846 bp, Sorghum bicolor
gtacgttttatagcttctcccagtgcctgctacatctcctcatcagctggcttagcaaattaagctttgcttgcacttgcaccacctccttctcctcctcacgcactcctcttctttctctttctctttctctcttaataaaatctgacaacggcggcacatacgcagctacctcacgtttgctagctagtagctgcatttggtccatgccctaggcgcagctggtgctccatccatggcgacggcggcggcaccggtggcggcaacggtgaatgggatggccgttgatcgggtggtgttcgccctgaacgggcagcggtatgaagtggccggagtcgacccgtcgacgaggctgctggagttcatccgcacccagacgcccttcaggggccccaagctcggctgcggcgaaggcggttgtggggcttgtgttgtccttatagcaaagtataacccagagacagatgaagtgactgaatttactgcaagttcatgcctgacacttctctacaatatcaatttctgttcaattatcactactgagggtctagggaattcccgagatggctttcattctgttcaggaaaggatgtctgggtttcatgcctctcagtgtggcttctgcactcctggaatgtgcatgtctattttcacttcccttatcaatgctgataaatccaagaggcctgaaccaccaaatgggttctcaaaactaaaagtatcagaagcagaaaaggctttctctggcaacttgtgcagatgcactggttaccgtccaattattgatgcttgcaaaagttttgcatcagatgttgacttggaggatttgggacttaatatattctggaagaaaggtgataggaaaccagatgttagtgacttgccacattacactcttggtggcggagtctgcaccttcccagactttctaaaagctgagctaaaatcatcgcttgatcacctgaataatccttgtattgcagactccagggagggttggtatcatccaaggagtatcaaagagtattatgagttaataaattcttgtttttttagtgactcagtcaaagtggttgttgggaatactagtagtggtgtaccaggatacaaggatcaagacctctataataagtatattgacataggagggattccagaactatcaaatattgtaaggagggagtctggctttgaaattggagcagctacaccaatcgctaggaccattgagatacttgaggaagaatgtgaatctatatcctctccaaacggaagtgtggttttcagaaaacttgcgaaccacatgagcaaagttgctacaccttttgttcgtaacacagctagtattggaggaaacatagttttggcacaaaaatacccatttccatcagatattgcaaccatactccttggtgctggtgcaactgtttgtcttcaggtagttgcagaacggagacaaattactttggaagagttcctagagcagcctcctatagaggcgactactttactcctgagcatatttattccacattggattccagattctgggacaaaaacaagtttgttatttgaaacttacagagcagcgcctcgtcctcttggcaatgctgtttcatatgtaaattgtgctttcttggggcatgcttctgtggatgaacaatcagatactcttgtattgagtaatctgcgcttggcttttggtgcatatggaacagaacatgctattagagcaaagaaggtggaggacttccttactggcaaatcactcactgcatcggttgtacttggtgcaattcaattacttagagaaaccgttgtaccaatggagggaacatcacatcctgaatatagagtcagtgcagctattggatttctcttcagttttctatctccgctttctaaaggcatcccagagcctggaaagtctctgaccagtagttctgctgattcagcagttacagatgatgtctgtaacatgccattatcaacacgtcgagaaacagttttcagtgatgaatataaaccagtcggcgagccgattaagaaatatggtgttgaacttcaagcttcaggggaggcagtatatgtggatgatattcctgctcctaagaattgcctctatggagaatttatttacagcacacaaccccttgcttatgtcaaaagtataaaattcaaatcttctttagcatcagagaagatcgtctcttttgtttctgcaaaggatattccaagtggaggacaaaatattggatcatccttctcgtatggtgacgaaccactatttggtgatccagttgctgagtatgctggtcaagcacttggcattgtgattgcagaaacacagaggtatgctgacatggcagccaagcaggttattattgaatatgacacaaaggatttgggcccaccgatcataactgtggaacaagcagtggaaaacagtagctattttgaaattccaccagaaatgtatcctaaagaagttggtgatgtttccaagggcatggcagaagctgatcacaggattccctcaactgaagtaaagcttgcctctgagtactacttctacatggaaacacagacagcactagcagttccagatgaggataacactttggtagtttacagttcgtcgcaataccctgaacttgcacaaagtgtgatagcaaggtgcctaggcattccattcagcagtgtgcgtgtcattacaaggagggttggaggtggcttcggtggaaaggcatatagatcattccaagttgcaactgcagctgcgctttgtgcatacaagttacgacgtcctgtacgaatgtaccttaatcgcaacactgatatggttatggttggtggtagacacccagtgaaagctcattattccgttggattcaagtctgatgggaaaattacagccttgcatctagatttattaattaatgctgggatatctccagatgcaagccccattataccagatgctattatatctagtgtcaaaaagtacaactggggtgctctgtcatttgatatcaagctctgcaaaacaaatatttcatctaaatctgtaatgcgtgctcctggagatacacaaggctctctaattgcagatgctgtaattgagcatgtcgcgtctgccctttcactggatgctaacagtgtgagggaaaagaattttcacacttatggtactcttcagttgttttacccagatagtgcaggcgaagcttctacgtacacattgcattctatttttgataggttgatctcaacttcaagctacctggatcgagctgagtccataaaggaatttaacagtaacaacaagtggcggaaacggggcatctcttgtgtgccactcattttcaaagttgatccgagggcagcccctggaagagtttccgtgctcaatgatggctccatagtggtggaggttggaggaattgaaatcgggcaaggactgtggactaaagtacagcagatgactgcctttgctctgggaaaattgtggcctgatgggggtgaaagtcttcttgagagagtgcgtgttctacaagctgacaccttgaacttaatacaaggcggacttactgctggcagcactagttctgaatctagttgtgcagcaactcttcaggcatgtaatatgctgattggcagattgaaaccagtcttcgataggctgcagcagcaatcagaaaatgtctcgtgggatacattgatttctcaggcttctaaagacaatgttaatttatctgcgagcacgtactgggtacctggtaaagtttctaataagtacctgaactatggagctggtataagtgaggtggagattgatcttcttacaggagcaattactttactaaggggtgatcttgtgtacgactgtgggaagagcatgaaccctgctgtggacttaggacagattgaaggttcctttataaagggaattgggtttttcgtatatgaagagtatcttacaaacagtgatggcctcatgattagcaacagcacatgggactacaagatcccaactgtcgacataatcccaaaacagttcaatgctgaggtgctgaacactggatacaataagaaccgtgtgctttcttccaaagctgctggtgaacctgccttggttcttgcctcatccgttcattgtgcactgagagaagctatccgagcagcgagaatggagtttgcaaacagcactgtatctggacgctcaccgctggaattcaagatggatgtccctgcaccaatgacgctggtgaaacaactatgtggtttagatattgtggagaagtacctagaaagtctatctacctagaaaggagtggtatcatctttgttgttgtagtttgcaataaaacagaaaggaggaaggaggatttccatttccctcaatggaaatagggtttcctcgtgtggaaaggaaggagggaggtgttaaattagcacaatatttgaataatgctttcaaccatctgtattcatatgactcttaagaccaaccacctttctctcattgacatgaacattgggttgtatatcagatgcataaccagcaggaaactttaccacttttagcacttgacaaaataactttttctcatcaggacacactgaatatggtgcaggtggtaaatacaattggtcttcaagttcaacagggtggagatcatttctaatacctagagtttgaaggtctaagcgagaattcagattatccttagatttcccatcagtacccaagaatgtattgacaaatttctcatacacattcttccctatatgcatgacatcaaaattatcccgcaggcaacatcaaatctttccaatatgtttg

SEQ ID NO: 220 - DNA, 934 bp, Sorghum bicolor
ccactgttttccccttctttcgtgttcgtgtactacttcgtgatattggtggttgattccgtgatgagaaatccaacgagactcgagcccctcgatgagtcgatccctcagatttctctccggggctcgaattttccactggggcgagatttccggagatcttgagtcgcttcgcctactgcccaccgtgaggcgcagcgaataacattctccaagatttgcccgcaaaaaagttcttccagatttctgtccgtatatttttgtttattgtgcgttttccggttgttctgtgagccccgtgatggcacaatctttgagacctgagattttcttccttgatgaatttcaaaagcatgattactgagggccacagattcgatcaccttttcttactccttttcgtcagagcctagttgttttacttgatcgtgttgtggatgatgaaatgcactgggctccgagcagtgaaatttgctgtgttttgacggagatgcacttgcctagaaagcattgtctgacatgcacagtatagtcttatagtctagtaacatatcattgccctgatgagtcattgaagaaggctgcattgtaccaagattggggctcagtttctttaccctcgtcttgaatttgccgattcggctgtagccaaattaacgaggaagaaaaactggtcggcttgcccttattcagtgggttatccgcttaccgatcttcccatatgccatcaaatcaagctttttcttcactttgctattaaaacgaggtgatagtggaggggcatggcgtatgctgtagccattcttgtagaacacctcgaacagcaagttcctgccgctgtctttctcatacttttgatttctagtgatccttctccacgggcgttttaaatcactggaggaagacgtggccggtggttcatcatccgggcagc

SEQ ID NO: 221 - DNA, 1180 bp, Hordeum vulgare
ctcgactccaccaaccaaccaaccagccaagcaacgaagccagattagaatagcggcgccgatgggctggactagttggcgccatccgcgtgcgccaccaccaaccgccccctgccaccacgccgcgccatgctctccctcgcccgccgcccgctctccgccgccgtccccgccggcaacctcctcggcatccacctcttccagtgccccgacgcggtgggcatcgtggccaagctgtccgagtgcatcgcctcccgcggcggcaacatccacagcgtcgacgtcttcgtccccgacgacgcccccgtcttctacgcccgcagtgagttcacctacaacccaaggctatggccacgcgacgtgcttcgcaccgacttcctccatctctcggactgcttcaatgcgcagaaatccaccgtgcgtgtacctgacattgaccccaagtacaagattgcagtcctcgcttcgaagcaggaccattgtttgtttgacttgctgcatagatggcaagaaggcaggcttccagttgacattcattgtgtgataagcaaccatgatcggcctgtagataatcatgtaatgcgtttcctccagaggcacgaaatcccctatcattacttaccaacgacttctgggaataaaagagaacaagagatattggaattgattgaaggtacagattttgtcgtgctggcaagatatatgcaggtaatgtctgaaagctttcttaaagcatatggaaaagatattatcaatattcaccatggccttcttccctcgttcaaaggaggaagtccttctagacaggccttcaatgctggggtgaagttgattggtgcaactagccattttgttactccggaacttgatgctgggccaatcattgagcagatggttgagcgagtttctcacagagacacgttacatagctttgttgtgaagtccgagaaccttgagaagcagtgcctagcagaagctatcaagtcatactgcgagctccgtgtgctaccatatgaagtgatgaagactgttgtgttttgaatttcttttaatggttattatgatgtgtattcttttccaaaattagcagtacattattcttttattaatatattcacgttgagccattaggtgtatcttaacctgggttgaggttacgagaataatcaagcaatattac

SEQ ID NO: 222 - DNA, 1086 bp, Hordeum vulgare
cgaggccggcgatgtcccactcctccgccttcctcctcccctcctccgcaacccccgccggctccggggacgcgtacgcggtcgtcgtcctcaaccagcgcctgccccgcttcgcccctctcctctgggaccgcgcgcaggtgcgggtgtgcgccgacgggggcgctaatcgcgtgttcgacggcatgccggagctgctccccggccacgcccccgacgatgtacgctccagatacaaaccagatgtgatcaaaggggatatggattcagtgcgaccagaagtgaaggaatattattccaatttgggcaccaaaatagttgatcaatcacacgatcaggacaccaccgacttgcacaaatgtgtagcatttatcactgacaagtctcctggcccagacaaatcgaatctatgcatccttgtcctcggagcactgggaggtaggtttgatcacgagatgggaaacatcaatgtactccatctcttcccaaacattaagatcgtcctcctatcagatgattgcctgatctttctgctcccaagaacgcacagtcacaacatccacattgaacggtcagttgagggcccccactgtggattgattcccattggcacgccttcgaccagcaccactaccaccgggctccgatggaatttagataatgctcatatgagctttggtgggttgattagcacatcgaacattgttgatgaggaccaggttatggtcacttcagattctgacctgatctggacaatatctctccgacactgagtttttggatgaattttctcgtcagacaatacttgtatgagctacggtggattgattagcccgtccaacatcgttgatgaggaccaggttatggtcactttagattctgacctgatttggacaatatctctctggcaccgagcttatgctatgcagaacgtttgagatatcgccaattttgtctcgtttaatttatgtctatgacaactacacccagcagtgatgtgataaattttggcgtgttagaatttcaagccttgtaaatttctaatttctaatttggtagctttggcaattaaatatagttgccccc

SEQ ID NO: 223 - DNA, 1430 bp, Hordeum vulgare
ggaaggaaagcagcagcagaagtcgacgcctgcgttgggtgccgctgccactgtgctccagcattttttgttggttcttggtcttggattcttccgtctgcgataggaggttgctggttagtcgttcgtttgcttgttgggtgggtggctgatccgggatggaccgcctgctgctgccggtgagggtgaaggaggagtggccgccgccgccgcctccggaggaggaggaggaggagttggaggagcaccggggcctggcgccgcggccgatggtggggctgcacgagacggggccgccgccgttcctgaccaagacgttcgacctggtggccgacccggccaccgacggcgtcgtctcctggggccgcggcgggaacagcttcgtcgtctgggacccgcacctcttcgccgccgtgctgctcccgcgcttcttcaagcacagcaacttctccagcttcgtccgccagctcaacacctacggttttagaaagatcgatccagacagatgggagtttgcgaatgagggtttcattaggggccagagacagctcctaaagatgataaagagaaggagaccattgtcttatctcccttcatcacagcagcaggcccttggctcctgcctcgaggtcggccagttcggattcgacgatgaaatcgaagtgctaaagcgcgacaagaacgccttactctcagaggtggtgaaactgaggcaggagcagcagagcacgagagctgacatgcgagccatggaggagaggctacaccgggcggagcagaagcagctccagatgatgggtttcctggcaagagcaatacagaaccctgacttctttctccagcttgtccagcaacaagataaactgaaggacctcgaggacccttacccaacgaagaggaggaggtccatcaacgtaatgccgttccttggccctgaggggacgagtcagagtgagcaactcgagtccacattcatttttgaggacagggaattttcagagctggagaatttagcaatgaacattcaagggatcaggaagggcatggaggatgacaaaggtggtcggagtcagggctgcggtgaggccgagctgactgatgacttctgggaggagctgctgagtgaaggaatgagggatgaggctgagatgctagagctggaaaggaggagatctagatatgtcgacgcgtagcgcgaaagctgggtcgtctaagtaacaacgatccaaactctaccagaattcataaccatttaatctgtataccattgtattgatagctgtattgtatattgtagtgctaatttatagtcatagtctcatagactgattgtattgcggttccacaccgattatgtggtatatatctagtggtataaaaactgtccctggattcacgtcgacagttttttactctgatgatcttagttc

SEQ ID NO: 224 - DNA, 737 bp, Hordeum vulgare
cctgatatcagaggattcattcgtggtatttatgaaatcgaagagcggaaagaaagcgcgcacttcatagaaaaaatccgtctcgagtttcctaaggtgccacaacaaaatggggaggaatgtggtatatatgttctttactttatcaactgttttcttcaaaacggaaaattggcagaagttcttcagaataaaacactggaagaagatttcaaacagctgtttgatgatggcacgtttgatccagaggaactagagaacttccgcaaggatgttcatgcattccaagtagaaaggagtaccgaaaccggacagtaggtggactgtagcattgtgctgcatatatgtagttagttcttacaaggcagtggaaaatttcatcttcgctggtggtgaattctgaggaagcttgaaggtcgtggagaagctggtggtaatatacagcttatgcagccgagagaaagccgacaccatggagctttgtgacagttagcaggtgttgtatgatctgtatcgacattctagaactgttgtgtgtccatcttttgtatgacaccatgagagttatctactttatggactggaatgatctcaatagtctcaacttgttttccctgagtcttaagatagcagcatcacgtacaatgcttgctaggggtgaaaaaacacactcagtttcatattagctgttgctgatttagtaaactttgtactactccctccgttcctaaatataa

SEQ ID NO: 225 - DNA, 2103 bp, Hordeum vulgare
ggagttggggaggaagcaaagcccaaccaatggcggcgaatcggcatccgagccgctcggaaccctagcctagcctaccctcgcccgccccgccatggcaagtcctccttgcccgccgtcgccgctcgccagggtgcggctcgacgacgtggcgccccacgacggcgcggccgccccgggctacgcgcgcgccgtcgccgccctcgccgcctcgctcgcccgccgcggcgccgccgtgctcgagctccccgcggcggacgcggccgtcgtccgctgcgccctcgagtccgcccgcgccttcttccgcggccgccacgccgcctacctctaccgcgccgggaggactttggaagatggagagttgtcccctgcttgcatggctgatgctttcagatgtttgggcaaagcagcccgggccgccctctgtgcaatagcacggcacctgcgcctgcgtaccgatgtattcaaccaattacttgatgatactccactgccggttaacgagatctcctcatctgagttgctggtgtcatattctcacgaacagctccaaagtggtcaggcactcatgggatgtcccagcaggtcctcaatgcctcaagttgataggggatttgtaatgctagttgcttccgattgtccaggaattgaggtttgtgacccaaatggccattggtacatagctgatggggtttcaggcccaaataatctattgcttctgactggaagggccctaaatcatgttactgctggtctctgcccaatttcccactacagggtcaccaatgagaatagggcatcactcacctttaggttggtgcctcatgccaacgccatattggattgctctccaattttagctgctgggcattgcatacgacaggtgtaccaacccatacctgcaagccaatttatggatgattcctgtgccgaagaacatgctgtttccagtcacttggatgaaccttctgaatctcagggcaactttgttagtgacccatcactgagaagtgtcctgtcagaccctctgtctgggtcatttcttgaagatgccatggttctccaatgtgggcactcatttggtggcctcatgctgaagaaagtcattgaaatggctaggtgcaccatttgcaatggagaagttgacccatcctctttgttccctaatctcgctttgagagcagtagccacggtggtgaagatggaggatgataggagactgtttcataacgctgctcttcggaagcgcaggaaagatgtgaccgagcatacagatgtgccaaagcggactgggagtagcaaagacaacaatgagcttgctctggatgctggaagcccggtggcattcaagggagtgcagtacccttttgtagtgggcgagagggtcctgatcatggggaacaaaaggacgcccgataaattcgtcgggaaggaggcagtcatcacttcgcagtgtctgaatggctggtatcttgtgaaggcgctcgacagcggagagagtacgcggctgcagtaccggtcactgaagaaagtgtcggagctgcaactacagacgcaagcgaggctgcagcccctggcatttctcggaggcagatgataagagatggtgatgaaggatcatgtgtgaaccataagtccataaccactacccaaggtgtcggtcaggtagtaagaggaagatatggtggtagtgctgctgtgtgcaagttgtgaatcaatgtatcttgatttcttttctttgtttgtataggtagggcgctcccatgctcccttgttcgaaggcaagatcaatgtaaaagtcgagagtaggaaatgcagtcccgtgcctgcctcagggtatccgacggctggaatagtaagcgacacatgtttgtgcgtccaatctgggtttgtagaagaggaagaatgtgtttgtgtgtgttcttcaaggctgtctccagattgtacaagacctttctgtgaccggacctgtcatgtccacagtgccatggctggctcatttgctagtaggagtattcactaactatgtttgggcaattatatttcggtatgatgacccatcaatgtttttgtttgtttgaatccatgtgaaacatcttaggc

SEQ ID NO: 226 - DNA, 952 bp, Hordeum vulgare
gaaaagaagaaaaatctaaagcgagcagctggctggaggctggtccatcgagcggccgggactgacatgaggccgccgtcttcttcttcttccatcgttgccgccgctgcaacagctccctcctcctccactgctccccctgttgcagtcacaaccaggagagcacttctcttctccacctcgttcatcgcgctcgcacctgctgcagcagctcaggccgccaacccctcctccacgccctactcccagtccaggaccctgcagatcggcctcgacaccaacgggaagattcggacatgcccctccaccaatcccgggtgcgtgtgcaccaaccccaccgtcggcgcctcctcctccgtcgcctccccgctcatcatcccggagtccacctccgccgacgctgccgcccagttgttgcggcaagccatcctcaagacgcagaagaatgtcagcttcaacgttgatcagcaaactcccaatggccagtacatccaggcggaggtggacggtggtttcggccgggacgtgatggagttccttgtgaagaaagacgccggcgtggtggcctaccgctgcgtggccaccaaggtcacctttgtctaccccttcaccaccgccgtcggcgactcgcggggacaggagcagagggtcgccgccgtcgcgcaggagctcgggtggtacgcgcccgacataagatcctccgtcgacgacgttgctacgtaatcaagctacgtaacgcgccgactgtgagatgcgtttcaagatcaaacgacatgcgtgcaagagattggtatgtatgcagattgattgatcatggtcatggaccagataatttgacttttaattttttagttgggactcataatttgtcgtccaaccaccgatgtactatggacaatagttgctgggcccatctcccctagtaaaacagtttaatatttgtttgggacaa

SEQ ID NO: 227 - DNA, 1088 bp, Hordeum vulgare
cacacggccacaacccgactcaccaccgcgcctcttcctcctccctctcacccacccatggcgacggctatgatggctgcagccaccacctcctgctccccgcgccgagcgctcctcaagccagtggcctcctccagctccgcgccgccgcccaggccgcagccacggtccttcctcaagcagctcccggggctggctgcgacggcggcggcggcagccgtcgcctccgtgcccctcccggcgctggccgtggagatggagaaggcggcgctgttcgacttcaacctgacgctcccggcgatcacgatcgagttcctgctgctgatggtggcgctggacaagctctacttctcgccgctgggcaagttcatggacgagcgggacgccaagatccgcgcggagctcggcggcgtcaaggacgcgtccgaggaggtgcggcagctggaggagcaggcccaggccattctcaaggcggcgcgcgcggagatcgcggcggcgctcaacaagatgaagaaggagacgaccaaggagctggaggcgaagctcgacgagggccgccgccgcgtggaggccgagctcgtcgaggcgctcgcgagcctcgaggggcagaaggaggaggccatcaaggcgctggacgcgcagatcgtgtcactcagcgacgagatcgtcaagaaggtgctcccatccgcgtgaaaacactagtagatcacgcagcgcgcagcagccggcgcaatccccgtttcatagtaaagatttctagttcttgatgtgtaatgtatacgcccactgggctgcctcccctaagaatgtaatcgaatcaacatttctgtgatcacgtataaatgaatgacccttttgtacactactctgtcctgaatctcagtggtgcttcgatcctcaattcatttccgggagaacccaaaaggcagaattgtactgtaatggaatgtcccttgtttctgacatgttgttagacattattctttagcattatcgtaataggatcattagcctagcataagaccacctaggacatgattaacagagtgggttcttcccaaaataacaaaataacactggctgatccg

SEQ ID NO: 228 - DNA, 1283 bp, Hordeum vulgare
ggtcacaacaccaaggcccaagccaaacaccatctccactctccacagccatggacgccgacgccgacacggtggtgttcgaggcaccggcgcacttccgcttctacaagagcggcaagatagagcgccttcaccggcctcccatcctcccagccggagtcgacgaggccaccggcgtcacgtccaaggacgtcgtcctcgacgcggacaccggcctctccgtgcgcctctaccttcccaagctccaggacccttccgcgaagctcccggtcctcgtctacttccacggcggctccttcctcatcgagtcggccgactcctccacgtaccacaactacgtcaacgccctcgccgcggcggccggcgtcctcgccgtgtccgtcgactaccgcctggccccggagcacccgctccccgctgcctacgacgactcctgggccgcgctccagtgggcggcgtcggcgcaggacgactggatccgcgagcacggcgacacggcccgcctgttcctcgccggcgacagcgcgggggccaacatcgtccacgacatgctcatgagggcggcttccaaccacagcagcccgagggtggagggcgcgatactgctgcacccgtggttcggcgggaccaagccggtcgagggggagcacccggccgcgtgcatggtcaccgggatgctctggtcctacgcgtgcccgggcgcggtgggcggcgccgacgacccgaggatcaacccgctggcgccgggcgcgccggcgctggagaggctcggctgcgtgaggatgctcgtgaccgccgggctggcggacgggctcgccgcgcggaaccgcgcgtaccacgacgccgtggccggcagcgcgtggggcggcaccgcggcgtggcacgggtccgatggggagggtcacgtgttcttcctcgagaagcccgggtgcgacaacgccaagcagctcatggaccgcgtcgtcgccttcatagccggtgcctgatagagagttggtctgcagatcatctccattgtcttcgagaggaacctgctctgcatcactgcttgttcgcttactgggtgaataaggtgcagtagtattatttgtgaataaataggtgatgtcgcctagatggaattcaagttttcttggagtatcaattttcagcgtctcaaaatttgcactccgggattacaagcatttttttagaatgattatcaccattttctgtcacgtactaagttgcatcgcagcgcgccacagccatgacggctgttgcgacccacacggtgatagttg

SEQ ID NO: 229 - DNA, 831 bp, Hordeum vulgare
ggcatctggtgatcttctttggtcatatgacgccggcgacccaattactgcatctgcttttgtggatgaagtgttagcatcaacgccatctggatcatcagagagatttatttgtatctgcacaagctctgggaagatccgtgtccttgggattagaactgacgctgagcaggagaaagatggttactctgtgcaagagtttacagccatggatcttcctggagacatcttctcgtcgccattgatggtgggtgggcgcatctttgttggctgcagagatgatcggctacattgtctctcgatcgcctcacatccataatctatttcagacatatccaggcaaactgttttgcttagtggccaatagaagaactagtggtgatgatggcccgagcagtttgatgttttgaacaaaatcaacaaagaagaaatgcagaagaaactgttttgcttgggttccgaaggttggatttccatgccgtaaatagaacttgaagttctttggttaagtgcttgatattcagtatcacaatcacattacaaccttaattagtgctgtgctcagtgagtgtaatgggttctaaagcggaagcagagctataaccggcccttgctcctttgctgcggaaaatacaccttcaagcttggtccgtctctttttatgcatcagaattattggttttttgttagaagaaagatcaaaattgttggtcgagagcaacatgctggatgtgtacataagctgatgtatcgaagcagtgtagctgggtggcatgaaagatacaaaatgaatgcaggtaatcgatttgcgaactcaatggagatacacag

SEQ ID NO: 230 - DNA, 1380 bp, Hordeum vulgare
aagcggtgggcgcgcgacggcggcggcggttggccctctcgagtcatggtgctactcgccaccctctcgcgcgatgccggagctcacccgtgccctgcgcaggaattccagggggaagcagggccgccgcgcccgcgcaggccgtccgcgttctacagctctgtgttcgcgcagatcgaagaggtcgggtgggggcagctggtgagcgccgcaggcgatgatggcgtgtcgtgcctcaccttccgcgtcatggatgagcagcgacggcaccatttactggagatcacactgcccatgaactacccgacatgccctccttcaattgccgcggatgttccttatctccccaaattacagtggtcaaaaagctcaagactgaaggatgttctctgccagttccaagagcacctgaaggtattgcaagattactggtctacaatggatggcattgacaaggccctttgggttgtcgatcctacaaagccgacatatgctatgtctcatcgtcgcatagctttgggtgatgattgctatattttactacacgttgatgcacagaagcccaactctttaccagagtgccgcttcctaggcacagatgggaaactggaaaggctgataaagaattggagaaaaaatcgtaaaagatggagtgctgacaaaaagttccatgaaaacctgtcaaccgtcctagattttgcactgccgcaacccccttctatgtgcatcaaagatgaccagcaagctgattgtgggatatgttacgccacgcatctgccagtcgacgacgaactcgggactcagagcgggtgcgcggcggactacaagtgcgaaaaccctagctgcagcagagccttccactcggtgtgcctgagagactggctgcgcaccattaccacaacaaggcagtcgtttgatgttctgttcgggaactgcccttattgcagcgagcctgttgctgtgaagagcaccgacagctgaacttgggtttggcattcacaaattgaggcgctgagatcagatcatatgtttttagacaatgaccttcaagcagaagcaggtaagattccaggtttcagacgggccaataaaaaggaaggggggagaaatcagagacatctaggttgatgcgtccgtcaggtttgtgctaaaggcaggtcgtcatgacctataccgtcatcaatggagctgcaagaggtcgaaattgctgttggtttctacgaaattggcgtccacttgttctagaggtgaaagaagtcaattgctgagcttctagagttgcaaattggtgtgtgttacatagaagtcaattgctgagcttctagagttgcaaattggtgtgtgctacatagatttggaacggtgaatgcgcaattgctg

SEQ ID NO: 231 - DNA, 2080 bp, Hordeum vulgare
ccagatcttcctctactgctgctacctcgtttctcccccctctcccacacggcagcatcgtttacccaccaaactcctcacttcatccgtggaatctcgcccactttcccggctcagatccgagctcgtacgcgaaatggtgatcctttgtgctggccaccctgctccttcggttcattctgaatttctatctggatggctatcactcaacagctccagaaggccttaccgtttgagctcaaccggaaggaacatcagaaagcaaaacagacatcagcgggcgattaccttcgcaaaaagctcttcattacaagattcagtggcctctgtaaaaccatctcgtcttctgcccacagtagaaccaaaaacatttcccaatagtgtccctgatgagatgctatcaaaactcagattggaagaatctgatgcattttacatactagagctgtgcacaagtagagaacttagttcctctttgctagataagaactccgcgatcttagtctgcttaattgatgttgacggtgactccttgttacaaagagtaccagcaatctatggggaccaaccttcacatggcaccaaggcatcacaattcctcccctttcaaagtggttcagttgatatcattacctttaaaggtcccaaattgcagacaatcaaagaaatctggattggccttgaatcaggttcatggagattagatggtttaagtttgaaagtgatccatggagcacgggatacacctgaagatcttaagggaacacttgagctcaagttcagcggtttgcagtacacgttcgacaagctgagtgcgctgcttggtgaggagggagcttcagtagtggaagcaaggcctattgctgtcactgacctgtcaggaattagcatttctgaccttcaagagggacagctatcctcagcaaggacagcctcaagcattaaggaattgaaggaggatggactgagggagtacgctgatctcaaacaatccttgctgctttacgacatatctattgttataacaggtttctctgccttcactctggcttcgaatgatggggccgcctactcgttcctcgtcggcgggattggagggttcctgtatctattgctactccaaagatctgtggatgggttgccggcaattagttctacttcagaagtgagcagttcagagccctctgtgaatttcagtggcgtaagaaggccatggttgatattgtcgattgtaatggttgctggggctgttgcactgaagtacggtgctagtggtgacagctttgagctgactccaactgagctcttcgttggcgccgcagggttcctggcgaacaaggttgctgttcttctggcagcattcaaacccttgcaaagtaatttggagagtgacgatggatccgtggactgatcttcctgacaatattgctctgaatatactaccatgctttttagaagggtgtaaaatgtaacaagaagtagcgtttcatagtagctcgacagcattcaagatctgaagctcggtatcgaaagtgcaggggacaagctcaggggtagaatggaaaggtgtatgcttgtcacttgagcctcttggtaacttcattccatcagcatgcccaaccacagaagttcatctcgtagcatccgtttgagagtcaatcaagaacaaaaggtatggttaataaaatcataaaatacatttctggctatagtaatgctactcaaactcgaattgttcagcttagcctatgcaaactcgagtacttggctgcgctcaaaggcatgtagaccgtgacacctggagatgccagatacctcaaatggttcaaatattcattcaaatgagatggtttggttactaactccaaacttatgatagttttagcattaccatatgttatatcgctgtaaataaattaatcgactgtcccaggcagttgggctgctagatattacaatacaaatgtctgtatataaagtggagttatagtttgtctgctgaatgttcttatgattggaaatatagatgtattttcagtgtataaaactaatattttgaattatacttgatattaaaata

SEQ ID NO: 232 - DNA, 696 bp, Hordeum vulgare
gggacctcgtccttcctgccgaaatgctggccgccaccgccgcctgccgcgcgccggcgcggccgctccccgccgcgcgacccggaagcagctacctcctcggtcgcgtccttctccccaagcggagagcgccggcggtgaggaggaggggacggagcgcggcggtgcggtgcgggctgctccccgtggacccgtgggctcccggcgtggactcccagagcatcgcgtcgcagctcttcgccgtgtcgctgttcccctacctggggttcctctacttcatgacccggtccaagacggcgcccgggctcacgctcttcggcttctacttcctcctcgccttcgtcggcgccaccatacctgctgggatatatgccaaagttcattacgggacctcgctgtcaaatgtggacctgctgcacgggacggcggaatccctcctcacactcaccaatctgttcatcgtgcttgggctgaggggagccctgaggaacttggataaagcagaggagagcagccctgaagctcctcgggacagcaaggagaagagttcagtataggtgcttgtaaattgttggaaaacctctgttttttagtgtgtgtagtgatgctgatgacattgtactgtagtgagtgtacatttcttctgctcaactagttgctgctgtaataagctgcacatgttggctttgtgcattt

SEQ ID NO: 233 - DNA, 3655 bp, Hordeum vulgare
ggcagcgtgctgtatggagagacgcagccgctggacgaggacgacgaggagaccgaggcggttgatgaatttgagggggaggggaggagaggatgtctgatgacacacaggtggtggaggactcagaggatgatgccggtggcttcgctgggcagacacaggcagtagaggaggaagaggaagatggtggcagcacggaggatgaagccggtgatggtgtggtggaggactcagaggatgatgccggtggtgtcgctgggcagacacaggtagtagaggaggtggaagaggaagatggtggcagcacggaggatgaagccagtgatggggataggacccagttggttgaagaatgcgaggttgaggatggtgggagtggcgagacgcagttggccgaggaatgccaggaagaggagagagaaaatgatagcagcgacgatgaggctgctgttcaacgggggacgacccagttggttgaagattcggataaagagatgggtggtgatggtgatgatgagttgagccagggcactcaagtgcaaagtgacgacgagggcctgccaaataatgagggagatgtgaaggattatgccgaggattcggttgattctgatgcttccacggaagaagagggtgccacagtcaaaagtttggaacaagggaaaaggcatgcttcgaccaatggaacatttctccggacggaaattgtagacaactctacctcatgtaatgcgtcctttggtgattgcccaggtcgtaggattgatgacgggtcttttgggtatgtacagagccatgaaaaagatgggagtaaaagcaaaggcaggtgctcaacagcaaagaagctttttgctgacacaacgaacgaacagaaggaaatcaagagcaggtgttttagtggactaagctatctcggatcacaggagcctggtgagctatctcaagcaaatgctttggacgttgtggaggggttgatctcaattcatggcggcatatcgtctcaagaaccatcaccaaaaaaattagaaaaagcaaagccacctgtttcagttaagatgggaactttactattggctgagaaggttgaccggcgtagaagttccagtggaaaagcagaagtctttgcatgggtggatagtcgcgaggatgatggcggaggtgattttttcaggaaaaacaaggatatcttgttgcaccaatcagctggcagagggaaatcaaaaattcccaggccaaagaaatgctccacaaaaattgcacctcctgacaagaaaataatagaggggcgcaaaaggagaacgaggtccaaactttgtgagaagactgaaactttaccttcatcggattcgagactactcaaaagtgaggtgaagagtaagagggcttctggaaaaaggactgagaaaaagcttttgaaagacttggatgatcatctatcgactgccaaacctattgaaagacagcaggaaaaggtcagtgtggatttgcatgatgttggtcaggatactcaaatggctgttgaagctatagaagcactggcacaaagttcccctgctgaaaacttgtcagccagagttgaacctccagtgaagagagatctgagagttggatctaaagtagaaaaaggtaacccaaagagtggccctcctagaaagagaaccagcagcgtccaggaaggtgtcacgacacgttctaaaagaataaaagtaactgagatgaaccacaagcctcagaaaggacagggaggaatagaaatgcgacataatttagaagattgtgcaacaaagacgaaacataagcaggcaaagccagtaccacagaagaataaagttgcaaacattgttgatggaaatagttatgacagtacacctgttgttcgtcgaacaaggcacactggtagaaataacctctatgagtctcccgagttatgttctaataagaacttgaagaaggccactgttgcagatgtaagaaataatcatagcgaacatggacttgagagaccggtgattagtgagagaaccgcagaatatggttcagattctatgttcaaagaaaacacagaaattgcatgtgcaaataatgctcagggtcttcagccaagtactgatgcaagcatacagcataccagtgcaaatgttgctcagaaccttgaaccattaagagatgaaccaacaactcatgtcttccgcagagagccctcatctcaccccaaacagagaagaacacctactgcagtggtacaggcaaaggctcctgcagttaccgaggctgctacaggtcatgatatgcaaccagaagtgacaaggccatccaagaaaagacggatttttattaggagttcagaactgctaacgtatgcaaggagggagcgctccgattgcagatcaaattgtttgctgtctagtattctcacacaatcatcagctgcttctcctgttcttgattcttcatctggagttaacagcaaaacttctggtgttagtagctctgatcagcgacaaaagaaaccatctggtgttaaggatgcaggaaactcaccaaaatgtaactctccggtcccgtgtagtggcctgaaaacaccttctaaagtggtaagcaaattgtcacctactttcagtcctctaaatccatcaaaagcttcaagtaggagcctgttgaaaccctctattgccagagagctgctggagttagatcctgaaaatgctctaccaagtcgataccgaaaggattctagaagaaaagatatgaccagttgcagtattatttttagccatcatttggatgaggatgtgatcaagcgtcagaagaagatcttggcacgcttaggagcccatgaagcatattccgttgcagatgcaacacattttgtggcggatggtttttaccgcacaaagaatatgctagaggcagttacacgtggcaaactggtagtgacatcaatgtggcttgaaagttgtggagcagcaggctgttttgtaaacgataagaagtatattctgagggatgccaaaaaggaaaaggagatgggtttcagcatgcctatatcactggcctcagcttgcaagagtcctctgctgttggggaaaagagtgtttgtgacacaaaatgtgaagccaagtcgagaggtggtgactagcttggtttccgcatcttctgggcagccattggagaggatgggtaggtccataaggaaggaaaaggaagcagcagatgacctacttgtcatctcatgtgaagaggactatcaaacatgcgctcccctcgttgagaaaggcattgatgttttcgatgtggagcttctgctgaacggtatagtcacccagaagctcgattacgagaggcaccgccttttcttggaccgtgtgaagcagacccgctcgacgaggtggctgaaagacggcgcccacgggcagtttgtgcccgtatcaaagagttgataccataccagtgtaaatgtatggtgtgctgtggccgatgcctgttttatgcccatcctcaagttctagctctgtcgtgtgattaaaatctgtaatttgtagggtgtttatatgtgtctctgttgctttaaacctctgtttgcatgcatcttggtcacgcttgcagctgatcatgagttatgatggccagtttctaatggctgctttgatcctcc

SEQ ID NO: 234 - DNA, 921 bp, Hordeum vulgare
gccgcaaaaatcaggttattgccttaccatgttgttgctgactacgaggctgaagaagatgacaggatccttgacagcgatgcaactggccagattccctctcgtcttcagcaatgggatcataacattctggtaaaaattgctgagttcacaacaacttttgagaagcaagtgttggcatacaacataatgaccaagaaaagggccatcggtgagtttcggtcggaggagcgactcatgctagagcaggctttgttacaggaggagaagcaggcttcgatggaactaagagcagagatagaatctagggagaaagcaggccgtgaagctgctgaagctaagatgcgtatggcgatggttgagcatgctcgagtggaagcccaaccacaccctgaggtgattggtcatggccctttgagggccaattctgctgcttcccaaggcgatgatggtcctagtcatgacatggcacaagaacatgttgaagatggatgggaaaacactcaaagggatgatgatgatccatccgaggatttcctcaatgatgagaatgagccagataatgggaactctgatatgcaagaggagtggcggcgatcgggggaatttgatctaaactcgaggtaagacagcgagaggaatggtgttgatggtgacaatctgattgaactctaggtaagacaggtgtactcaacttgagataaggcttgaggatgcatcggctggtgcctggtaacttgtctctagttctttgattatatatgtttttaagataacttatcctgtcattgtggttgtaaacacacaatttaaaactactgtttagctactcttgtgttcaaacttagaatgttgagatggcctctgtatgttgtaaagctaacttctaaatgggtttccacgcaaaagaatcacgcagtg

SEQ ID NO: 235 - DNA, 961 bp, Brachypodium distachyon
atgggcatcggagcactgcagccggcggcggccatggccccggccgccactgcctcgaacgcagccccccgaatccaccatcgtccgtggacgcgcgctgccgcccctaggactctggtctgcaacgcgggatcaggttcttctaacaccggcgctccgccgcagccgcggacgacgaggggccgcttcgccgcgaccacggcggccggggcggctccggacgccgtgacgtactcctccagcatagacaccgacatgcccctctacgagccccccggggtgtcgttcgacgagtacctcgaggaccggccccgcgtgttccgcgccatgttccccgacgagggccggagccagcggctgggcgacgaccactggagggtccggatgctgccgctcgagttcctcctcatcaccgtgcaccccgtcgtcgtcatgcagctccgcaaccgcggccgcgcgctccacctccgcatcacggagtgggagctgagggggctggatagcggctacacgccggcgagcttcgacctgggggtgcggggctcgctctacgccgacaggtcgggcgggggatcccggctcaggggccacctcgagatctccatcaccgccgtcctcccgccgccgctgcggctcgtgccggacggcgtcctgcgaggcgtcgccgagtcggttctgtcgacgctggccgagaagatgaagcgggatgtggacgtcggcctcgtcgccgacttccggatgttccggatggagaaggcggcttccagagccaccggaacggctgtcgccagagcagagtagtagcagacagagaaagcctgaaggctcgtcaagttttcttctgaccaaaagtttgttttcctccggcggtttgagaaatgcatctttgtatagagcatggattggtactactacgtttttcccggcagcagcgaatcttaaaccgaaatgcaaggtctct

SEQ ID NO: 236 - DNA, 1008 bp, Brachypodium distachyon
aatcccaaatctaacgtaggaaacgtcaaggacaaggaagaaaaccaccagcttcactggctcaacaccggcggccacccctcatggcgacctccacctgccacctaccacctctcctccctggccccgcctccccgaaccatctccacctccgatcctcccctcccccgttcactcgccacctccgcaaccctactccggttcgtctcctccgcgcagcccgccgccgccatcccgacgccgtcgtcgtcgtcccggacgcccgtccctgggtcggcgatctatccggatccgcttcctaccgggacggcagcgaggaagatggagacgcggaggaggaggacgaggaggaggaggacgaccgcagcctggacctcctggcccggttcctgcaatcggtgttcaggaaggcctcccgccgcgcgcggcgcgccgccaggtccgtgctgccgccctccgtccccgctgagctggtaaaattctcggtcaatggtgtgctggttctcacgttcttgtggatcctcaaggggcttcttgaggtggtctgcacatttggaagcatggtgtttataagcatacttcttgttcgaggaatatggtctggagtaacttacatcagagaaaaccgatacagttatattcaacagctcaacgatgaaggcaaccggtggagcacagtacaaactgccggttgatcatttcctttccgtcttgccattatacagcacagctgcgcgagaatggaaggaaccccatgtgttatgtacaaataagtggttccgttcttcctctgggcgtatacaggagggatgcttgagttcagcaggattaatgagaacagccaaatggtgctgcagaatgttactagcagtagtttgcgtttatgcatggcccataccagcagatgtagaaagactcatgtttgttgtatgaaaggtggtgcaaaatcctttcgataattagtacggtcgtttagggcacttaaaattcatttggccttcacagaaa

SEQ ID NO: 237 - DNA, 4159 bp, Brachypodium distachyon
tcgcttgcctgattcgttcgtggtccctctccggtggggggctgtggtggtgctgaggcggcggagcggaggcccggagcgagattgtttgtgcccgctctcccccaaccccgactccggcgaccactgaatcaggagggggaggaggaggatgttggttagatttggcgtgatcttatcccgaggggggcgcgcggttctggcggggtaggttttgggcggcaggcgatggaagggacgacggcggcggtggttggcggcgacggcgcggcgggggatgcgcagattaagggcggtaaggagaatgggcagcaggcgctgcagctgcagcggccgctgcagccgtcggggggcagcgaggcgctcgagatgccccccacgccgctgccgatcgcgcgggaccttgactggtccgagcatttctccttcttcaactcggcgggcgggttcactgacggcgcgagggggttggcgagcacgggcctgtcgaattccgtgtcgaggccggacagcgtgacccagtgctgcttggaaggcacggacgagagggtggaggagctcacggtggggaattgcatcagctctgatgctcagcctcacgcctctgctggtggaagctcgagcggcggggagaggcctgctgttgtgaggggcctgtggggcaatttcacgcggatggcatggaggtctagtgatgtggccagcagggaaaacttagcagcgggtcgtggcgacattgcgaacttgaggactggtgatgtggctagcagggaaactttggcagtgaaccttggcaacaatatgatctctcagaacaacttgaggactggcaatagcattgatgcttcgggcaaggaaatgccattcagtcgtggtgacaatgctaatagcgagttcaatatgtcatttggtaatcagcagcagcctattccgtcttcacggctgaatcaaaccgagcaacgatttgaaagagagaatggtctgaaagtgagtagtttctcaaatagaattattgatcagatgaggaataaaactgccacaccttcatctggggttcaggggtttccatttaagactgcgtcgaagggtaaaggggttacctaccaaagtgcacgtgaggagatacaagcacaagctaatgtaagacctagagtccctatggataggatttctaagattcctagctcaacacacaattctatggccagattggatggtgcatttttcaacggtggtggaaatgcttctgaatctcaaaatgagggaacaagcctgagggaactaattaggcccacaggccaagtgacgagcaagtttgagaaaatgcagttgttcaagcagatccttgatcatgtagacaaatctcatgcacggggtttaactttgcaacatgtacgcccttcatattttatagtctcacctccaaaccaagtaaaatataccggctcttatgctacacaagatttatcagccccagccaaaccggatattgccacagatgacatgttcaataggaaacgacgcttcgatcagaaaaatgcgcaccaagagtttaatggcaatggaaatccaaattcaatcctaaagtatcaaaaggtcggtgatcaaggttctgttgccgtcaggcgaccgacacatacctttcggactgaccacagagggggcaaccaaagtgaagatgttgatcctggtgcttccggacagggaaattctagttgcaccgtcagaggacgttttaacttcggcgaaccttactatggcaatggcaataatgcatcttatgcccaacgtttatccaattacggcaaccaagaatcggtacttgatttgaggttgctagaagatagctggtatagaagcccagaagagctcagtcaactgaaaggcacattcccatcaaacatctacagccttggggttattctatttgagctcttttgctgttgtgaaacatgggagctgcattgtgctgcaatgtcagatcttcgccatcggatcctgcctccaaattttctttcagaaagtcctagggaggctgggttctgtctttggctactgcatccagatcctcgttctcgaccaaaggcaagagacattctaggatgtgacttgataaatgagggtcgggatttgtcgttgttagataataaggtaccagctgctgtcaatgaggaggacacagaatctggtttattactgaatttcttgtctcaactgaaagaagaaaaagaaatgcaggctagcaagttatcagcagatcttgcaggcttacaaacagatattgcagaggttgagagaagacattcgctgaggaatgggttcagtttagaggacatgggagtactggcaagttctaatgatttgccaggcacttcttcagatgccctgagagggggatcgttgtcaggtttgctaccaccaatatgcaggtcaagcatatatgagcagagggtgatgaggaatttggagcaacttgaaaatgcatattactctatgaggtccaccattgacacgtctgagactaatgtaattaaacgttcggataatgatgctttgagggtgcgtgacaacttttaccaacttcatggtgatactgatgccatgaatgagcaaacagaccgccttggatgcttttttgatggtttgtgcaaatatgcccggcatagtaggtttgaagtacgaggaattttaaagaatgcagatatacttaactcaccaaatgtgatctgttccttgagttttgaccgtgatgaagaatattttgctgctgctggggtttcaaagaaaattaaaatattcgaatttgatgctcttttaaatgatcgtgttgatattcattatcctttaatagagatgcctagcaagtccaagcttagttgtgtctgttggaacagctatataaagaactacttggcatcaacagactatgacggcactgttcagctatgggatgcaagcactggtcaaggattcacgcagtttacagagcacaggaaacgagcttggtctgtgagtttctcagaggtggatccaactaaattggcaagcgggagcgatgattgttgcgttaaagtttggagtattaaccagaaaaattgtgttgacacaatcagaaatgtcgccaacgtatgctgtgtacagttctccccatactcctcccgtatgttagcttttggctcagctgattacaagacatactgttatgatctgaggcatacgagaatcccatggtgtaccatttccggacatgggaaagctgtcagctatgtaagattcttggatccagaaacacttatctctgcatcaactgacaataccttgaagatatgggatctcaaccggactaattccagtggattatctagtagtgcctgcagtctgacattgagtggccataccaatgagaagaattttgtaggcttatctgttcatgatggatacataacatgtggttctgaaaacaatgaagtatattcttactacaaaacctttcccatgccaataacttctcataagtttggttctattgacccgataaccggtcaagagacgaacgatgataatcagcaatttgtatccagtgtttgctggagagggaggtcaaatatggtggtagctgcgaactctagtggcagcattaaagtgcttgagctagtctaaacaagctgctgagaattttacagaatgagaaagtctgatcatacagtttccttgctgtttttaactcttaagcctcttagatggctgtatatcgtctcgagcattctgccttctgaatggacaactaagcgtcaacatatatcaaggcctaggttccgttcagccatcgcggcggtcgaaacatgcagctgtccaattcaagcgacctaagagacctactttgatgtttgctcgaaactccgaagcgaattgttcaaagggtatgaaatatcctagctagctattcttgggaggtaaactctgtttgtaacgcactttgacgtagtactagccagcatctcaaggagggtctagggggtggggtctgtacagatttaggggcccggaagggccgatgtataatatatatcttcaaacctggtgtacttttgagctaaagagccgcatgatatgtttggtcagtacatatccaatgggaatcaactcggtatgcaatgac

SEQ ID NO: 238 - DNA, 1359 bp, Brachypodium distachyon
tcactgtcactcgcgatggcgcggcctcgggcggggcctcacccatccagcctcgtggcgttgctcctttccgccctcctactcctcctcgcccgcgacggcgcggccaggggtggcggcggcaggggcagctcggtgtacccggcgtccgtggtgtacccgcaccactcccgccagatctcctggaaacccagggtgttcctctaccagcacttcctcagcgacgacgaggccaaccatctcctgtccctcgcgagggcggagctcaagaggtcggcggttgctgataacacgtcgggcaagagcacgctcagcgaggtccgcaccagctacggcaccttcatcagtaagggcaaggatccaattgttgctggtatagaagataaaattgctgcatggacatttcttccaaaagagaacggagaagatatgcaagttctaaggtataagcgtggggagaaagatgaaccgcaatttgatttcttcaccgacactgtaaatactgtacgtggtggacatcgcgtagctactgtacttttgtacttaacagatgtcgcagaaggaggggaaacagttttccccttagctaaggactttacagacacaggtttgcatgataaggatacaaccttgtcagaatgtgcacagaaaggcattgcagtgaaaccgcgaaaaggggacgcccttctgttcttcaaccttcgcccagacgctgcaacggaccccttgagcctccatggagggtgcacagtcatcaagggagagaaatggactgccacaaaatggatccgtgtagcctcattcgacaaggtctatcatatgccaggcaattgcagcgacaacaacgacagctgcgtgagatgggcagcgctcggagagtgcataaagaacccaccgtacatgattggaaccgcggcattgcccggtcattgtaggaggagctgcaacgtgtgctagcgatttagcattgcatggggaaacagaatcgacggtaactggcttgttgttcaatcaggtccatacatgagcaacgatagctgtttaacctgagtttgttcatgaggtttggcactacaaattgcaccagtattttgttgttccctgacggactacttggttcctggttaccatgtttattgatcaatggtaacctggctggaatcagagggcgaacaacctttgttaattagtgctcataatttatggtaggcaggcagagatcagtaagcttccagtgccgaagttgtccttttcggctgtagactgtagtagagagtttagagactgcaatctttttcacttttgcggtgtatagctagctcaaatgtgttcctggattcaatattaaacctctccaaa

SEQ ID NO: 239 - DNA, 1397 bp, Brachypodium distachyon
atcccgcgtggtgtattcagcaattaaagaaatggaatggacaggtttataagatttagccaggaaagactagaatcagaagctaatggttgcgggttggggcactccctttggtccgattggctcacacgcttaaattgtggcaacaacaaatactagctactacatgcttcataaataaaaggaggtccattttcaatttattcctctgcatatcccccccttctgtcttctcctctcctttgcaactcctctccatatcctgatcattccaaggaaagtgtaagagactaagagggaggataggacgagatgttttttcagaggaggaattcaaagaaagtgaaggacaccgatggatcatcaccgaagaaggacaaagatggccgtgggaagaatgatttcttcgatcgcgccaagggtgcttttacaggaagcctcaagtcagccaagaatgacgctcaagggagagcggaaaaggttcaagcagatgtgaaggctggctttgaaacaatcttggagaagggatcaggcattctcgagaaagcgaaagaggatgttggaggtcactcagaatcagaagccagccgctcaaaggaactaggtcaaggaagtgaagaacaaggaaaggaggacatggaagctttcaattcaatgctcgacaaggtgaaaactcacccagatgtgatggacaaggtccattcggtcctcgacaaagtgaaaaaacacccagaagtgatagaaaaggttgcggaggttttacatctgggaaaacatgaatccaaagagaaagaagctgctgaggtcaaggagaaaacaaaaggcgagaaaacacaggacgctgacgagggcgcctctggcgataagaccaaaagctcaaacatcctagaggaggctgtggaagaaattcaggctgtctttgcagcggtgcagcagcaagatacagatgaaactgagattccagttgaggctgctgccgaaaccggaactccagctgaaggagaacagcccgaggaagcaaagcgggaggtggagaaagacgacccgaagaagcgaatcgatttcctcgggttcttcgccatgctgtttgagaggttctgctcccctgctgccaagaagaaagactagggtgtggcagttcagctgtggattaattctgccttttttgtgttctttgaaattgaatggtctgcttgggagggtgtggatggtgtacagtttgcagctgtgtattctcttcagagttgtttgtttttggatttgtccttgatgtttgatgaatgcagaaaaatagtgttttattttgtgtaactcttgttacttatggatttgatccaatttatgtgaatgaaaaaaacaattgaatttatataagaaccttccaccgtatcaaaaac

SEQ ID NO: 240 - DNA, 1733 bp, Brachypodium distachyon
atgtcgcatcatcttcacctgcgtggctcggttcctccgctgtccttccgcggtggactggacgctcgcttttcgcccggtgtgccctggcatttcgctagcagcagcagcaacgtcggcgtggctgcagcatcgtctgcacgaaccctccggccgccgcagcacagggcgaaggtgatggcgaaggaggccggggagcaggagacggcggcgctcggctgggcggcgagggacgcctccggtgtcctctccccgttcgacttctccagaagggctcagaaagacgacgatgtgacgatcaaggtgctctactgcgggatctgtcacactgatctctacatcatcaagaacgaatggggcaacgccatgtaccccgttgttcccgggcacgagatcctgggcgtggtgacggacgtgggcagcggcgtgaccaagttcaaggccggcgagaccgtgggcgtgggctacttcgtcgggtcgtgccgctcctgcgaatcctgcggcaacgggtacgagaactactgctacggcatggtgctcacctccaacggcatcgacgccgagcacggcggcgccgtcacccaggggggcttctccgacgtgatcgtcgtgaacgaggactacgtggtccgcgtcccggacgggctgccactggacaaagccgcgccgctgctctgcgcgggcgtcacggtgtacagccccatgatgcgcttcggcctgaacgcgccagggaagcacctgggcgtcgtgggcctcgggggcctcggccacgtggccgtcaagttcggcaaggcgttcggcatgaaggtcaccgtgatcagcacctcgccggggaagcgcgaggaggcgatcgagaagctcggcgccgacgacttcctggtgagccgggaccccgggcagatgcaggcggcgttcgggaccatggacggcatcctggacacggtgtcggcgtggcacccgatctcgccgctgttcgcgctgatgaagcccatgggccagatggtgttcgtgggcgggccgaccaagccgctggagctgccggcggtcgcgatcgtgccgggcggcaagggcatcgccgggaactgcgtcggcgggatgagggactgccaggccatgctggacttcgcggggaagcacggcatcaccgccgaggtggaggtcatcaagatggactacgtcaacacggcgctggagcggctccagaagaacgacgtccgctaccgcttcgtcattgacgtcgccggcagcctcggcaccaccgcgtagctaggccgggtcgcgcacgagagcccgttgcccctctcggccatttgtatgttgttttcagtgcaccacagaggttcaggtacaatctctctatgcattccttctttagtagtatcgtgtctaataaaggagtagtgttattgggagtagagatgtgagagagacctaatgattaatttgcaagttgatttgtgcagagaaacggtattcactactgtaagagattgttctcttctctaaaaggattgttctcttctctcgttaactatgtggcgcatagataaaacactgccgtggatgattaagagaagatgtcacatatagagacctaagttttctttttccttttttgaaatcgaaagacctaagttgttagaaggaggatgatctattctaacttgttataattttcagatgtaaactttgagacttgtgcgatgtttgagatttgaataatggcatggttg

SEQ ID NO: 241 - DNA, 4981 bp, Brachypodium distachyon
agggaagaaaaaatcgggagttgctggaccatgagcggagtgctacaagaagcaaccaatagtattatttttcttccttgtcatctagcgattataaactctcagctacctaggcaatcctggcgagaagtttaaccagaggtgtccgtcgagtggattatcatttgatctttactatctccgggcattatcccttgaatctccatggagtttgagccagaggagcctcagttgttgacgaggttgcatgcgggcgccttcgtggccatctggaagctgatccagcggccggagttcaacatggacgacacctcggcctcgggagagcaaagacttggattcatctctgcaagaaatccttggtttggaaggtcaagaatgtttcgacactgcttggacctacggcatctttgcaggttacctaaccagatagtcactcttccaaattaccgaccaaagcatgctcccagtgctgcagtatacaggggtgttagtagtccattaacagaggaatttgttgatgaggtgggatcaagatcaaggattattcacttttaccgtaaaccatttcttcaagagagtgagactgaggaattactcaggaaagtgcaggcaaaggtttcttgtaacgttattgacataaagaccgagcaatgtttcaatgttgaattggagagggccctggcatctgagaagcttgcaacacttcagtggcttctagcggaaacttatgaacctgataatttacaaacaaggagctttcttgaagaggaagttgctagcggtccttattctgttcttgtcgaggtagggccacggatgacattttcaacagctttctcgaccaatgctgtctcaatttgtaaagccctatcgttaatggaagtaactcgcttggagagatctcgaagatatcttttgtgccttcagcctggcggtggagcacttgatgaaagccaactcaacagctttgctgctttaattcatgacagaatgacagagtgtgtttatcctagcaagctcacatcattttggtcagatgtagttcctgaacctgtcagtgttataccagttattgaaaagggaagggaagcattggaagaaataaatatgagaatggggcttgcttttgatgaacaagatattaaatactacacccacctcttcagagacgacatcaagcgcaatccaactaccgtggaacttttcgatatagcacaatccaatagtgagcacagcaggcattggttttttaatggaaagcttgtgatagatggagaaacgatggctagtactttgttccagttagtaaagagccccttgaaggcgaaccctaataactccgtcatcggtttcaaggataactcaagtgcaataagaggacacacggtaaatcatctccgtccagcactaccaggctcaacttcaccgctatcccttatgatgcgtgagcttgacattttgttcacagctgaaacccataactttccatgtgctgtggcaccttatccgggagctgaaacaggcgcaggtggtcgcataagagacacacatgccactggaaggggttcttttgtcgttgcttccacagctggttattgtgttggaaatcttcaaatggaagaatcatatgcaccttgggaggattcatcctttgcatacccatcgaacttagcttctcctttgcagattcttattgatgctagtgatggtgcttctgactatggtaacaagtttggtgagccactgattcagggatttacaagaagctttggtatgaggttgccaaatggggaacgtcgtgagtggttaaagccaataatgttcagcggagcaataggccagattgatcatgcacatataacgaagggggatccagaaattggcatgctagttgtgaagattggtggtccagcatatagaattgggatgggtggtggtgctgcctcgagtatggttagtggacagaatgatgcagagcttgatttcaatgcagtgcagcgtggagatgctgagatgtcacataaattgtatcgtgtgatcagggcatgcattgaaatgggagagaagaacccaattatcagcattcatgaccagggagccggtggaaattgcaatgttgtgaaagaaataatctatcctaagggtgctgaaattgatatccgctcaattgttgttggtgatcatacattatctgtcttggagatctggggtgctgaataccaggaacaagatgcattattggtgaagcctgatagcagaagcctgctggaggcactttgtgagagagaaagagtatctatggctgtacttggggaaattgatggcagtggaaagatagttttgattgacagtgctgctgtggagcatgccaagtcatatggccttcttcctcctcgccctgttgttgatcttcagcttgaaaaggttttaggagatatgcctcagaagacctttgaattcaaccgggtttctcgattgggtgagcctttagatattgcacctgaggtcacactaatggatattcttaagcgagtattgaagcttccttctgtatgttcaaagcgtttcttgaccacaaaggttgataggtgtgtgacaggtcttgttgcgcaacaacagacagttggtcctctccaacttccacttgctgatgtcgctgtaattgcgcaaacatacacagatctgacaggtggtgcttgtgccattggagaacaaccaatgaagggtttacttaatccccaggcaatggcaaggcttgctgtcggggaggccttgaccaatctggtttgggccaaagtttcatcactttctgatgtcaaagcaagtggtaactggatgtatgctgcaaagcttgacggagaaggagcagatatgtatgatgctgctgttgcgttggctgactgcatgattgaacttggtatcgcaattgatggtggaaaggacagcctttctatggcagctcaatgtgatggcgaggtagtcaaggctcctggaaatcttgtcatcagtgcttatgtgacatgccctgatataactttgacggttactcctgatttaaagcttggaaaggatggtgtcttgttgcacattgacctggctaaaggaaaacgtcgacttggctgttctgctctcacacaggtgtttgaccaaattggaaatgactgcccagatatagaagatgttccgtacctgaagatagtatttgagactgttcaggaattgctcagtgaacgtcttatttctgctggtcatgacattagtgatggtgggcttattgttactatttttgagatggcatttgctggcaattgtggtgttaacctcaacatagacttaaagggaaatagccttcttcaagcactttttgctgaggagcttggccttgttgttgaagtgcactcagatgaccttgattctgtaaagcaaaagcttcaagcagcaggtgtttctgttcatgtaattggagaagtaaatgcaacatcagagatagagctggttgttgacggggaggtgcgtctgaaggaaagcattttagacctcagagatttgtgggaagaaacaagcttccagcttgaggagctgcagcggctgaagtcttgtgtgaaccttgagaaagaaggtttgaagagtcgaacatcaccttcatggcatttgtctttcgctcccaaattcacaaacaagaagctattgactgcatcctccaaaccaaaggttgccattattcgtgaagaagggagcaacagtgatagggaaatgtctgctgcattccttgctgctggctttgaaccatgggacatttcaatgtcagacctattgaatcaggaggcctctttgactgaattccatgggattgcatttgttggtggttttagctatgctgacattctagattcagcaaaaggctgggcagcgtctatcaggttcaaccagcccctcatacagcagttccaggagttctacaataggccagacacgtttagccttggggtgtgcaacgggtgtcagctcatggctcttcttggctgggtgccaggaccagatattggcggttcccttggtaaaggtggagacatctcacagccaaggttcattcacaatgaatctggccgttttgagtgccgatttaccagtgtggctataggggattctccttctataatgttcagaggtatggaaggctctaccttgggcatttgggctgctcatggtgaagggagagccttgttcccagatgaaaatgttttatctggtgtcattaactctaatctggcccctctgcgatactgcgatgatgctaataacgccacagaggtctatcccttcaaccctaatggttctccgcttggtatcgccgccctctgctctcctaatggaaggcaccttgctatgatgccacatccagagcgtactttcatgatgtggcaatatccctggtatcccaaggaatggcaggttgagaggggtggtccgagtccatggttgcgcatgttccagaatgcacgagaatggtgttcatagagcagagcaaaactggtgttcgctggtgttgatcttttcttgctcgcctgcacgtatgaggatgaacatgtttcctttcggagttgagcatggattaccccacaatcgctctttagatggtagagctcctatcaccatgatttgaagcatcagtatggttattcttgaactgctgtggccagtattgtgcgattctaagagttgccgacgttgtgctgtgatagtcggacagataattcttccatatacaggagttgatgtcctattaactttctacctcgttaaaacttgtgtggacgtgcagttcttgtatggcatagccattattttttgttccttctattatttatcagatgtcaagaacaagctcctgaaatcccagaacatcttgaatgaaaatcttgaatgtgcgtttctgaatacaatttataatcttggttggtttcataaaagtatattt

SEQ ID NO: 242 - DNA, 788 bp, Setaria italica
cacatttccactagacagccgaagatgggggcgtcagcagcacccttcaccggtggcttcctctgcccgaccaaaccaaggacaccaccgctcccgtcctccacctcccgatcttctcactcccgcctccacttccgcatccgatcccccaaacccaagaacccggcggcggcgcccgtctcctctcgcatggaagcgtccctgccccaggcgcgcgacgcccagggaggggcggagtcggccatgaagctgctgttcgtggagatgggcgtcggctacgaccagcacggccaggacatcaccgccgccgccgtgcgcgcctgcaaggatgccatatcctccaactccatccccgccttccgcggcgggtctatacccggagtgaacaccgaccagatgaagctgcagatcaagctcggcgtgccgaggtcgacacagcacttgctggatgctgagagagtcaaagccgtcttcccctatggcgagataatcagcttcgaggttgtcgatggcggcatgatctgttcgagcggcgtgtgcctggaagcaatgggggacaaaaacgacgactgctacatagtcaacgctgcagtttacgtcggctattgatgtaattctggaagagcggctttcacctggaacagtagaaatcgggcaggccacctctattttggagaactagagatgttttcctacctcaataagcatgtcattgctgaaataagtgcacttccttggtgtcgtatcgtattcgttctatgcctgccctcgtacgtcttttggtcacg

SEQ ID NO: 243 - DNA, 1672 bp, Setaria italica
cactgccaaaccaaacacacaccccccaggacacaaagaaagaagccttcctgtccccgagcacaatgcgcctcgccggaatcctctccgcctccaccgtcctcctcccccttctcctcgtcctcggcgcgtctccgccgtgccatggcgcctcaggccacaacatcacggacatcctcgcggcccacccggacttcaccgagttcagcgccgccctgacaagcaccggcgccgcggcggagatcaacaaccgcaccaccatcaccgtccttgccgtcgacaacgacgtgatgtcgcagctcaaggcgcagcagctccagccgagagacctcgagcgcgtgatctacctccactgcctcctggactacttcgatgccaccaagctcggtagcatccggggtggtttcgtccaggccactagcctctaccaggcaaccggcaaggcgcagggaggagaaggaatggtgaacgtcaccatgttccgcggcgggcgtgtcgcgttcgctctgtccggcacctcgaacgtgccgccggccgcgttctaccagaaatccatcaaggaagagccctaccaaatcgccgtcctgcaggtgagcgccccgatctggtctccagcgccggtggccggggcgcaggcgcccgctccagagccgccggcgccgggattggcggatctcctgtccaagaacgggtgcgggggcttcgccagcctccttgccgcgacggccgacgctgcggcgaaattcgagcgcagcgccggcggcggcggcgggctcaccgtcttctgccccgacgacaaggcggtgacggccttcgacgccaccttcaagaacctcagcgccgacggccagctcgcggtcctgctgtaccacggcgtggcggcgcactactccgcgcagtctctcaagacgatcaatggggatgtgaacacacttgccactgacggatccaagggctacaagtacaacctcaccgtccgtgctgacggcgacacggtggaactgtcgtcggcgtcccagagcgcggccaaggtgaccaagacggtggtcgacaaggggcccctcgcagtctatctcatcgacgccgtgttgctgccaagtgagctcttcaacgccagccatggccgcactgcgcccgctcctgcgccggcctcgtcacctgcccatgcgccgccacctgctcctgcgccggcctcatcgcctgcacatgcaactccacctgctcctgtgccggcctcgtcgcctgcacaagcacccacaccgccagccattgcgccggcgactccacctacgcccaggcgccaccccgcgccaccacaagaggcggacacccctgcggattcgccggacgccgacagccagccgcctgcagatcagaagaacaacggagctagggacacggtgtcttggagtcttggcatggtggtggccgccgcggtgccggtgatcgtgctcctgctgcagtgaagggttcatgctggttagaatgatttcgatttggtgttcccgtgaccaatcatcttgattacaggttagcatggaaacagtgtttatgggcatgtattggtcaaaataatatgatcctgattattgtgcctgcttaacaatggtgttcttcgtggttggattggcatttctgtattgaatctttcttctaattctctctgtgtttc

SEQ ID NO: 244 - DNA, 1170 bp, Setaria italica
cggaggaatctatggcggcgtcgacggcggcggcagcggcacccccttcctcctgcgagatcgcgcggatcccggaggacctcctcgcggcgtcgatcgcccgcaccacgccgcggaacgcctgccgcgccgccgcggtctcgccggccttccgcgccgccgccgactccgacgcagtgtgggcctgcttcctgccgggcgacctcccgccgcttgccgacggggagctctcccccgcgccgccgtccaagaaggagctcttcatgcgcctctctaacagcgacagccccgtcctcctcgccgaccgcctcatgagcatgtggttggacagggacaccggcgccaagtgctacatgctctcggcgagggcgctgtgcatcatttggggcgacacgccgcggtactggcgctggatccctctcgctgactccaggttctcggaaggtgccgagctccaggatgtttgctggttggaaatacgtggcaagatacattgcaagatgctctcgcgaaactcaacttatgctgcttacatggtgttcaagatatccgatgaatcctatgggctggattatccaccccaggaggctgcagttacaattggggaaagcaaattcactcgtcaggtttgcctccaaggccatgagaacgagggtgagggcatagaagaggtgcctcagaattaccgatctcttatggttccagccatcacacgaaggttaagaagaaaccgtcctttgcctcatggagtgactgtgcctaagaaaagggctgatggctggatggagatggaaatgggtgagttcaacaatgaagaaggtgaggatggtgaggtgtctatcagtctcatggagacaatacaaggccactggaagaaaggtcttattgtgcagggcattgaagttagagcaaagaaataaaactgggagggtgggatatcgtctttgcacatcaaaataaggctatatgtatatgttttgcagcattgtgttggtggacaatgtgcttttgtttgccaacgagctgctaactacacactgataaatgggtgtgtccaggttcttgagggaaaacaaaaaaaaaaaaccctgcagttttgtacaaattatggtgtcccagatcagttagtgcttgtctgcttgatgactggcaacgtttggttctgaaaat

SEQ ID NO: 245 - DNA, 2012 bp, Setaria italica
cccgaggttttagctccaccacgagctgccactcccctccaccgccgcgacgatgatctccctgctccgccgcaccgtctcctcctcggcgccggccgccgcgcggtggcggaggcccctcctcgcggcgctgctctccccgccgccggcccctcccggccctacacgccgcgcgccggcgctggagccgccgaggcgggcgttccacggctcgcgggcccccctggggttcagggccacccccgcgtcgtgggctgggcccggaccgggggcgggcgtggcagcgggggaggacggcgggctggagattgcgaggctggggatctccgggcggatcgtggagaagctcgccgcgcggggcatcaccaggctcttccccatccagagggctgttcttgagccagcaatgcaaggaaaagacatgattggccgtgctcgaacaggaactgggaagaccttagcttttggtattcctatcatggacaggattattagctacaatgagaagaatggaagtggtaggaatcctttagctatagtcttggcaccaacaagagaacttgcccggcaggttgagaaggaatttagagaatctgctcccttggacacactctgtgtctatggaggtgttcctatcaaccaacaaatgagagttcttaactatggtgttgacatagtggttggaactccaggtcgagttattgatcttttgagaagaggtgttttaaacctttccgagatccagtttgtggttctggatgaagctgatcagatgctggctgtgggttttgatgaagatgttgaggtgatcatggagcagttgccacagaaccgtcaaagtatgctgttctctgcaacaatgcctagttggataagaaaaatttcaaacaagtacttaaaggatccagttataattgaccttgttggtgactcagaccaaaaattaccggaaggaatctctctgtactccattgcctctgacaactttgggaagccatcaattcttggtccgttgattaaagagcatgctaatggtggaaaatgcattgtgtttactcaaactaaacgagaagcagatagattggcatatgttatgggaaggagttatccatgtcaggcgctacatggggatatttcacagaatcaaagagagaggacactctcaggatttcgtgatggtcgcttcaatatccttgtggcaactgatgttgcagctcgtggattagacatacccaatgttgatctagtggtacattatgagattccaaatacctcagagttatttgttcacagatctgggagaactgcacgagcagggaagaaaggcagtgcaattttgatatacacatatgagcaaactagagctgtaagggtcatcgagcaagatataggttgcaggttcacagagcttccaaagatggcagttgcagatgaggcgcagacatgtttaatgtcatgagagatactcgctctagatcagttggaagcagaagaacgggtgggactttggccgtgaaagttatggtggcttcggagatcaccgttccggtggctttggtgattttgacagttttggtggttcctttgatcgcggtggcgggtcccgcgactctggttcgggataccgtggtgggtctggaggtttcagacgaccttccaatgactttggcaggtctagtttcggtcgctccgatagatttggcgactttggagaaggcgatttcagcaggcgtggcagccctgactttgggcgctcccggagctccgatgattcaggatcctcgcgctatggcagaggatccagtggtgttggcactcctggtttcggcaacttcggtggctacggggattccaagcgatgagtggaatgtctttcttcttgtacagttctgaacttttttctagcacctgttgtttcttccatgcctgagagaactaggcgcgctttgttgcgcttttggcctaatcactagtagtttggttgtgtagtgctgtttcagaacttatgttgt

SEQ ID NO: 246 - DNA, 1221 bp, Setaria italica
atgaggctgaggcagcacctggcctcctcccctatttatacctccgccatcgccaggatcggcaacagcagagccccccaccgcctactccccgtcgcaccaccgcaaaagcaccgcccgacaagtaccaccaacaagcccctgctcctgattcttctgctactctgcttcttcttcctcttcttgatcccgaccgtcttgttgcccccagcgcgagtcatgtcgtcgtcttcctccgcttcggatgccgctgccgccgccgtgccgttcgagaagcccagggccgtggtcaagaagctcctcgccgagtcgcagcccgaggggcagggcgccaccgtccggaggagcatcggcaggcatgagctcaggaacctggaccccttcctcatgctcgacgagttctcagtctccaagcccgccgggttccccgaccatccccacagaggattcgagaccgtcacctacatgctcgagggagccttcacccaccaggactttgcgggccacaagggcaccatcagggcaggggatgtccagtggatgactgccggccggggcatcgtgcactcggagatgccggcgggggacggggtgcagaagggcctgcagctctggatcaacctctcctccaaggacaagatgatcgagccccggtaccaggagctccagagcaaggacatcagccgcgccgagaaggacggcgtcgaggtccggatcatcgccggcgaggccttcggcgtgcgctccccggtctacacgcgcaccccgaccatgtacatggacttcaccatgcgcccgggctcccagctccaccagcccgtcccggagggctggaacgccttcgtctacatcattgacggcgagggcgtcttcggtcgggagaagtcggcacccgtgtcggcgcaccactgcattgtcctgggcgacggcgacgggatcagcgtctggaacaagtccggcgcgccgctgcggttcgcgctggtggccgggcagccgctgggcgagccggtggtgcagcacgggccgttcgtcatgaactcccgcgccgagatccagcaggccatggaggactactactacggcaagaacgggttcgagagggccagccagtggagctcctccgcctgatcatcgatcacccgcttctgaattctgatgcatgcattttcttgagaaattgacatggaaaaaaaggaaattgctgtcctgcatacctggatg

SEQ ID NO: 247 - DNA, 1018 bp, Setaria italica
atgcagcgaaagaacttccgcaagcggagcttcgagccggacgccgacgaccgctccgacgacgaggacacccgccgcgtcgtcctggaggagatcaagtacatgcagaagctccgggagaggaagctgggcatccccgccgaccccgccgccgcctccaccaacgggtcagccgcccgcggactggtgggtggagggggagcggctatcggcgaggccgagaaggaggacctcgtcctccaggacaccttcgcgcaggagactgccgtcaccatcgaggaccccaacatgctgaggtatgtggagaccgagctggcgaagaagaggggtaagacagttgatgtgggacacaaggaagagatggaccatgtggacgagctctacaccgtgccagaccacctcaaggtgaagaagaagaactcggaggagagctcgacacagtggactacgggcattgctgaagttcagctgcctattgagtacaaattaagaaacattgaagaaactgaggcagctaaaaagatgctgcaagagaaaagacttgcggctaaaccaaaatcagattcaaatattccatcaagttacagtgctgattatttccatcgtggcaaagaatatgatgagaaattgcggagagagaatcctgggctgtacaaagataaagattctcggcctaatgaaagtgcaggaggtaaagcaacagatactaaaaatacagctggtgccggtgcaggacggagagaggctgctagtgatgatatcatgcttgagcgattccgcaggcgtgaaaaaattcgtgtcatgcgaaggtagccagagctgtcagattgctaccgttgcctttgaagatcaaatatgtgatcacatgaagacctcagtattcctgtcctttttagcgagaattttactgtaaagctgcatccttggttcttggctacttttgcagctactaagggcaaggagcagattaaatccttatcgcagaggtgatttggggcaatagattttggggagagtt

SEQ ID NO: 248 - DNA, 471 bp, Zea mays
ccgacaccgacgcgacagccgacaaggcagggggagaggccgagaggggaaatggcatcgttgtcccgcaccgctgctgccgctgtcgtggccctgaggtcggcggtccgctccgcgccccttaccggccgcgtcctcggagcgccactaccttcctttgcctcgccttccgctacccgctccgcccggatcctccgcaggtcggcggccgcggcgtcggcggggctggaaacgctaatgccgctgcacagcgcggtggctgccgcgcggcttaggtcctgcatcgccgtcgactcctcctgctggtgctcgctctcacaaggatatgctttgcctttatgacagcgaggcgagctgcacctgaagaaacaaaagaatcttaggaattacaaacaagggctgtactgtaataatgtggttcttgtaaaccaattttgccttagaattctgtaacttgaatcatccacagat

SEQ ID NO: 249 - DNA, 2321 bp, Zea mays
tgacactcggctgttccattcgtgatcccatcacaccagccgccgtcttctccctcactccgccacgccactaaaaccctaatccctcgccgccatggctgcggcggcggccgccacctcgctcctcatacgccacaaccgcaacccccacctcctcctcctccgcgccgcgatctcctcctcccgcgcactgtcccagcagccggagctgtctcctgacccgaccaccggcgcccccgaccccgccggcgccgccccactccccccaaaccccagcacggggagccccttatacagccagaactggcgcaaccccgccgcagccaacccgccctcttcgcttctgcccaccgtcgccgccggcagctccttcggagcgcagcaccgcatggccgccttctacgataagcccgacgccgcggggctcaaggaaacgtttgccaagtatatggcggagcagcggtgggaggacatgaagcttctgttcgaccactgggtgcgctccctcgacgccgccacggggaagcccaaccaccccgacgtcgacctattcaatcactacctccgcgccaacctcatgacgggtgccgtaccgcacgagatgctcgatctcgccgatcacatgcgcgagttcgagctcgagcccaacagtgcatcgtacaacctcgtgctcaagagcatggtcgccgataaggagtcctacggcgccgagaagctcattgaacggatgctgcaaacaggaacagttccagatgaagaatcctacaatttggttgtaggcctgcttattagacagaaccttgttgactcatctctgaagtatttggatctgatgcttaaatcgggctacacgccatcactaactgttttcactgattatatccaagcatgtgtcagatctgggaggttggacacgttgacatcaattatacagaaatgcaagacagctgataagatcaaagttttgtgtccacaatgggcctggtgcattgacatatcagaagctgcatttgaagctaacaatagcaaattagctctttttgctctggaatttcttgcaagatggattgttcgtggtgagaatgttaaacctcctgttcagctgtcagttaatgaaggtcttgtaatatcagctctgagtgctgctggcagaacttttagtactgacctcttgaatgctgcttggtcgctactacggaagtccctgcgccagaaaagggcacccaccccagagacatatcttgccaagatctatgctcattcatcaattggccagcttcaaagggcttttggtacattgcatgaatttgaaaatgcctatgggaactccaaggacgttgatttagagctcttctcaccatttacgtccttgcatcctcttgttgttgcttgctgcaaagatggctttagcacattggatttggtgtatgttcagttggagaatctgagtcatgcagatccaccttacaaatctgttgcggctctcaactgtgttatattagggtgtgcaaacatttgggacattaatcgagcttatgaaacttttgtggctattaaggaaaaatttgaactcagtcctgacatccattcatacaatgcccttctgtgtgcatttgggaagttgaaacagacaggagaagcatgtaatgtgttccagcatgtattaactcttggtgttaagccaaatgcaacaacatactccctgcttgtcgatgcccatcttgcaaacaaagatccaaaagctgctcttgccataattgatgagatggttgatgctggcttcactccttccaaggataccctcatgaaggttcgaagacggtgctctcgtgagtcagactttgacagtgacgagaaagtccaatccctggctaagcagttcaactaccgaatgggtggtgagaatcgaagagagatgctttatagcatagaatacaatcctgtgtactgaagcggcagtttctactgagtttgctggtcgttgggagagcacggacattgtagcttgtaaattacttgaacgcaccaggattcttaagcaatattcagtttctcaatcattatttttgctcgcagggttgatgttaggacttgctaataagctgcatactatttgtttgcttgagaatccgaaaatgtcagttctttttcataaattgtagcatctgcgtggccccacttcttacgtgactcctaggtgttttcggctttgtttacacttgtaactaacgaagaagtcctgggatgactgggtcgcagcttcttcaaaagatgctattcttattatggaaatttaatggagactgacaatttaaagtcac

SEQ ID NO: 250 - DNA, 931 bp, Zea mays
aaaagagcagcggagcggagcatgctcttcctccggtgccagcctcgcgtctcgtccccgtcccgtccgcgtccgcgccgccttttcgtccccgcgtccgcgtcgcggctccactgggcgtgcgcgtcaccggcgggaggcgagggcaggcggtggtcgcgatggcgtccgccgacgcgcgcttggcggggattgcctcctccatccgcgtcatccccgacttccccaagccagggatcatgttccaggacatcacgacactgctgctcgaccccaaggcgttccgtgacaccatcgacctcttcgttgagcggtacaaggaccaagggatcaccgtagttgctggtgtggaagctagagggttcatttttggtcctcctatcgctctagccatcggtgctaaatttgtacctttgaggaagccgaagaagttgccaggcgaggtgatctccgaagaatattctctggaatacggaactgacaagatagagatgcatgttggagctgtacaggccaacgatcgggctcttgtagtcgatgatcttattgccaccggtggaacactctgtgcagctgtcaaacttattgaacgtgttggagcaaaggttgttgagtgtgcttgcgtcattgaattgccagaactgaagggccgagacaaacttggggacaggccagtttttgttcttgtggaagcagatgcttgagcggaacttgggacttctcttctcagagagttagagttggtgctgttgatgctacctctctgtcaacaacaaagtttcccatgttggctatattcttgctgacacgtaataaagtttcattccaaattgtgatcccctgaatgatttgtcaatgtagacatgattgctggtccttgtatactgtggcttattattcacatcaattaaggataatcctgattggagct

SEQ ID NO: 251 - DNA, 1395 bp, Zea mays
cgcctatgagggccctcgtccggatccacctgcccacggccatctccaccggatccttcctccacacctcctcaaccgccgcctccaagaccctagtaccgaaccccaacctcgtcccgctccggctcgtccgccacttcccggccatggccgccaccgccgcagacgagttcgtgaagggccgcgtcttccccaacggcgtcgccgtcatcacgctcgaccgacccaaggccctcaacgccatgaacctcgaaatggatgttagatacaaggcacttcttgatgaatgggaaacaaatccaagtgtcaagtgtattcttgtggaaagcagctcttctcgtgccttctcagcagggatggatattaagggggttgccgtggaaatacaaaaagacaaaaaaacaccacttgtgcaaaaggtattcacagtagagtactctttaatttgtaagatacatgagtatgcaaaaccttatatatgcttgatggatggagtgacaatgggatttggaattgggctatcagggcatggccgctaccgcattattacagagagaacactcctagccatgcctgaaaatggtattggcctgttcccagatgttggctttgcttacattggtgcaaaagcaccaggagggggtgcagttggagtttaccttgggattactggaaaaaggatatcatcacctgctgatgctatgttcataggccttggtactcactatgtaccttctgcaaatttgggttcactcaaggagtccctgctgagtgctaacttcaccaatgatcctcatagagacgttgagtcagttctgacaggatacaagaaagaaccagagtctgaaccacaactaaaaaagcttttgccatatatcatttcttctttcagtcctgataaatcagtggctgaatctgtggaagagctaaagaaatgtagccgaagtggtgatgctgcagtggcagaatgggccaatgaagctttagcaggaattgagaaaggcgctccattttctctttgtttaacacagaagcatttctctcaagttgcatcagcatatgggactagtgaacactatttatctaagctggctggtgttatgaaattggaatatcgcattgccttgaggtcgtcgattagaaacgattttgttgaaggtgtgcgtgctgttttagttgacaaggaccagaatccgaagtggaatccagccactctggaagaagtaaacatggccgaggtcgaatcagttttcgagccattaggggccgaggctgagttgagtgtgtgaaatatggcctgccacactcagttttcttatttgtgctgcaataataatgtatacaaaacagaaatgcgatgcccacagaaacaataaatgctgtgtcttcatgaac

SEQ ID NO: 252 - DNA, 5096 bp, Zea mays
cccgctcactccgagtctcactctcactccgtcctccctcttccttacagaaacacaactcatgcagctcgtacggcaccaccaccaccaccaccaactgccgcactgacacatgcatgcgcagaaagcagctagctagcggccggtggccttgagagccgctcgctagcttttaaaattagccaccaattcaatctctagctagcttgggggagctccgttcctagctacacgtacgggcggcgcggcaaccaccagccgtgtagccgacctagtacgttggagcgaagcatatatcggcggccgcatcacatggagagcgcgatggagaaggtgtgggagtcggggcggcggatgagccggagcatcgggcggggcatgggcatggaggcgtggggcgtcgacgacgccttcgtgccgcagcacggctcccggtcccggggcggcggcggcggcggcggcgacgacgacgaggaggcgctgcgctgggcggccatcgagcgcctgcccacctacagccgcgtgcgcaccgccatcctgtccaccgagaacgccgccgtggttgacgacgacgacgacaagacgcggcggccgccgccgccgcagcagcagcacttcaaggaggtggacgtgaggaagctcggcgtcggcgagcgccaggagttcatcgagcgcgtcttccgcgtcgccgaggaggacaaccagcggttcctccagaagctccgcaaccgcatcgacagggtgggcatcgagctgccgacggtggaggtgcggttcgagcggctgacggtggaggccaggtgccacgtgggcagccgcgcgctgccgacgctgctgaacacggcgcgcaacgtcgcggaggcggcgctgggcctgtgcggcgtgcggctggggggccggcaggccaggctgaccatcctcagggacgtgtccggcgccgtccgcccgtccaggatgacgctgctgcttggcccgccgtcgtccgggaagaccacgctgctgctggccctcgcgggcaagctggacccggcgctggtcgtcgccggcggcggcgaggtctcctacaacgggttccgcctcggcgagttcgtgccgcagaagacggcggcgtacatcagccagacggacgtgcacgtcggcgagatgacggtcaaggagacgctcgacttctccgcccggtgccagggcgtcggcaccaaatacgatcttatgacggagctggccaggagggagaagggggccggcatccggccggagcctgaagtcgacctcttcatgaagatactggggctggacatctgcgccgacaccatcgtcggcgaccagatgcagcgggggatctctggcggccagaagaagcgcgtcaccacaggggagatgatcgttggcccgaccaaggtgctgttcatggacgagatatcaactgggctggacagctccacgacgttccagatcgtcaaatgtctccagcagattgtgcacctgggcgaggccaccatcctcatgtccctcctccagccagcccccgagaccttcgacctgttcgatgacatcatcctgctgtcggaaggccagatcgtttaccagggacctcgtgaatacgtcctcgagttcttcgactcctgcgggttctgctgccccgagcgcaagggcactgcggacttccttcaggaggtaacatcaaggaaggaccaggagcagtactgggcggacaagcagatgccttacagatacgtttcggtgccagaatttgcgcagcggtttaaacggttccatgtcgggctccagcttgagaaccacctctcgctgccgtttgacaagagcaggtgccatcaggctgccctcgtattctcgaagcactcggtgtcgacaaccgaactcctcaaggcatcctttgacaaggagtggctcctcatcaagcgcaattcatttgtgtacatcttcaagaccatacagcttatcattgtagccctcatcgcgtcaacggtgtttctgagaactcacatgcatacgacgaatctagatgatggctttgtttacattggagcactgctctttactctgattgtgaatatgttcaatggttttgctgagctttccttgaccataacaaggttgccggttttctacaagcaccgggacctgctcttctatcctgcttgggtcttcacagtaccgaacgtcattctcagaatcccattctccattattgaatctatagtatgggttcttgtgacatattacaccatagggtttgctccagatgctgacaggtttttcaagcacttgctgctcgtgttcttgatccagcaaatggcaggtgggcttttcagagcaacagctggactttgcaggtccatgatcattgctcaaactggtggagcactatttcttcttatcttctttgttcttggaggctttgtcctgcctaaagttttcattcctaactggtggatctggggctactggatctcacccttgatgtatggatacaatgctctagctgttaatgaattctatgcccctcggtggatgaataagtttgtcctggaccaaaatggtgttcccaaaagactggggatagctatgcttgaaggtgccaacatctttgttgacaaaaactggtactggattggagcagcagggctcttgggtttcaccatcttcttcaatgtccttttcacactgtcgcttatgtacctgaaccctctcggcaagccacaagctgttatatcagaagaaactgcaaaggaagcggaaggcaacgggcattcaaaaggggcaataagaaatggaagcacaaaaccaaaggacggtagtcataacaaggaaatgaaggagatgaggttgagtgcacgtttgagcaactgttcatcaaatggggtttcacgactcatgtccattggcagcaatgaagctgctccaacaagaggaatggttcttccattcaaccctcttgctatgtcttttgataatgtgaactactatgttgacatgcctgcggaaatgaaacatcaaggagtgcaggatgacagactccaattgttgcgtgaggttacaggatcattcaggcctggagtgctgacagcacttatgggtgtcagtggagctggaaagactactcttatggatgttttggctggaagaaagactggggggtatattgaaggagacatcagaattgcaggctatcccaagaaccaagcaacattcgcaaggatttctggatactgcgagcaaaatgatatacattctcctcaggtcacagtaagggagtctttgatatactctgcctttttgcgccttcctggaaaaattggagatcaagaaataactgatgacataaagatgcaatttgtggatgaagttatggaactagtggagctcgacaatctgagggatgccttagttgggctaccaggaatcacagggctttcgacagagcaaagaaaaaggttgacaatagccgtggagctcgttgccaatccatcaatcatatttatggatgaaccaacatcagggcttgatgcaagagctgcagcaattgtcatgagaactgtgcggaacacagttgacactggacggacagttgtttgcacaatccatcagccaagcatcgacatctttgaatcttttgatgagttgctattgttgaaaagaggaggccaggtgatctactctgggaaattgggtcgcaactcccagaaaatggtggagtattttgaggcaattcctggagtgcctaaaataaaagataagtacaatcctgcaacgtggatgctcgaggtcagttcagttgcaactgaagtgcgactaaagatggattttgctaagtactatgaaacatcagatctgtataagcaaaacaaggtactggtgaaccagctgagtcaaccagagccaggaacatcagatctttatttccctacagagtactcgcaatccacaataggacagttcaaagcctgtctctggaagcaatggctgacttattggcgcagcccggattacaaccttgttagatattccttcactctgttagttgccttgcttctcggctccattttctggaggataggcaccaacatggaagatgcaaccactctcggtatggttattggagcaatgtacactgctgttatgtttatcggcatcaacaattgttcaactgtgcagccagttgtttcaattgaaagaacggtcttctacagagagagggctgctgggatgtactctgctatgccatatgccattgctcaggttgttatagagataccatatgtatttgtgcaaacaacgtactacaccctcattgtatacgccatgatgagcttccaatggacagctgtcaagttcttctggttcttcttcatttcctacttctccttcctctacttcacctactatggcatgatggctgtctcaatctccccaaaccatgaggttgcatccatcttcgcagcagctttcttttctctcttcaatctcttctcaggcttcttcattccgagaccgagaattcctggatggtggatctggtactactggatttgcccactggcatggacagtgtatgggctcatcgtgacacaatacggagacctggaagacctcatctcagtccctggagaaagtgagcagacgataagctactatgtaacacatcattttggataccacagggattttctgccggtcattgcgccggttctggtactctttgcagtattcttcgcgttcttgtacgcagtctgcatcaagaaactgaacttccagcaacgataagaacaagatatggcagcaaaagctcttgagagtttttttggaacattgccgtgtatatagggtattttgcacatcgcgttctcctttcattttttgagtccctttaatacattgtcgtgtatatagggtattctgcacatcgccaaatgtggtgaggtcttatacagatttctagccatttattgcaagagcaaaactatgatatttttccggatacacagaagagctacatattattatattaagaagagaggtctaacgtagacctgccacaagatataatcctctattggataagaggatataacact

SEQ ID NO: 253 - DNA, 4659 bp, Zea mays
atcaaatcttgtacttgcactggaaggttatcatcttcttcagctcataatcttacagacacatatatttcaatgacctgcaaaagctgtactggtgaatcaacagaagacagaggtgggccatcgtgtagcggcaagcttaacaatatgggtttggagctcccaaggcctatagatcttgaggttaaatggatgactgtaaaaaaaaggcaaagggacaccaggagagcaagggcttcctttggcgaagacacaagcagggatggaattggatctttctgtttatctggctgtgctacaaatcaagagatggcgcaagacgctccagtctctgaatctgagaagtttggagtatccattcttggtagacgctttagtgatcccatggaaaatgttcctataaaaaagagaagatttcatatggatttttctccatcacctccattcactccattgctagtggatccatatgaaaagataccgggaagctcttctaaagctgtcagatcatatgagaaacattataagcttaagacgcaacaaattgagtataaggtgggaaacaaaggtcgttttggtgacgatgatttttctggtattgatatactagcttctgctgcctgtgaaagtgagatgagtggtggaatattagatggggagtgctcaacgttagctcacctcccagaagaaaggaaactggagaatactactggtagcagcaaattgagtctattacataacatggaggatacgttaaatattcctggtacttcacattgcatatatgatatgcctcttgggtcttctagatctgctccagatatgaagtccttatttgttgccacaccaactatcttagaaaatcttgttgaatcggcatctgctcccaaggttaattgttcattatattctgcactgaacaatgcaaacgaaatagagattgtttctgatgctaagtctacaagtgttgcaattgcaaacagttcagacaatccagaaaaaactataggatgtttaaaggatacagttgtgcaaaccaaccatgccaatgcgactaatgccaagtctacaagtgttgcaattgcaaacagttcagacaatccagaaaaaactataggatgttcacaggatacagttgtgcaaaccaaccatgccaatgcgactcgtgattctaggctgcactgggatcttaatgttgccatggaggcatggggcactgattgcggtgctgttgaggatcctttagttgctactgtaagtgatcatgatgatgccagaaatgacatgaacaaaccagggacatctcatcattttgagtcaagagatggtagtgtagttgatcactctgttgacactcatatggatgatgcactgaaacacgtgtctgctaatacaaaggatacatgtgattctcctgctgacagtccgtctcacccttcgcgcaacttgcagctattggaatctggatatgtagggagtgatgcccttgctgaaacaatggatttgcctgaccagaagaatagcaggttcgcttcagctatggattcacatattagatctgatccagaaccagctcttatcatggagcattttgcttcagcttcacatgtggagaaaatcaatggttcgcatcccgaacctgttcaatgtgatggtttgtctaatatgtcttctgtgaatgtccatattggaagtaattcactccaaacaagtgaattgggcaccacattaaagcctttggctagcatattagtttctgaggaaagcaaaaaccttccaacagtaggcacttcccataaaaaggttactgactttggctggagtgataataagcttgaagaagcttctgaacaaagcatatctgaatctaagaaccaggagcttttggatgttgattcagaaactagtaagaagggtgaacatgacactggtatattttatgccaacgaaaggacaaaatatgcagaaaatctcattcatccagaggacaaccatggatcttctaattgtgatatggctcatgtacatgaagaaaatggtgctgttgcaatgattaattctaaagactctttaattacttgtgccaacagtagcactgtagagacatattacatttcagatgcagctcctcaggttcctgttcccagttcagaatgccacaaactggaatgttttactgatgcgggcagcactgtggattcaaaatctgcagcgcacagctaccagaatggttgcgaaaatgagcttgggaaggtcatatcaaatgttcgttcagatcaatgctatgaaactgacacatcacatattagcaaaaatctagctggggttgaaaaagtttatgtcgaggaggacgattctcaatatgaggatggggaacttagagaatctggtgattgttattgggtggatgatggttatgaagatgttaaacatgccaactggcattatcaggtatcagattacaagaatgaagaagctactcctggcctcacgtctctccatactgattctgttgcaaataatgtggttattcctgttgctaatgacaatggaccacaatctagaaaggaggacattgctgtttcacctgtgtcatctaagtgttcatggttaacaaactgcttagatggtggatctatagctgatggaaagtctcaaagtattcatttgagaggtgatactaacatgtatgggtcaaacccaagccgtgtagcagttagatctgctacaacagtaagccagtctgaaaggtgcaacgatgccctaggtgatatgttaaatatcagaatgaagaacacaggttgggatatgatgcctgaagatcaaaagcactctcaacatgatgcaagggatgtgactgattcgtctaatcggtgtgttttgagctcagatgcggctagagacgatgattcactgcaaaaaaagggactattgaatagagatcttcaaggagtggaacggcaaaaatcatttgacagaccccagaggaatgaattgagcagatctgacgatggttatggctcaggctcaaaatctggaagggcaatggactctcatggatcgcatgacatgtatggcacatcccgtcatgttcagacaagcgctcgggtggagtgggtggaaagttcaaaacgtcctcgttctactcggcacaaatcacctgaatattataattatggcacatcaggtccaaggaatgctgcagaagctgctgtggcaaagatgcagagcagtggctttgttgttgcacgtgatggcactttagtaagagctgttgatgctgcaaatgctggtcagatgcccagaaggatgcgaaatcctttaagtagctcatgccacctgatttctggatggggttccccagttgacagggatgaagcctgtgggatgtccagaggccccgtgcatgctaggaaagcatctccagagcgtcactttggtgcaaatagtaaccggtccagtcgatatggttctgaaatggagaaaaatcatactactgatgcaaatttgagttctgtccattgctcgctgtccagtagacaacgaggcaccccgacatctagagcatcacttaacctttcccgtgctcacagcagatctccttctgggtccaggtctcgatccccacatgattgggcacctaggaacagaggcaagatcatggcaaatggaggttcaactttatggaagcatagtagatctccacctaatcacatgactaaaggtgaaattggtagaatggcttcacctcggagacaacctggatatgatgatcgagctatgtgttacagtccactatcaagaaacaacacatactccaagaatgcttcgacatgggttgatggaaggaatggttcagcagtggatatttctgatgatcataataaaaggtattcaaggagaagctcacctctgagaattacctcacggaatgacagatttgatgtcatggactcccaaggacgaccaaggtctggagaattctaccgtccgacacaaggaagacttctttatggttacaatagggaaaataagcatggcagaaatggtgaagatggaagggaatgcactgatagatatgcgaataattctgtcaagcgatatgaccggagtggtgcagtaaagcaatttagaaatgatactggtgataaatttcggactcgtatttctgctcccagatcgccagatctccaaaggggggtgagtcctcggagatttgacagaagctttgagaggtagctgactagctggctgtgaatttgccttatagaactaaaatggaaaataaagacctgtctggatgattgagccaggaaatgttgcaaaaccttgatggagttcaatcataggggttgatggaggactcttggcagcactgtttttttttctgcttctgctgcatatattcaaggcacagaaatgttggaccatgcacttctgtacggggaattcagattaacttcataattttcctgtttcagtctgtaaatatttatgttggtagcagaattacaatcactcctttcagctttattatagctgttcttttttttaatttctgatactttatcatgtttgtcccttttgttttttcaatgggtattgtccctgtacgaggtccattttaacatgatgaatcaattaaattttgagctcaaa

SEQ ID NO: 254 - DNA, 2729 bp, Zea mays
caggtagcaaatattaatgccaaagaagagacaccagttggtcatggagaagtaatatgctttagcatctattcagcaaattctgatgtacaggcagctgattttggaaatggcaaaacttgcatttgggttgatgttctagatggtggaaggggtgtcctgatggagtttgctcctttctttgaagattcatcgatcaagaaggtttggcataactatagttttgatagccatgtcattgagaattatggaatcaaaattgctgggtttcatgctgatacaatgcatcttgcacgcctttgggattcatcaaggaaaattgatggtggatattcacttgaaggacttacaaatgaccgtagagtcatggatactgttccagaggatttacctaagcctggaaagacatcaatgaaaaccatctttggcaggaaaaatattagaaaagatggatctgaagggaaagttgtatctgttgagccagtcaagaagttacaaagggaagacagagagttatggatttgttattcttctctagattccatgagcacattgagactttatgacagcttaaaaagcaagcttacaacaaggagatggatcttggatggttgtcctaggggcaccatgtatgatttctatgaacagtactggcgtccttttggtgccctacttgtgaaaatggagacagagggaatgcttgttgaccgtggttacctttcagagatagaaaaggctgctattgctgaacggaaacttgctgcagataagtttcggaaatgggcatctaaatattgtcctgatgccaagtacatgaatgtgaatagcgatattcaaattcgccaacttctctttggtggcattgaaaatagacacaaatctggtgaaacttggccacatagtaaaacttttaaagtgctaaatgaagaaagtgttgctacagagggtaagaagacgtcaaagtatcgtacaatcaaactttgcagtattgttgaagatctgaaaatcgatatgttcaccccgagtggctggccaacagtcagcggggatgcattgagaagtttggctggtaaaatacctacagaatatatttacacaatagatgatattcaagatgatgatgaatataccagtggttcagaaaacccagatgggaattcctcttatggaacagcatatgaagcatttggtggaggaaagaatggaaaagaagcatgccatgcaattgcagctttatgtgaaatatgttctattgattctttgatatccaatttcattcttccgttgcagggagatcacatatcatgtgcagaggggcgcattcactgttcattgaatatcaatactgagacagggcgcttgtcagcaagaacaccaaatctacagaaccaacctgcccttgagaaggataggtataggattcgccaagcttttgttgcagccccgggaaattctcttatcgttccagattatggtcagctggagcttaggattttagctcaccttactaattgtaaaagcatgctgcatgctttcaaggcgggtggtgatttccattctaggacagccatgaatatgtatcagcatatccgtgatgctgtccaagaaaagaaagttcttcttgagtggcaccctcaacctggtcaagagaaacctccagtgccgctattgaaggatgcttttggcgctgagaggaggaaagctaaaatgcttaatttttccattgcttatggaaagacagctgttgggctatcccgggactggaaggtttctgttaaagaggcaagagatacactgaagctctggtacagggatagaaaagaagtgttagcttggcaaaaaagtcagaagaagcttgcaagcgagaagggtgaagtctacactttgcttgggcggtcgcgccattttccttacctgactcagtatggtcctggccaacgaggtcatattgagcgtgctgctataaatgcaccagtgcagggaagtgcagcagatgttgctatgtgtgccatgcttgagatcgaaaggaatgtccgccttaaggagcttggttggaggctcttattgcaggtgcatgatgaagtgatactggaagggccttcagagtctgctgaggtggccaaggctatagtggtggagtgtatgtccaaacctttctacggaaccaacatcttgaacgtcgacctggctgtcgacgccaagtgtgcaaagagctggtatgctgccaaatagactgaggagacgctgtcacctgccacaaggttgatgacaccagtgcaatcgagaccccactgttcggataaaaaatggtggacccgtcgtcatgcagactgcggttccaggaccttgagtttgttgtggtggtaacccaggccctgacaagacaacacgcccatttcttggctgcagcagaacagcggaagacacggaggactctgctgccagcacctggagttgcgcggtgccaaagcataccagacagaattcgagatggcttggatctcgagtgaactagcgcggtgccaaagcatgctgttttgttcataatctcacttgttcagcgtgctggtgcgttaggttagtttacagatttgttctggtgcagtgaggccaattatggtccctgcggttggtatcgatcttggattgtgcattgcatgtagtaccatactgcatctacactgggaccatttttcagataacagaaacattcagcttcatcctcgaaa

SEQ ID NO: 255 - DNA, 764 bp, Oryza sativa
cggaaggatgatgatgatgatgatgtcagcagcatcatcccccagctgcctcctcctcctcccccgcccgaccaaaccaacaccaccgctgctcccctccacctcctcctgccgccggccgcctcgctgccggatcagatcccttaggccggagaacccggcgccgcccgccgcaggagtagcgagagcggtcgcctcctcgtcgtctcccatggagatggaggcggcgcagacccaggcgtgcggtggcggggaggggcagcaggaggccatgaggctgctgttcgtggagatgggcgtcgggtacgaccagcacgggcaggacgtcaccgccgccgccgtgcgcgcctgcagggacgccatcacctccaactccatcccggccttccgcagcggatccattcctggggtgaacacggagcagatgaagctgcagatcaagctcggggtgccgaggccaacgcagcacttgctggacgttgagagagtcaaggccgtcttcccctatggtaaaattatcagctttgaggttgtggacggtgggatgatctgttcaagtggcgtatgcctagaagcaatgggagataaaaacgatgattgctatatagtgaacgcagcagtttatgttggttactaatattatctcgatgaatagttcctcttcgttggaacagtaaaaagacagaaaaatgttgtgcgcaataagcatgtcctgaattttctgaatcatcttttcttaatgtgtacaagtgcttatttgctcc

SEQ ID NO: 256 - DNA, 1596 bp, Sorghum bicolor
atggcagagcacggcaacagggctctggcgcggtggcggcggtgggtgctggccaacctgggctccttctccgccctcttcaccaacaccaacttcggctcggcgtggctcatccttgcgccggtggtgtcgctggtggccacctacgcgccgcggcggctgttcctgacctacttcaacctcttcctccggcgccgcgcgcggcgcctgctcaacgccgtcgacccctacgtgaccatcgacatctcggagcccggcggcgaggtccggtactcccggtacggccccgtctccgacagcgacaccacctacgaggaagtgaaggcgtacctgagcggcgccgcgtgctcgcaggacgcgcgcgagctccgcgccgagggcgcccgggagggcaacggcctcgtcgtcagcatgcgcgacggccaggacgtcgccgacgagttccgcggcgtctcgctctggtggtcctccgtcatcgtcagggacgtccagggccagcgcaagggcgacaggcggttccagcggctcaccttccacctccgccaccgcggggtcgtcgtcgacgagtacctgccccatgtccgccgccagggccgcgagatcctcttcagcaaccgacgccggcggctctacaccaacagcaagtcacgagatccctacagctacgagtacaagtcatggagctacatcgacttcgaccacccgacgacgttcgacacgctggccatggacggggccaagaagagggacatcatggacgacctcgacacgttccggaacagcagggacttctaccggcgcgccggcaagccgtggaagcgcgggtacctgctgtacgggccgccgggcacgggcaagtccaccatggtggccgccatggccaactacctcgactacgacatctacgacgtggagctgacggtggtgcacaccaacagcgacctccgcaggctgctcatcgagacgaccagcaagtccatcatcgtcatcgaggacatcgactgcaccctcgacgtcaccggcgaccgcgccagcagcagcaggccgcggcggcgagaggcggccgacgagaagccgccgccgccgccgccgcgcgacacggtgactctgtccggcctgctcaacttcatcgacgggctgtggtcggcgtgcggcggcgagcggatcgtcgtgttcaccaccaaccacgtcgagaagctggacccggcgctgatccggcgcggcaggatggacatgcacatcgagatgtcctactgcaggttcgaggcgttccagacgctcgccaagaactacctcgacgtcgacgaccacgagctgttcggcgccgtcgaggagttcctgcgggaggaggacctcacgccggccgacgtcgccgagtgcctcatggtggccaggcgcgcgggctccggcgagccttctcgctgccttgagatatcgatcgatgagctgaagaagagagcggcggagaaggccaaggccgaggcagaggccaaggcgagagcagaggcggaggccatggcgtgggcggcggaggcagaggccagggcggcggtggaagcaaatgcggcggccgcgagggaccgtgggaattcgcgg

SEQ ID NO: 257 - DNA, 3920 bp, Sorghum bicolor
tccacagctaccactattacacaccgcccccgcacatctcgatctcgccgtcgtctccccccggtggcatgctccgcttccgctagactagatccgatctatctatggatacccgccgtcgtctccccatcctcctcgccctcctgctcgccttcttctccgccgttgccgcctctgacgagatccacggttgcggcggcttcgtcgaggcgagctctggcttggccaaatcgaggaaggcgtcggattccaagctcgattactccgacatcacgctttggtgtttgctggacaccaattatgctgggggtgatttgaatgctcagactcaaaatccaattatgtataggacagatgaacttcgtgttagtttcatgtgtttggaggttgagctctgtactgttgatggtttggttaaagaaagcacacagtgtgctcctaatggctactattttatcccagtttatgataaggttcctgtcatcatcgatcacaatggctgcaatggaaatgcggatataaatttccaattcactgggtttatgatatccggtaaagtagtgggagctgttggtggtaagagctgctcaaaagggggaggacctgctggtgtgaaagttgagctgatgacagattctgatgagttgattgcatctgcttcaacatcatcatcaggagaatattcatttacaaacataattccagggcgttacagattacgtgcttctcatcctgattacaaaatcgagttgagaggctcaccagaggttgacttgcgatttggaaacgtcgtggcagatgatgtcttctttgtatctggatatgacatttatggcactgtggttgcacagggaaacccgatagtgggagtccacctatatttgtattcaaatgatgtaacggaggtcccttgtccacaaggtttcagtgatgcacccaaggaaggtgctctttgccatgcaatatctggtgctgatgggaagttcacgtttagatcactaccttgtggtagctatgagctgctgccatactacaagggggagaacaccgtctttgatatttcaccatcttcacttcctgtttctgttgagcacagtcatttgaccattccccaaaaattccaggttactggattttctgttggagggcgtgttattgatggttacggtgctggtgtggagagtgccaatgttatagttgatgggcagtcgagagccataacagatagtctcggatactacagacttgatcaggttacatccaagaagtatactataactgctgagaaggatcattataagttcaatcgtttggagaattttatgattttaccaaatttggccagtattgatgatatcagatcagttagatatgatgtatgtggtattgttcgaacagttactccgaattcaaaagcaatggttactttaacacatggaccagaaaatgtaaagccacagcggaagttagtgggtgaaaatggacagttttgctttgaggttcctgctggtgaatacgaattatctgcattacctgtagattccgaacgctcttctagtcttatgttttcaccaggatctattagcatcaatgtaaatagcccattgcttgatctcgaattctctcagtcacaagtcaatgttcatggcaaagtctcatgcaaagagcaatgcaaccagaacattcttgtctcgcttgttagattggctggcggtgttgagcaggaaaagaagacaactacattggagcaagataatgtcagttttgtgttcaagaaagtatttcctggaaaatatcgtgtagaggtgaagaattctttacccgagggctcagctaaggatgattggtgctgggaccaaagtaccttgaatatagatgttggtactgatgataaaggatctcaaaggatttgtgttgaaacttcagggcaacacgagattcatttaactaatccttgtatttcctttgggagctcgtctgttttgtttgatacagctaaatcaatgcctattcatatcagcgcaaagaagtatcttgtaaaaggtgaaatccatgtggacatgagctcccttcaggaaaacattgattccaaggatatggtcgtggatgtcttgaagagtgacgacagtttcatagaaaagatatccacttcacctgttattggaaaggataatcaaaatgactttactgcctttgagtactctatttgggctgaccttggggaggacttcatctttgtcccccatgattctagcactggaaggaacaaggtcctattttatccagcaagacagcagtattcagtgtctatgaatggatgccaagatactgttcctctaatcactgcaaaaactggtctataccttgaaggatcagtgctacctgcaacttctgatgttgacatcaagattgtagcagctggaaagagcaactatgcccatctgaacaaaggggatgtagcaacagagacaaagacagattctgaaggatcattttttgcggatggttaccatctcaagcaaactggtccatacaccttttcttgtcagaagcttggtcagatatcagtgcggatttatggtgaaaattcagagcttttaccttcagtattattatctttgagtggcgaggaagggtacagaaataactcaattagtagttctggtggaactttcacctttgacaacttatttcctggaagtttctatctccggccacttctaaaggaatataaattcaatccatcagcagtagctattgatcttaattctggagagtctagggaggctgaatttcgtgcaaccagagtggcttacagtgccatgggttctgtaacactattaactggccacccaaaggagggtgtttttgttgaagcaagatctgaatccacaggtttttatgaggaagctaccacagatgcttttggtaggtttcgtcttagaggacttgtgcctggatcaacttactctataagagtggttgcaaaagataatcttcggtttgcagcagttgagcgtgcttcacccgaatatttgtcggttaatgttggtcgtgaagacataactggtattgattttgtggtttttgaacacccagaagtaacaatcttgagtggtcatgtggaaggagacggcattgatacgttacagccgcatctctctgttgagatcagatcagcagcagacccttctagagtagaatctgtacttcctgttcctctttcgtactattttgaagtgcgagatttgcccaagggcaagcatcttgttcagcttcgatctggccttccatcacatacacataggtttgaatcagagttagttgaagtagatctggaaaaggaaccccaaatccatgttggccccctcaaatataaaactgaagagcgtcatcaaaagcaggaactgaccccagcaccagtttttccgcttattgttggagtttctgtggttgcactggtgatcagtatgccaaggttaaatgacttgtaccagagcgctgtagggatgacttctctgggttcggggatggcaccaatcaaaaaggagccgcgcaagaacataattagaaagagagtgtaaacggcagattagcttagccttaggggtcgagaaatgagcactgacaaattgagcatgtcaagagtggaaatagctgctggtttaccctttttttccgaaaacgtgcgctgcacgtgcctcattaagaagagagttaaaagttacctccctcgttccaaatggtgaggtaccattggcacggcgggcgacacgagttacaataggcgccggctactacggcggagcgttgttggttgtactttctaggcgaaaagctgcacgttgctggtttaccctcgtgtaattttgccaacgaaaaggaatctgacagttttgataccatgctggcttcaagtg

SEQ ID NO: 258 - DNA, 3407 bp, Sorghum bicolor
ccagcccactctgagtctggtcgcgaatctcagcggtcccgacaggaatccaacggcgttgggcgacggcagccctacgcgcggcttcgcggagtgccggagtcgcgaggcggctcggctctacaccctctcgcgctcgctctcggcctcgcctcttccctcacacgactcgccgcgaggagtttcccccttcctccgcgcgcatccccgcgagagctcgctcgaaaacctagccgccaaatccatggctcgacgcggccacgacgacgacgacgagatcgaggaggaggaggacgaggaggaggcctacgacctggacgaggaggaagaggaggacgaggaagacgactacgaggaggaggcgaggcgcgggaaggcctcccgcagcggcggcgccggcggcggcaaggggggcggcggtgggcggaagcggtcgcgcgaagacaactttattgacgactcggccatcgaggacgacgacgaggaggatgacgacgacgacggcgggggccggccgaggaagaaaggcggcggcggggtgcgagggttcttcgacgaggaggctcaggtcgacgaggatgaggaagaagaggacgagggcgagggcgaggacgattttattaatgatgctggggccgaccttcctgatgaggatgttgttaggggctcaagacgtcattctattcctatgagggatgaagaagaggacattgatgagattgagagacaagtgcgggagagatacgcaagatccactcatattgagtatggtgaggaagcagcagaagtggaacagcaagctctgctgccctccgtgaaggatcctaaactatggatggtcaaatgtgcgattggacatgagagagagactgcaatttgtctgatgcaaaagtacatagataggggagaccttcagataaagtcagtcgtggcattggatcatctaaaaaattatatttatgttgaagctgaaaaggaggcccatgtcaaagaggcttgcaaaggtctacgaaacatttatgcttcagcaaaaataacattagtgccgataaaagaaatggcagatgtcctctctgttgagagcaaatctgtcgatctttcaagggattcttgggtccgaatgaaattgggcatatataaaggtgaccttgctaaggttgttgatgttgacaatgtacgtcaaagagtagatgtgaagctgatccctagaatagatctacaagctttggctagtaaactgatgcatattcgtgtggaacggaggcgagataaagaatctggggagtactttgagtgggttgataatttgaagttcaaagatggtttcttgtacaaatcagtctccactaaatcaatccacacaaataatattcaaccgactttcgatgagcttgagaagtttaagaagcctggtgaagacatgaatggcgacatggctagcttgtccactctgtttgcaaacaggaaaaaagggcattttatgaagggtgatgctgtcattgttgttaaaggcgatttgaaaaatctggaggggtgggttgagaaagtagaggatgaaaccgttcacatcagaccaaaaatatctgatcttccgaaaacattagccttcaatgaaaaggagctttgcaaatatttcaagcctggtgaccatgtcaaggtgatctccggtgttcaagaaggtgctactggcatggttgttaaagtggaagggcatgtcttgataattttgtctgacacaactaaagaacatatccgtgtgtttgctgatcatgtcgtcgaaagctctgaaattaccacaggaatcaccagaattggtgattatgaactgcatgatcttgtccttttagacaacttgtcatttggagtaattataagggtggaagctgaagcatttcaggttctgaaaggagtgccagatagacctgaagttgtgctcgtgaaattaagagaaataaaaagcaaaattgataggcgctcatcagctaaagatcgttctaataatattatctctgcaaaggatgtcgtaagggttattgaaggagcatgcaaggggaagcaaggacctgtggaacacatacacaaggggatactgtttatctatgacaggcatcaccttgaacatgcaggctttatttgtgcaaaagcgcaatcttgccttcttgttggtggatctgctggtggccgtcgaggaaatggtatggacacagctgatgcacggcttggtgctttgagatcttcagcaagcattctgcaatctccaggaaggctgcccccaagaggacctaatatgaattatggtggaaggtttggaggcggccgtggtggtagaggacatgatgccttggtgggtaaatgtatcaaaattaaatctggcccttataagggataccgtggccgtgttaaagaggtgactggtgcactcgtacgtgtagagcttgattcattgatgaagattgtcacagttaaaagagatgatattgctgacacacctactgttgcaacaccattccgtgagcctcgttattcattgggcggtgaaacaccaatgcacccgtctcgaacaccacatcatgcttatcagactccaatgcgtgaccctggagcaacaccaatacatgacgggatgcggactcccatgcgcagtcgagcctgggctcctatgagccctccgagggataattgggaagatggaaatcctgctacttggggtagcagtccagcttaccagccaggaaccccacaagctcggccatatgaagcccccacacctggatcagggtgggcaaacactccaggagttagtttcaatgatgcccctactcccagggataactatgcaaatgccccaagtccatatgtgccttccacgcctgttggtcaaccaatgacaccaaactcggctgcatatcttccgggcacacctggtggtcaaccaatgacccctggcactgttggactggatgcaatgtccccgatactaggtggtgagggtgatggtacatggttgttgccggatgttatggtcaatgtattgaggggaggtgatgatggtcctggtgtggttagggaagtactcggggatggatcttgccgagttgcacttgggtcgtcgggcaacggtgacatggtgacagtccttccaaacgaggtcgaggtcatcaggccaaagaagagtgacaagatcaagatattgaatggtaatttccgtggatacacaggaaaactcataggtatagatggttctgacggaatagtgaggcttgacgacacatacgaagttaagatattagatatggtgattttggccaaactggcgacttgaaatggatatatatattctgtaacgtgtccatcatagaacataattgtaacaatgccctcgtttgcaataaagctttttgttgctt

SEQ ID NO: 259 - DNA, 3104 bp, Sorghum bicolor
tcaaatccagaccctagcgaaccagactacttattttgacgtgttgaatcgacacagcaatccacattgaccgacgacgacgtttgtggtctggggcagttgagtatccccaagagagatgggcatttttgtcatcttgctctggggaagggaagacatttacggcttcttgaaatgaaaaatctgccacagactttggttgtctcgtggagtcaggacgcccagtacctcagcggctcaaccagcgacgagtcatcgactcctccgtcttgctcgcggcgaaggtatatatttatattatcacaaggaattcagacatggcagatgccctatttgtagttcttaggaaacttgctgattccctaggagaacgggcactagagaggattggcacagagctggttcaagcagcaccagtttcgacagattatgagcatagcatgaagcaaatcgaggccgagctattgattctgcaggcttttattgctcaggctggggcaaaggtcggtgataaggcattcgatgcctggctggaccaagtgagagatgttgcccatgaggtagaagataccattgatgagtatgcttaccttgcggttcaagccgtggatactggcagcttctttaagaggaagttccgtcagataaaaaagtttgcagcatggcagaagtttcatagccagatcagtcaagtagaagctcgaattcagaggctaggcgaaattaggaatcgatatggcatcttggcaggtgaaatagacaggagtaacaaattgaggaaacccaatcagctctttatgtcagattcttcttacttaactgatagctctgaaatagtggggtatgttgatgaaattggaagattgacacaatggttacttgaggacaaacaagagcgaactctcattgccatctttggtatgggaggtctaggaaaaactactattgcaagcagtgtgtacaagaatcagaatatcacaagaactttcaactgtcacgcatgggttactgtatctcagacttatcaagttgaagaactactaagagaaatcataaatcagctaattgatcagagagcaagcatggcaagtggtttcatgaccatgaaccacatgaggctagttgaggtaatacaaagctatttgctagacaaaaaatatttaattgtcttggatgatgtatgggataaagatgcatggttatttctaaaccatgcgtttgtcagaaacaactgtggaagcaaagtgctgataactactcggagaaaggatgtatcttgtttggcagtagatcactataggattgaacttaaaactcttcaatatgctgaatcctgggagcttttctgtaaaaaggcatttgttgcattaaaagatagccaatgtcctgaaaaccttaggttttttgcagagaaaattgttgccaggtgtcagggattgccactggctattgtaaccattggaagtactctatcatatcgtgaattcgaggagcaggggtgggaatctttctacagccaacttagctggcaattagctaacaatccagaactgaattggatttctaatgttctgaatatgagcttgaatgatctcccatgttatctgaggagctgcttcctgtactgcagtctctatcctgaagattacaaaattagaagaaacgtgatttccaagctttggattgcagaaggttttgtggaagatagagacgatggaacaacaatggaggaggttgccaattattaccttgtggagctcactcagcgttgtcttcttcgagtcacagaaagtaatgcatgtggaaggcctagaacatttgttatgcatgatcttgtgcgagaagcaacctctgttattgctaaaagggagaagtttggtattgcatatggcgatgctagtacaacccaagttccccatgaagtccgccacttatgcatacaaagaggtgcccagaccttgaattttatagctagttcacggctccgctcatttattttgtttgacactgaagtaccatgctcttggatagatgatattttatcacgtttcagactactgagggtcctatgtctaagatttgcaaatattgaacaagtgcctggcgtggtcaccgaattgtataacttgcgctatattgatttttcatacacaaaagtgaagataataccagcatcatttggtaaacttgttaacctacaagttttggatctcagattcacatacgtggaggagttgccactggaaataactatgttaactaatttacgatatttacaggtgttcgtagtgcatgatcttctacaaagatcattggattgctttagtgctacaaaaattcctggtaacatttgccttctgaagaatctgcaagctttacatactgtttcagccagtaaagatttagtttcacaactgggtaacttgatgctgttgagaagtttggctataatgaaagtgcgtcaaagctacattgcagagttatggagctccctgacgaagatgcctaactttagcaggttgcttattttcgcaattgatatggatgagattcttgacttgaaaatgctcaagcccttacccaatctgaagtttctctggcttgctggaaagttggatgcaggtgttcttccatcaatgttttccaagtttgagaaattagcatggttaaaggtggactggtctggtcttaagaaggatcctattatctccttttctaacatgttaaacctagttgatttgaggctctatggggcatatgatggggaacaactgaccttttgtgcagggtggttccctaagcttattcgtctggaattaggtgacatggaacatctggattggattgagatagaggacgggacaatgataggtctacatgatctagaacttgttggtctagggaatgtaatggcagtacctgcgggcatccagtaccttaggacactccaccaaatgtttctgacagatatgtcgaagggattcatacaaagactccaaggaagtgacaattacattgtccaacatatacctaacattcatattttttactcctctgattctcaagcaggtaattttcatgttctttgccagttacttgatgaa

SEQ ID NO: 260 - DNA, 2690 bp, Glycine max
agaacacaacacaaaaataatacaaataatttctctgaaatttctctctgcactcaaattcgtggccttactttttccatttacactcactcacgcacgagcttcaaaaccaaaaccaaactctgttctaacctccaaacttttatgccattcatgactcataacatcatagaaaaagaagaactactcacgaaccgcgaccaccaccgacaataaaaggacaacaacgtcagtgtttaaaagcatgaaaatgctgccacctcccaccgccggaggtgcctcccacagcggcgccggtgaccgcaccgtggtggtgggcatgaagatggactctcacagcaccgagttgctcacttgggctctgttcaaagtggctcagcccggtgatgttgtgcttgctcttcatgttcttgggaatgatgaaattgtgaatcgagaagggaaatcctcgttgttttcacttgtcaaagcatttgactctattcttgccgtttatgaaggattctgcaatttgaaacaggtggatcttaagttcaaaatatgccggggttcatcagtgaggagaattttggttcgagaagcgaatgcttattctgcaacacacatcatagttggaagttctcaaggtcttcatataattcggccatgtatatctgtggcaaggtactgtgctaagaagttaccaaaggattgttgggttcttgctgttgataatgggaaaatcgtgttcaagagagaaggaaaaaacaatcttttaatatttattttagcttcatcgttggaccaaccctatattgcaggacttgaccaggatcacaaaactcggttgctcggttcgattcataggacaatcagcaaggaattcgttgagaagaagaggtgctctatttgtgcttcagaagaagagtcttgtggtgatgcttctgatgagaataaccctttggcaatagtgcctgtgcagaccaacgatgctgcttctaaaccaggttggccgctgcttcgtaagacaattgcatctgacaagaaatgttccgaaaaatcactgttgcgccagatctcggtggtacaatgggcaatgcagctaccctctagagatctttcatatgctgcacatcaagaccataaagcaaacaatttggatgccgaaataggaactgcttcttcgcctgaacgcaattcgagaagcattcctaaggaattggagggccttcatgagaaatattcttccacttgcagattgtttgagtaccaagaacttgtattggcaacatcaaatttcttgccagaaaatttgattgggaaaggaggaagtagtcaggtttatagaggttgccttcctgatggcaaggaacttgctgttaagatcttaaagccatctgatgatgttttgaaggagtttgttctagaaatagaaattatcactaccttaaatcacaaaaacattatttccctccttggattctgctttgaagatggcaatcttcttttggtctatgatttcttatcaagaggaagccttgaagagaatctccatggtaataagaaaaatccacttgtgtttggttggactgagagatacaaggtggcaatgggtgttgctgaggctttggagtatctgcataataatgaaggccaatctgtgatccatcgcgatgtaaaatcatcaaatgtgttgctatctgaggattttgaaccccagctctctgactttggacttgctaaatgggcatcaacctcatcatcacatataatttgcacagatgttgctggaacctttggttacatggctcctgaatacttcatgtatggcaaagtaaatgacaagattgatgtctatgcatttggtgtagtgcttcttgagcttctttcagggagaaagcccataagtggtgattatcccaaaggtcaagagagccttgtcatgtgggcaagtccaattctaaatagtggaaaggtgttacaaatgttagatccaagtttgggtgagaactatgatcatgaagagatggaaaggatggtcttggcagctacactttgtatcagacgtgctccaagggctaggcctctaatgagccttatctctaagctccttggaggtgatcctgatgtgatcaagtgggcaagactagaagctaatgctttggaagcaccagaaatgcttgatggtgaagcttgtccaccttccaatttgcagtcacatctcaaccttgcattgcttgatgtggaggacgactcgctctccatgtgcagcgttgagcaaaacgtctcgttggaggactacttgagaggccggtggagtcgctcatcaagctttgattaagcaaactactagcaaattgctagaagaataagaaggattgtgttttttgaaatctaaatccttttgtagataattttgccgtgttgcatgtgctgtgaatgtttttatagatgggtttaggatgagaggttgtttgtgtgtgccctcctccttcccttgattgtcaaggaaactatgccttgtaatttgtaaggctagatatcctttgtcgttttactttaattacttggtgctagtttcaatccttaatctcaatttgattgagtgtaatatgttctggtgcgaagaataaaagatgaaaaagttgtatcttaaaactacataatgagtactgttctcatgcattttaatcaagttaatggcaatttct

SEQ ID NO: 261 - DNA, 5963 bp, Glycine max
tcctatgaactgagatgatggggttttactttccatggcgatggccaatgatggcctatgccttttggtctggaacttagtctgaacaatttcatttggatatggttctcaccagcatcatagatcggatggaatgttaacaaggctggtcaatgagggactcataatgagagggcttgggtggaatcacagtccatgggcaccccggacaagaaaatatctgactttgttgatgtagttaggtcttggatccctcgaagggcggaaccactaaatgtgtcgagggacttctggatgccggatcagagttgtagggtatgctatgagtgtgattcacagttcacaatattcaaccgcaggcatcactgtcgaatctgtggtcgagttttctgtgcaaaatgcactgccaattctgttcctgttccatcggatgaggcaaatactggccgcgaagattgggagaggataagggtctgtaactattgttttaaacaatgggagcaagtaacaacagttgataataatggcagtgcagatccttcggctaccccttgtctcagcccttcaccatctacaacaagcttggtcagcactaagtccagttgcacctgtcatagtagcagcagcactgctggttcagttccttatacaactgggccttatcagcgtgtgccgtatagtccccatcaatcttcgcaaatgaatcagataacagatgatcaagaaaatttaaattctgggaggagtacaaatccctcagaggctgtagggaatgtgccttctaaccaatttggccattgcttcagcaggagtgatgatgaggatgatgattatggtgtttatcattctgatacagaatcaaggcattattcccatgcccatgactacgacgatccagttaacattcatggtgttgaccatgtctatgggccacatcaaatgcatcctgatgaagataacattcaggaaaaaaacttgagttgcctaacccaggcacagaatcttgatccagaaggtgtaggtggaattcaagtacctgggaaagaagacgatgagcatgatcatgctgatggatgtgaaacttctccttatcatgaggagagcaattatgcggagcctgtggattttgagagtaatggactactgtggatacctcctgagccagaagatgaagaggatgatagagaagctgttctttatgatgatgacgaagatgaaggtactactggaggtggggaatggggatatctacgatcctccactagttttggctctggagaatgtcgtagcagagataaaacaagtgaagatcataggaaggccatgaagactgtagtggaaaggcattttagagccctggtagctcagctattacaagtggaaaacctaaatacttgtgatgaagatggaaaagagagttggttggatataattactgctttgtcttgggaagctgctacacttctgaagccagatacgagcagaggtggaggtatggatcctggtgggtatgtaaaggttaaatgcatagcttgtggacatcaaaatgaaagcatggtggttaaaggagttgtatgtaaaaagaatgtggctcatcggcgaatgacagcaaaaattgataaaccacgttttctaatacttggaggtgctttggagtatcagcgtgtttctaaccagttgtcaagtgttgatactttgttacagcaggagatggaccatttgaaaatggcagtagcaaggattgatgctcatcaccccaatgttcttttggtggagaagtcagtatctcgttatgctcaagaataccttcttgctaaagacatatcgcttgttctgaatattaagaagccacttctagagcgtattgcccgttgtactggtgcacagattgtcccttcaattgatcatctgacctcacagaagctgggctattgcgaaacattccacgtagacaaattttttgaggagcatggtagtgctgggcaaggtgggaaaaaatcaacaaagactttgatgttctttgagggttgcccgaaacctttaggttgcactatcttgctgaagggtgccaatggggatgagttgaagaaggtgaaacatgtgatccaatatggaatctttgcagcctatcatctggcactggagacatcttttctggctgatgaaggtgcttcacctctagagtttcccttgaaatctcccataactgttgcattacctgataaaccatctagtattgtgagatccatttccactatccctggattttctgttctcactgctagagagtctcagggagcaaaagcttttaaagaagaaccacaatctaatgacatctacaagacagaaagaagcccatctagctgctgtgagtccactgaaagatcattggtgggtgactcaatccatatgcatgaagtgtctggaggtattacccaatcagctcaggatatgccatcttccaactgcaatagtttcctttcaaatacttcttctaaggaggatgataagaaatgtcccatggaattttttcaatacagactagatgagagaagggaaactatgttgaacaatgatcttatttcagattcttttggtacttttgagtcttcacagcaagatggaaatagccacctcagagctgcagcattgtctgcttatcaaggagctaaccctgagccaccttatataaaacatgatactaataattataataacaataataatcatgatgacatgatacattcaaaagaagattttcctccctcaacttctgaccatcagagtattttggtctttttatcaacacgtgtgtggaaaggaactgtttgtgaaaggtcccatcttgtaagaattaaatactatggaagttctgataagcctttgggacggtttttgagagatcaactacttgatccgagttacacttgctgctcatgtgagttgccatcagaagctcatgttcattgttatactcatcagcaaggcagcctgacaatttccgttaagaaatcggagtttgctttaccaggggaacgagaaggtaaaatttggatgtggcacaggtgcctgaaatgtcctcgcatacatggttttcctcgtgctacacgaagagtagttatgtctgatgctgcctggggcttatcctttgggaaatttttggagctgagtttttcaaatcatgcagcagcaagcagggttgcaagttgtggtcattctctccacagagattgtttaagattctatggttttgggaagatggttgcctgctttcgttatgcttcaattcaccttcattctgtttatcttcccccacccaaactggaattcaactatgatagtcaggactggctacaaaaagaagcaaatgagagaaggtttcaggtcctgtgttgcaggagggtggaaatagggtgtcagattttaggaatctagttgctgaacttaaagggatgctgctgtatgagaaagaagaatttgaggactcattacaaagattgctgcataaagagggcaaagttggtcagcctgtgattgatattctagagctcaataagttgtgcaggcatatccatatccattcttatgtttgggaccagcgcttgatatatgcatccaatctaagtaaaattattcttcaagaaaacttgaagagcttaaatcatagagagaagttgcttggttctagggaaaaggttatcgaagcagatgttgccactaggccagcaagaggccatagcagttgtgattcctttcttttgggaacaaaacctgatggaaacctaaatttagaaaacactagccaccttagccaccctgtggtcaaaagtgaggacaagggcaaagacacaaatcatgataaggttgatctttctctttctggtggtgccaatatcaatgataaatctgattctgtggagtttggaggggctgtacggagggctttgtccgagggggaatctccttttgtggctaatttatctgatacccttgatgctgcatggacaggtgaaggtcatccgacaaatttatcactcaaagaaaatggttgtctacctcctgatgcagcagctgtggctgttcattcacctgtggcaaatatagttacatcaaaatcaaattctgatatttatagtgctaatataggtgggattgaggcaggatgcactaattactctaaattgctttccaaaggacttgatactaaatggaaaggaataccttttgcaaatgtctttggttcattcaacaaaacttcttccttcaatactgagaagcttgttgagtacaacccagttcacattttatcatttcgagagctggagcgccagacaggtgctagattgcttcttccagccagcactaatgataccatagtgcctgtctacgatgatgaacccactagtgttatagcgtatgtgcttgtgtcaatggattatcatatgcagatgttagaatatgatagacctaaagagagtggagacagttcaatttcattgccactctttgattcaacaagtctactttctctcaactcttttgatgagacaattactaatacctacagaagtcttggctcttttgatgagaatgtgttacccacttctgggtctcggagtttgccggctggggatccattctcatacacaaaggatttgcatgcaagggtttcttttactgatgatggctcccttggaaaagtgaaatatactgtaacttgctactatgcaaaaagatttgaggctttaagaagaacttgttgcccttctgagttagattttgtgcggtcccttagtcgttgtaagaagtggggagctcagggaggaaagagcaatgttttctttgcaaaaaccctggacgatagatttatcatcaaacaggttacaaaaacagagcttgagtcgtttactaagtttgcaccagcttattttaagtatttatctgagtcaatcagtacaggaagtccaacttgtcttgcgaagatcttggggatttatcaggtaacatcaaagcacctcaaaggagggaaggaaacaaagatggatgttttggttatggaaaatcttctttacaggcgtaacattagacggctttatgatctcaaaggttcttctcgttcacggtacaatccagatacaagtgggagcaataaagtgctgctggatcagaatctcattgaagctatgccaacctctccaatatttgttgggaacaaggcaaaacggttgctcgagagggctgtgtggaatgatactgccttccttgcatcaatatatgtgatggactactcattgctggttggcgtggatgaggaaaagcatgagttggttttaggtatcattgattttatgaggcagtatacatgggacaaacaccttgaaacttgggtgaagacctcaggcatccttggtggacccaagaacacttctccaactgtgatatcaccacagcagtacaagaaacggtttaggaaagccatgagcttatattttcttatggtgccagatcaatggtcccctccagagttacaccccagtgggtcccaatctgacatttgtgacgaaaatgcgtgaggcatgggactcatttcattgatgtggtcaaagtttgaatcttgtaaatgttaccattccagcatacatcattgacacgggtctctccttccttatgcccttaatatttgtctcctgcataatgcagctgctgttgatttgtgtcccttaagcaatggaggtgcacctcctgttaccagagattgttgaaagggtaactaagtgtacagcgattctcctcctctttcttttttatacatttttttatatcatgtatttaatctcttgctttcataatctgtcgtaaatttgatttaaagttcacaacctattattgaattgcacaccgcgtttctttttctacgcatgtgaaaggcgttgataaattcttacctcactgttatatgaccc

SEQ ID NO: 262 - DNA, 1257 bp, Glycine max
ggtgtttgctttagaaggggagagtttggtctacacacaccaccacatgaagagcatggtgacgccattgacgagggtcttaccctttcgtcacccaaatggccataatacccttccattttctcttacacgctacccttcttcaccaaacttctccttctcccctctcactctcactctttccatggctgcttcaccccaatcctccgctccaactgtgtcgcctggtgatgttaacatcgacaaagatggtgtatttcaattgattcaagctcatcaggaaaaagctgctagacttccaccagttgaggagattcgaactgtccttgatcgtagcgtgcgcgggatgctctctacattctcaaagaagtttgatggttatccatcagggtctatggttgactttgcatgtgattcaaatggatatcctatattagcagtgagcgacttggcagttcattcaaaggacctaactgccaatcctaaatgttcattgcttgtggctagagatcctgaagataggactgatttagtgattactgtacatggtgatgctatctctgttcctgaaaatgaaagagaagccgttcgagctgcatatttggcgaggcatcccaatgcattttgggttgactttggagacttccaattcttgcgcattgaaccgaaagttgtacgatttgtgtcaggtgttgccacagctttgttaggatcaggagagtttagtggagatgagtataaatctgcaaaagttgatcccatagctcagttttccaagccagtggcgtctcatatgaacaaagatcatgctgaagataacaaagtgattgtgcagcattggacctcagttccagtggactttgccttcatactagatttggatagtcttggtttcaatgttaaggctggttatcagggtgatactttcaagcttcgtgtacctttccctcgatgtgcagaagatagaaaggatgtgaagactctcattgttgagatgcttcaagctgctaggcctaaagttgattgatcacttcacagatcaatgatgaacaggtgctcctagaatcttcatataatccatcaattcaattcatgtgtttcagcctccaagatttgtcattttttcttcattctgagattagttggctatgccttgcaactagatattcatataccacataattattaacactatttatgccaaataaatacttgcatacgtattggtaacatttttgtctgctacttttaaaccaa

SEQ ID NO: 263 - DNA, 718 bp, Solanum lycopersicum
aattttttctagtacaaagatgtctggggaagaagaagaaaacgccgctgagctcaaaattggcgatgagtttttgaaggccaaatgtctaatgaactgtgaagtcgcattgattcttgaacacaagtatgagcagatccagcagatgtctgatgatccaacaaatcagatttcgcaggtatttgaaaagtcgctgcaatatgtgaagcgtttcagtcggtacaagaaccctgatgctgttagacaagctcgagaaattcttagtaggtatccacttgctgaattcgagctctgtgttcttgggaatctttgccccgaaactgttgaggaaggtattgccatggtcccatccatcaagaatagaggacgtgcacttgacgaggaagcaattgagaaaatgctaactgacctttccctaataaagaaattcgagtagtcctattatagtgcttgtcttgctatgctgcagcagtctctgcttccgaacctgtacctccatatgtttattagtagcagctctgtaatgctaattgggctctggcattatgttgaaaactttatctgttgattgaagaagaaaactctctctggacccttttttttctttttggtagctggttgtaaccacaatcctttggtgcacgggctaaatcattgtaatgacatacatggtttgtcgtttcgcttttgtgaaagacaaataagagcataccttgat

SEQ ID NO: 264 - DNA, 3677 bp, Hordeum vulgare
catcgcaaagttcatcagaccctcgctcgccagctctggtcgagcaagggcgagaaaaataacactactactctatccactccagactctagagagagagaaaaaagaaagaacataaaagccgcggctcgccgggcctccattccgttaattatagtcgtcgtcgtcgtagatcccccatcccggagcaccccggcccttccgatcctcaagagccaccgccgcacgccgcccgaggatcaatcccgcctcctgccaccgcctctatactctctccgcccgcccccgcgttcgtctttggcaatccggagtttccaccactctctttcttgctgcttcttaatgctggtccaggggatggtcggcggcggcgttttctgttgtccggtggcggcgatccgtcgacgtagcgggaggaggagcacctgaggatggcgtcgctgccgccgtgttccctttgaccgaaaggtgccgctcctttccggaaagggggaatttgtttctgcgtttctggcgacttcctttgcgccgattccattcctcgcgtcgctaaatctcgccgggatttcttcccttcctccttggactcccggtcgcagatccttttcctccctgcccgcttgcccattcttgctatctgcttgttcggtcgctctgcaattgtctgcaaccttgggttcgaacttgttgctgctgaggggctgtgagtttgctggtggagggtggtgaggaggatcgcatctgggagaggatcttggtggtttggtggcggacgggatggcctcgagatcctactccaacctcatggagctcgccgccggcggtgaccgcgagcagccgacgctgccgtcgctcgggcagcgacgggtgccgcgggtggtgacggcgtctggcattgtgcccggcctccactgcttcgacgacgacgctggcaccgcctcggtggcctccgaccagccaaaccaggcgccgcgggagcgcaccatcatcgtggccaatcaacttcccatccgcgccacccgcggcgccgacggcgcctgggagttctcgtgggacgaggacagcctcctgcggcagctcaaggagagcatgcgcgggcaccagggccgcgtcgacatggacttcgtctacatcggcagcctgcgcgacgacatcccggcggaggagcaggagaaggtcgcggccgagctctacgatcgcttccgctgcgtgcccgcgttcctggccgccgacctccgctcccgcttctaccacggcttctgcaagcagcagctgtggccactgttccattacatgctgccactgtcgcccgagctcggcggccgctttgaccgcacgctgtggcaggcctacgtgtccgtcaacaagatcttcgccgacaagatcctggaggtgatcaaccccgaggaggacttcgtgtgggtgcacgactaccatctcatggtcctgcccaccttcctgcgcaagcgcttcaaccgggtcaggctgggcttcttcctgcacagccccttcccatcatcggagatctacaagactctgccggtccgcgaggagctgctccgggcgctgctgaatgccgatctgattgggttccacacatttgattatgccagacatttcctatcatgctgcagcaggatgcttgggctcaagtacgagtcgcagaggggatacattgcactggactattacggacgaactgtcaccatcaagatactgcctgtggggatacatttagtgcagctgcagtcggtgctcaacctcccggagactgggctcaaggtcgccgagcttatgaagcagttctgtggtcggggccgcatcttgatgcttggcgtggacgacatggacatcttcaaaggtatcagtctgaagcttttggcatttgagcagctgttggtgcagcatccagagtggcgagggaagctggtgctggtgcagattgccaatccggcgagggggcggggaaaggatgtgaaggatgtacaggatgagagctatgcgatggtgaggcgcatcaatgaggcatttgggcagccagattaccagccagttatactgatcgacaggccactgcacttctatgagagaatggcatactatgttgtcgctgagtgctgtttggtgaccgcagtgagggatggcatgaatcttataccctatgagtacatcattgctaggcaagggaatgacaagattgacaggatcctgggtctcagcccttccacaaagaagaaaagcatgcttgtcgtgtcggagttcattggctgctcaccctccctgagtggcgcgattcgggtgaacccttggaacattgattcagtgactgaggcaatggagaaggccttgtccatatctgactgtgagaaggtgctgaggcacgagaagcatcacaaatttgtgagcacacatgatgtcggatactgggcaaacagcttcctgcaggatctgttgaggagttgccaagaccataacaagaggcgctgttggggcataggatttgggctaaggttcagggttgtggcccttgatacgagcttcaagaagctcgcggctgagcagcttgtctcagcctaccggaaggcaaccacgcgtgccattctcttggactatgatggtacgctgatgcctcagacatcgttcggtaagaatccgggctccaaaacgatagacatgttgaacagcctttgtcgcgatgagaagaacatggtcttaatcgcaagcacaaagacccgggcgaccttaagtgaatggttctcaccatgcgaggacctaggccttgctgctgagcatggctacttcctcaggctgaaaagagatgcagaatgggagacatgcggcattgcaacagactgcagctggaagcagatcgcggagcctgtgatgaaaacctacaccgagacaacggacgggtcagtcatcgaggacaaggagacagcaatcgtctggtgctacaaggacgccgaccctgattttggatcttgccaagccaaggagctccatgaacacctggagagtgtcctttccaacgagccggtatcggtcaaagctgacgtgaaccatgttgaggtgaagccacagggcgtgagcaagggcctggtggcgaagcggatgctgtcggcgatgcaggcgcgagggctcctgcccgacttcatcctgtgcatcggggacgaccgctccgacgaggacatgttcgaggtgatcaccaccgccgtggacggcccctacctgaaccctgaggcaaaggtcttcgcctgcaccgtcggccgcaagcccagcaaggccaagtactacctggacgacaccgcggacatcgtgcggctgatccaggccctcgccaacgtctccgacgaggtgcagggcggccctccttcctatttcttcgcctgcgccggcaccagcaccgacgacagggcgctgaattgagggggaaagccggcaaagaagaccagcaccagcacagccccggcctgaataagaccgcgcttcaggaaataccctaggactaatggaccgtgccgtcggctcgcataatcgtgtgctgtgctttagtattagtagtagtagtggtcggtcgtcgttgtcgtggtggtgttgttgtttcgccgttgtgtacatagactccgttgaacttggtttaattgccgactaaatttgcagccaccagctaaattagc

SEQ ID NO: 265 - DNA, 3984 bp, Oryza sativa
aaccagattacaatgtaaaatactcgaggtttctgtttgttaattacttaccgtgacagtgagcttacgggagtgacaggcactacttgcgcgaaaacagaaaggtggagtaaaaataattcgagtaattcagagagaagggaaggcgacaaagaggcggccatatgcaaaacgcaaccgggcaggcaggcaggtggcgaccgcgcgcaccaaacgaaacgatcccgagctctctctgcctcctgatatacgaaacctacgggggcgaagaagctgaagccgaggcaaacgcccgctcgctcccgttcgtttcgtttcgtttccatcagacgcgcggccgcagccgagcgcgagcgcggaggccgcgatccggctcgcctccccaccacctcccgttccgctccctcccccccaacccccgcatgctgcctcctccccgtcgcctcctcgccgccgccgccgtgtagctccgtccccgaccatgtctgcctattccgacaaaggggagggggatttggagattgggttggcgtcgccggaggcggagggagggggtcctggagggccggcgctggacctgtcgccacccagggcggtgaggcggccggggctagtgatgtcccactccgggaagcggctggaccagtcgccggcggcgtcgccgtcgccgtcgcggccggtgctggtgatgtcccactcgagcaaccggctggaccagtcgccggcgcggccggtgctggtgatgtcccgctccagcaaccggctggaccagtccccggcgtcgtcgccggcgtcctccaggggccccgtgctggtgatgtccggctccggtaaccgcctggacagctcgggcccgtccccgtcgccgtcgccgaccgccgcggcggctgctgcgccggtgctggtgctctcgaactccggcaagcggatggaccaggcggggcggaagaagtacgtcaagcaggtgaccggccggcacaacgacacggagctccacctcgccgcgcagcgcggggaccttgaagctgtgcgccagatcatcgctgaaatcaacgcgcagatgaccggcaccggggaggagttcgacagcgaggtcgcggagatccgcgccgccgtcgtgaacgagcccaacgaggtggaggagaccgcgctgctcatcgccgctgagaaggggtttctcgacatcgtcgtcgagctgctcaagcactccgacaaggagagcctcacgaggaagaacaagtccggattcgatgttctacacgttgccgcaaaagaaggccaccgagatattgtgaaggtactcctggatcatgatccatcccttgggaaaacgtttggccaatcaaatgtgacacctctgataactgctgcgattagaggccacattgaggtagtgaaccttctactagagagagtttctgggttggttgagctatcaaaggggaatggaaagaacgccttgcattttgctggccgtcaggggcatgttgaaattgttaaggctttgctggacgcagatcctcagcttgctcggaggactgataagaaaggccagactgctttgcacatggctgtgaaaggaactagtgctgcggttgttagggcactagtgaatgctgatccagctattgtcatgctgcctgacagaaatggcaacttagctttgcatgttgctaccaggaaaaaaagatcagagattgtaaatgagcttctccttcttccagacatgaatgtgaatgcacttactagggatcgcaagactgcgtttgacatagcggagggtcttccactttcggaggaatctgcagagataaaggattgtttgtctcgtgctggtgcagtcagagcaaatgatctaaaccagcctcgagacgagctcagaaaaacagtgaccgagatcaagaaggatgtgcacacacaacttgagcaagcaagaaaaaccaacaaaaatgtttctggcatagcaaaggagctgaggaaactccacagggaaggcatcaacaacgcaaccaattctgtcactgttgtggctgtgctctttgctacggttgcatttgctgcaatcttcactgtgccaggtggtaacgataacaacggcgtggcaatagctgtgcatgccgtatccttcaagatcttcttcatcttcaatgccattgccttgttcacatcattagcagtagtggtggttcagattacacttgttaggggagagactaaagcagagaggcgggtagtagagattatcaataagttgatgtggctggcttctgtgtgcactacagtggcgttcatatcatccgcttatattgtagttgggaagcacttccagtgggcggcgcttctggtgaccctaatcggcggagtgatcatggctggtgtgcttggtacaatgacctactatgtggtgagatccaagcgcacacgttcgatcaggaagaaggtgaaatctacaaggaggagtggctcaaactcatggcagcaaaactcagagttttcagactccgagatagaccggatatacgccatatgaagctcattctggttagttgatctctcagctttttggcagccataacacccgaatgtaaaaatgaaataggatgttataaacagaatgacccttgagattattattaggggttaactgtatacgttccaataagctggtgtaatctgccatttcctgttcttgaatcagcaggagctagccgacagtgctgttgtatactagtactacagatagactggttatcagaatatgcagcctccgctgtgctccatgtgcattgccttcagcttcatatcttcttttttgatactacaacaatgatgatagcagaatgatatgtatgctcctctgttctatcgttggctatcctaatcatgttctgtatccagtgtctctagaagcatttatgtttttcctcttgaacacaataatcttattctgattaagatcaaactattctataaaattccttttgttccaatggaatcatagccttgaaggagacatccatggtggagagggctttctcctctttgtccatggcacgtgagaagatgagaatatttccatgtcgacatgccggattttctaccagagaggacaagcctggataagcagcagtaatcttcagaacagccatctcgacagggacggggcaaattgccgaattaatttccaaaaaagcaagtatgatggagacggagcaatcaggctactgagcccggccgcaacttgatcgccgtcagtagtctctcttgcttgtgggcttcaatcatcagagcgtctgaaaccgcatgcgtgtgggcgtcgaacagtaaaggtcaagtgaaacggtgtgtggggtgtggcacactcactcactcctccattgcagataaggcattgacgctttggccccagtagactgattggttgacctgacgcttggagtcgtcgttcctcacgcatgatttattgccgaacagttgaattaaaccactacaattgttgccacagatcgtcagaaactgttgtaccacggcctaattaattttgtgcaagtactacaactcatctgaaaggaacagactgcagggaccaaagcaaattaatgcagaagctcttgaagacaatcagatggaggaggtggatttttgtcgtcctctcgttctttttcatgtcgtttaaaagtcataaaaaattgaaaaaaaatcgagggacatagactttcccccagatggaaagatatgtgaaggagaaggctttatggtagctgttctttagcaatctttagatggtgtgatgatatggaaggctgcaagccgaagaaggcctggtgtgccgcactatcaagtagcaacacaaagatcccactttgaggctttacgcatatgcaaatcctgcaaaagctctccagatcggcttgtatggtaaagcctttgccatgtactactggagcgtatagctaatgcagacgcggtgcttttcacaagaac

SEQ ID NO: 266 - DNA, 1983 bp, Oryza sativa
atcaaagtaatttcattaaaatccacccaaaaggatgtcttggtagtgcaattattcaaagccaaagcacttcaaaaatatggaaaggaaggagtaggctctaaaacgtgaaaagaacgaggtccttctcgcgaaaaagccacgcactccaccgaacacctccacctctccacgccctccctccctcccttctctctctcccgcgcgtgacgacgaggagactcctcccaccgaatcgaacaaccagcgtgctctctcctccgaatccgccgtcgacgatgccatccgccgcggcgggcgacggcaagggtaagcggcggttagtggggatgccgccggcgagggcggcggcggcggacttcgcgatgggcggggcggcggcggtggtggcgaagacgggggcggcgccggtggagcgggtgaagctgctgctgcagaaccaggccgagatgctccgccgcgggagcctcacccgcccctacaggggcatcgccgacgccttcggccgcgtgctccgcgaggagggcgtcgcggcgctctggcgcggcaaccaggccaatgtcatccgatacttccccactcaggcttttaacttcgcattcaagggctacttcaagagcatctttggctacgacaaggagaaagacggaaaatggaaatggttagctggcaatgtagcatctggcagtgctgcaggggctacaacctcatccttgctatatcatctggattatgcacggacaaggctagctactgatgcaattgaatcacagggaagcaaacgtcagttcagtgggctgcttgatgtctacaaaaagacacttaaaactgatggtattcgtggattatatcgaggtttcagtgtgtccattgtgggtatcactctatatcgaggtctctatttcggaatctatgataccatgaagcctcttattctagtgggaccactgcaggaaaatttcttcgccagttttgccttgggctgggcaataactacgttctctggagcctgcgcctatccatttgatacactccgtcgcagaatgatgttaacttctgggcagccattgaaatataagaacgccttccatgcagcaaaacagatagtttctactgaagggttcttcacactattcagaggggtcggcgcaaatattctctcaggaatggcaggagctggagttcttgctgggtatgaccagctccaccggtttgcaggtcaacatggttacaattttgagagcaagatgaaaggggcattgaaatgatgtgcaaatggggataaatagaggcatatccttggttgaagtttggattggccaaatgggatgtatgagcttggataatcaagcgggcgaaacagaactccagatactcctgcagttgataggattgacggcgaagagaacagcttttgcaggatgtatactttcaaggagcggagatgaagtcagaatcaaaagatagctcttgcggtagaaagaatgtcaataattctgaaacctgattcttgaagtgtgaatatcgatcgaaagttagatcgtactcgcgctaccaatgccttgatgtgaactgtaaatagaacttgtggaattgctccattgaataacctttctggtgtagtataccacatttgtactactgtatagccaaaaacaaattaataacaaacctctgggtgttccgaggattggagtcgggtcccaaagcgggaatcataccatcagaatctttcacaccatcctgtttataatggcccgcaggaaatcaagatagttgattcgaccaaaagagatgtaccatcttgattcgtccgttgatggtgttattcttttacactgtatagatatacctagattgtatttttgatctgtgatctgatttagattattcttgtacactatgcaaaacattctctggcttaaacatagaatgcatattacctttgtggtgcttccttgtctaggctgtcttatgaacttg

SEQ ID NO: 267 - DNA, 2292 bp, Zea mays
agacgaaacctgtttttccgacaatcgagcgccgaaaaaggactgccaccaaccgctcgctttccctcacctccccacctctctcgctccctccctccctccctcccattgcaggatcggcaccgatgcgattcaaccgcggcctcgcatccggtgcggaggtctgcaattggggggaggctcctctccgccgttggaaccgctgcggcgtcgcagcctgtgcgactttcctgctggttcctcatccctcagggacagattttgcattctttggcattactgtttgatggcagacagtagtgctccttctctgtggaggcattggggcaaaaggcagttgaactgaacgggcacatcaatagtctctggcctccaagggaaattgggaaattcagattgaacgtggctgcatcatttttcctttcattggtcttttcagcaacagcgatccattctcgtaggggggagagagagagagagagagagggagagaaatcaaagaggagagtgatcatggagcatgtgatcggagggaagtataagcttgggaggaagattgggagcggatccttcggagagctatatctcggtgttaatatacagaatggagaggaagtgggaataaaattggagcctgtgaaaacaaaacatccacagctgcactatgaatctaaagtttatatgctgctgcagggtggaaacggtatcccacacctcaagtggtatggtgttgagggggagtacaatgttatggtgatcgatcttcttggcccaagcttggaagatttgtttaattcctgcaacaggaaattttctatgaaaacggtgcttatgcttgctgatcaactgataaaccgagtggaatacatgcattccaagggatttattcatcgtgacatcaagccagacaacttccttataggcttaggtcggaaagctaatcaggtctatatcattgattatgggcttgctaagaaatacaaggaccttcagactcataaacacatcccatacagggagaacaaaaatctgactggaacagcacgttatgctagtgtgaatactcatcttggaatagaacaaagcaggagagatgatctggagtctgttggctatcttctgctatattttttaagaggaagcctcccatggcagggccttaaagctggcactaagaaacaaaagtatgataaaattagtgaaaagaaaatgcttacctcggcagagattctgtgcaaatcttacccgccggagttcgtctcatatttccactattgtcgctccctgcgatttgaagacaggccagattactcttcaatgaagaagctctttcgtgatgtatttatacgggaaggataccaatttgattacgtatttgactggactgcactcaagtaccctcaaatgggctccaacaacaagcttgttcaacaaccaagtgcaagaatggctggagttggaccatcagttgagagaacagacaaagcttccatgggacaagagatccgggataggttcactggtgctgttgaggcattcgccagaagaaatccaggctctgggcgccctgcagatcattccagtcattccaggcacaaaagctttgcagattcctttggaacgtccaacgaagcagttgccgactcatcagagaaaacgcgcatcttgtcccggggagggagctcgtcgaaaatgcccgcagctccgtccacccggccgacctcttcgggggactgcagtgaccagaaccgccggtgggtctccggcagcagtggcggcagcgggcgcccgtcccccgcgcagaggctccaccactcgggaggcgccgagaacagcaggtcgtccccgcgctcccccgtggcccggaacgcggccgggaggggaggctccgcctcgcgggacaacacgacgttccgcagcctcgagcgcctcaccatcaccaccagcaggaggaagtgagctgccgaggaccacgccgacgaattctgagagtggaaggcggttactaggccgaggaacttttgcgggatccttgctctctgcagctaaagcaaatcggcaaatagatgatggatggatggttacaaggctgccatgaaaatgcaccctttccccaaaccccagcgtatagtataacgctctccccaaactccaagagggaagacaactccaaagtacaatgcaatcttgattctgtcgatctggcactagttttaaggtgttattgcagaatccctccatttgaccataaattttaaaaacgtatacaagaatctgagttaattttgttta

SEQ ID NO: 268 - DNA, 256 bp, Sorghum bicolor
ccgttctccctgatctgtttgatttacacagattacacgctgccctgaccacatcgtcagcaagccggccgtgtgcagtgttatgacgggctgatgaacgagccacgcaaggcgttgtgttggaaaagtcgaatccgctagaataaataagtacgtggacgatgggctcttgctgtgtcactactggactttgcttgtgttgtatgtcaaaaataataataaatatgttccgttccatattgcttgtgacactata

SEQ ID NO: 269 - DNA, 809 bp, Hordeum vulgare
gcgccatggcgctccacgccgtctcccctgcggcggcggcacctccgccccgcgccctctcctctgcccgtctgccccagcgcccaggttgtggttgtctctcaaaccgttcatccctgttaagttcgcccacaaacttcatgaaaattcagtctggagcagtgggtttctttggtgtgcctttggttcttcaacactcggacaagagagcagttttgaggcatgccactaatgaagaaattgaggaagaaaagacaatcgttgaagaacaagctaaagaaaagatggagaaggccattgaaacagttcagtcgaacttcaataccgtgaggactgggcgggcaaacccgtctatgcttgacaggattgaggttgagtactatggaactcctgtaaacttgaagactattgcacaagtaaatactccagatgcgacttctcttcttatccagccatatgacaagtcttgcctcaagctcattgagaaagctatagttgctgcaaatattggggtaacaccaagcaatgatggagaagtgatacgagtcactgtcccaccattgacatctgatcgcagaaaggagatgacaaaaaccgtagctaagttatctgaagaaggcaaggttgctatcagaaacataagacgagacgcaatcaaagcctatgataagctagagaaggaaaagaaactttctgaagataatgtgaaggatttatcagccgatctacaaaaaatcacagacgagtacatgaaaaaggttgaagccatccaaaagcagaaggaacaggagctgagcaaggtttagtag

SEQ ID NO: 270 - DNA, 1010 bp, Hordeum vulgare
cgggcatggcggggatacggtggccgccggaggacccggagatgttcccgacgcggatgctggggacgggggtctggggcgggccccccgccgcgcccggcgaggcggcgtcggacgacgaccgctccgtggcggccgactcctggtccatcaagagcgactacgggagcacgctcgacgacgagcagcgctacgccgacaccgccgaggtgctcctcgcctcctcctcctcctcggccgcctccgccgccgcgccctccgcctgctcctcctccctcagcgcccaccactcctccgacttcagcttcgacaaggacgtgcccgacgtcgtgccgccgatgctgggcctgcacaattaccaggacggcgcgttcgccgaagacctagccaattaccacgaacgcagccacgccgatgactggtttggcaccgaggccatggatgtccttgtaggctggacgaaaaacttatgttccagcaaggatttgtccggctgcagcgtacttgacataggaaccgggagcggacgactcttacagcagcttgcaaaacaagggttttctgatctaactggcattgactatagtgaagccgcaattgagcttgctcgaaaccttgcaattcgtgatggatttgagcacattaatttcttggttgatgatgttctggagtcgaagttggagaggagatttgaacttgtgatggatgaaggaactctggatgcaatagggctccaccctgatggacctgtaaagagaatgatgtattggcagtcagtggctagcttggtttctcctggtggcatactggtgatcacatcctgcagcaggaccaaggatgagctagtgcaggaggtggagaacttcaatcagagaaagttgggcgccacgctatctgaaggagcgctgaccagcgatgctgtggtgttcaagtacctcgaccatgtgcaagcttacccaaacgtcgatggtgtttgcatcgccaccgttgctttcctgcatacatgatga

SEQ ID NO: 271 - DNA, 845 bp, Hordeum vulgare
catcgatgggcatggggacaacagtgctgcccgtcgcccacaagctctcgctcgcctcccccttcctcccgcgccaccggcggccctgccgtccccccgcccagcagcactgccggcgccggcgccatggggcggtggtggcgtacatggagccggacccgaactcgccggcggccatcctggggcgcatcgtcggggccctccccgtggtgggcctcgtggcgcgcatcctgagcgacgacggcggcgtcggcggcgacaccgtcgacttcgccgagttccggcgccgcgtcagcaagaagtgcaccgtcatggactcccaggccttctacgacttcaacgaccgccgcggcaaggtgggagaccccttctacgtcctgctgtgctgctggctggccgccattggcgccgggctgctgaaaacagaggagatcctggaaggcgtggcccggctccggatgtccaacgacatccagtacgaggaggagaccttcctcgacatgatgaagatagcaagggagaaacgggccaagtccaagagccaggcgccggtgataccgatggaggtgcgggcggagaaggcgctggaggccatctacgtgtgctgcttcgggcaggagatggtggagccggaggacgagaagctgctgtgcacgatgctgaacgcggtgttcccgtcggtggggaggccggcggtggagaggatggtgtccaccatggccaagcaggtggcctccggcgagaggaggggccccgacacaaaggtcgtgtccaaggaggtggcgcagaggcagctcaaggacctcgagttcctgcagcagaacaagctggactcggtgtgatga

SEQ ID NO: 272 - DNA, 1196 bp, Hordeum vulgare
ctcttctagggtttcctcctccccatccgcgccaggaccccatcgcccgcccatgtccgccgcctcccgcgacgccccagtcccgcccgccatgccggacctcgtccgcgaccacctctacttcggcgacatcaacgacgccatcgcggccctcaccgcctccctcccggacggcaccgacatcacccacgtcctctccgtcgtcagctccgcctccatctccttcttcaccgactaccgcccgggcctctgcttgccgaccgaggaggtccgccgcgtcgttgccggggaggatgggacgccctcggtggtggctccagggcggctggtgcgggtggtggagaggacgggggaagggctaagggtgacgcggatggccgtgccgctcaaggacacggaggaggagaacctgctcgaccacctcgagccgtgcctcgactttatcgacgaggggaggaaggcgggcagcgtgctcgtgcattgcttcgcgggggtctccaggagtgctaccatcatcacggcatatctaatgagaacagagcagaaatctctggaagaagcactacagtccttgaaggaaattaatgagtccgtttgcccaaacgatggtttccttgaccagttaaaattgtttgaagaaatgggtttcaaggttgatacttcaagtcctttatacaggcgcttccgcttaaaattgttaggtcagtcctatagagttggagagaaaatagggaaccatgtatttgaagacgatcctggggttgctcgacagcctaatcctaccgaggaattgtcaggcaaggggaagacccctaaaacagcataccgctgcaagaaatgcaggaggattgtcgcagcacaggacaatgttatcggtcacactcctggtgagggcaactctagctttgagtggcacgacaagaggaaaggccacacacacaacaaggaacaacaagattgttcctctctgtatgtcgagcctctcaagtggatgactccagtagaagatggcgctttggaggggaagctgtcttgtatccactgcggagcacgcttagggtacttcaactggtcagggatccagtgcaactgtggcagctggatcacccctgccttccaaatttccaagagcaaagttgatgtaagcaccatctagaacttctccgcgggctagcagattcgaggagtttgtcagg

SEQ ID NO: 273 - DNA, 800 bp, Hordeum vulgare
ttgctatggaaggtgggggaatggaccaggtttgcatggctgccatgaccaaccaaccttcagtatctgataacaagctgatgaagaacatcagcggggagatgcctgcaacagcaacggctggaagcggctcctttgactgcaacatctgcctcgacttcgctgcagatccagtcgttaccctttgtggccatctgtactgctggccttgcatctacgagtggctgcggccatcggtggtatcagctaccagcggcaacaacacttcagcaaggcagcagtgccccgtgtgcaaggccgcactatctgctgacagccttgtgccactctatggccgtggtggtagctcaaagaaatcattggatggtacggccattcctagacggccaacggtgcaccgggagaatgttgcgcagcagcacgcgcaaaccagcatcgatgacctgcaccaccagaacatggagcccagccctccgctccggccactgcggcatgcacaccaccaccaccaccctggtgccaccgagttcgactttgtgtaccctccttcaccaatggggcgtggcttgatccattccacggctggaggggtgctaggagggatggcggaggcggtgcttccgtgggcgtttcgtgggcaggtgccgccgagcatgtactacacaagcccctacgctgtcgcggaccacactgtgggtccccggctaaggaggcagcagatggaggtggagaggtccctgcaccagatctggttcttcctctttgtgtttgtggtgttgtgtctgctcttgttctgatga

SEQ ID NO: 274 - DNA, 1347 bp, Hordeum vulgare
ggtacatagcaaaacatggctcctctgactcccagacttgtggtgcccatagatgtgaagaagaagccatgggagcagaaggttcgtctccataaccgctggcatccggatattcctcctgttgctgatgtaaccgaaggggaattattccgtgttgagatggtcgattggactggaggacgagttagagatgatgactctgcagatgatatcaaatttctggacctcacaattactcattatctcagtggcccccttagaatagttgatgctgaaggggttccagcttcacctggtgatcttctcgcggtagagatctgcaacctcggtccgctccctggtgacgagtggggttatactggaatattcgaaagggagaatggaggcgggttcttaaccgaccacttcccaagtgcaagaaaagccatttggtattttgaaggaatttatgcatactcgcctcagataccaggtgttcggtttccgggattaactcatcctggtatagtgggaactgcaccatcagctgagcttcttaatatatggaacgaaagggaaagaaaattggccgagacaggtcacgagtctctgaaattgtgcgaagttctacatcagagaccccttgctaacttaccaacctctgacaactgcttacttggaaagattcaagaagggactgctgaatggcaaaaaattgcaaatgaagcagcaagaactattcctggaagagagaatggggggaactgtgacataaagaatctaagcagaggttccaaagtttatctaccagtatttgttgatggagcaaatctgagtactggtgatatgcacttctcccaaggtgatggtgaagtctcattttgcggagcaatagaaatgagtggattccttgagctaaagtgtgagatcataagaggtgggatgaaggaatacttgactcctgttggtccaacagcacttcatgtgaatcctatctttgagataggtcctgtggagccacgtttctcagaatggttagtctttgagggcatcagtgtagatgagtcggggaaacagcatttccttgatgcatcagttgcatacaagcgtgcagttctcaatgccatcgagtatctttccagatttgggtactccaaggagcaggtctatcttttactgtcatgctgtccatgtgagggtaggatatctggaatagtagacgcccctaatgcagtggcgacgcttgcgattcctacagcaatattcgaccaggatataaagccaaaacgcctggggcatggaccaaaattgagaagacttccggatgttctgcgatgaagttgcagtggacaccttcctgtaacatag

SEQ ID NO: 275 - DNA, 1633 bp, Hordeum vulgare
gagctaagcccgagttactgctgcggcatgaagcccaaggttgccggcgccgccgccgccggcgagaagggccgcggggtggacccgtcgctgccgcggttcaagtgccaggaatgccaccgggcgctcgtcgtcgtcggcgtggagtcattccccgataggttgcccgctcacgccaactctggtatgcatgcatcttctgttcagggcagcattatgggggcgagcaggatggacagttcttacgttgtgttgtccaagcagaacagacctcaaggccctggtattcccccacggccacctagtgcagcagcccggcatgtcgagcctaaccaatcaacaagagcaatggaggggtcatatataatgcttccacctgccgctgcttccatatacaagacatctacctccgaaggaggtggcgcacatctgtcgcctccaaatcttaactctactagcccttcaccaggcaacaattctggatttcactctagtgtgactgtcttaaagcgggcatttgagattgctagttcacaaactcaggttgagcagccactctgtctggaatgtatgagggtgctatctgataagatggacaaggagattgaggatgtaaatactgatatcaaagcttatgatgcatgtcttcaacgcttggagcaggaatcctacaacatccttagtgaaactgatttcctcaaggagaaagaaaagatagaggaagaagaaaagaaactaaaagctgctattgaagaagcagaaaagcagtattcagaagttagctctgagatgaaggatcttgaaacaaagtctaaacaatttgaagaattagaagagcggtattggcatgaattcaacagcttccagtttcagctgacatctcaccaggaagaaagagatgcggttatggccaagatagaagtttcccaggtccacctggaattgttaaagcgcacaaatgttctcaatgatgcattctatatttcacatgatggagtgattggaacaataaacagcttccgtctcggtcgtctgcctaatgtacaggttgagtgggatgagataaatgctgcctggggtcaggctgctcttctgttacacacgatggctcagtacttcccgaaatttcaataccggatcaagattcaccctatgggaagctacccaagagtaacagacatcaacagtaatacctacgaactgtttggtcctgtgaatttgttctggagcacccgatttgacaaagccatgacatggtttctcacttgccttcaagagttctctgagtttgccataagtttggataaagagaacaatgttccagctgaaaagtcactgaagcttccctacaagattgatggtgacaaagtagggagctacacaatcttcttaagttttaataaactggagaactggacaaaggctctaaaatatatgctttgcaacctgaagtgggttctctactggtttattggcaatacaagtttcgcgcctccatctgcatctttgtacttggcgcagtctccaaacaagaagggttgatgtgattgtagctgcatgctgaccaatcacaatacaatatgaaatttatgtacataaacaccaggcgtagctagtttccttgttgcttgca

SEQ ID NO: 276 - DNA, 332 bp, Hordeum vulgare
ctgagatggatacttcagctccttcaccatttgtcaatggagagattctgaagatgtttcttgggcgacgagtgcgcacagtggttcaagtccaacacaatgaaggtggagttcttcttgggctgtccactgatgggcatcagttgactatcagaggtgctcctggtgcccctgagccaccacactacatcgaggttattgggatcgctgatagcagcctgtcaatccgtgctgaatcttgcactgattttggtgaaaactttgatggtgtggcattcaacgggctatgcaagcttgcaaacgacaagtacaagtacatgttcctgtagtag

SEQ ID NO: 277 - DNA, 2901 bp, Hordeum vulgare
ctggtctcgtctctcccatccccttccctctccccagaaagaccaaaacaccccccaaaatccgcgggcggcgcactggcggcaagttgagcggcggccatggacgaggggctggtgtccgtggacaagttcagcggcggcagccaggtctacttcctcacgcacctccacctggaccacacgcggggcctcggcgcgtcgggcggctggcgccacggcccgctctactgctccccggccacggcgcgcctcctccccatccgcttcccgggggtcgacgcctccctcctccgccccgtcgccgccggcgcctccgcctcgctctccctctcctcccccaactccgggcgccccgtctccatccacgtcaccgccctccccgccctccactgccccggtacgcctccctccccaaaccctcctctcataatgtgctcgccgccgctcggtaagccgtctgatccgtggccgcgtgccttgtgcgcaggctcgctcatgttcctcttccgcagcgatatcggatgcatgctgtacaccggggatttcaggtgggagttggggtgcgacaaggcgcggtccgcgaagaaggcgctactcgacgcgctcgccggggataccgtcgacgtgctctacctggacaacacctactgccacccgtcgctgaacttccctccgcgccacgtcgtcgctcagcaggtcagatttgattcgatccactgcgccaatttctgccccgtgtatgcaacgctgtcacttcagccggccgtagtccatgctagtctgaaattatcttcaaagaagtgcacttaccttgtctgacgatttaaatcaccaggaagattatacgttgtgggtccctaaggaaaacaatttttagaatgccttggaggcctgatcccattctggcagtgaagtctccagaatgagcagatgcgctttgatatgcaatttccggtgtccatccttaggtgtcagttgcaagttgcaattgtcagttacaacctagttcatgtacacagtgtgctgcttatacatcaatacttctggcgtttcacatggagctcatagaatttcagcactccctcccatccgattaattgacgcagcctctatacaatgtaaaatttggacattgtatagaggctgtgtcaattaattcggatcacagggagtaagaaatttggtacagcctgttgatgccactcaagccaaatgtctgtcaaaggtgaaaaccagtggcatattgttttccagagctgcatcttcaagggggcagagactatctgagcatgaaagctgttgtacttcctcatgttcagcattagctgtcccgcatcctattttactaatggggtggatgctctgatagaggctagagttctagtgctaattaatctacctgcaataagatgtcattcccaacttgtaagtaagttgcccacacataagtttctgccctgagcgcaatgtatgtgaccattaagttgtccatcatgctatgttggatgttctatactaatattttcttagtgttgggtgcagatagttgacattattcatgctcatcctgatcatgaatttattcttggcattgacactcttggcaaagaagacctcttgctttatatagccagagcactacaaacgaaggtgctaagcctcttctccttgacatactcaattttctactcctgggcataatctgatatgttccttaatttcctatttccattcttttattcagcataaatgtgcttcagtattgatgttaagctctcaccgctgctcagtcatctagtctaaaattctgtgtagccctcagaactttgatacacacggtgctatcgtatttgctttataaacgctacacattgatcttctgaaggctaaatattcttttctctctttccttgtcagatatgggtctggccccagcgcctactgacaatacaccttctaggcattgataacaatgaagagatcttcaccacccagaccagcttgaccaggatccgggctgtaccaagatacgccctgagcattgagagtcttgaagctttgaacacagtatgtccaactataggaatcatgccttcaggcagcccttggctatggagaaacagtgagggaaaggctaagttcagtgataaagcaccagcaaagtctagcagatgcaaagggcgagggcggggcgctggcgcaatagagatgaactatgatcccttgtcaccaccaaagctatttgagaaggactcctacactctgccatactccgaccatgcttgttttttggagctagaggattttatgcagacagtgcgcccgtcagcagtcgtagggatcgtccgcacgtcatactgttacgtgaatcctcgtggtcacttcggccatctctgcgcagacgaagacgaagcgtgcactgacaatacgcccgtgaagaatgacaggcatgctggaaactcgacgcccttgaagaacagcaggcatgctggaaactcgactccggtgaagaacggcaggcatgctgggaactcgactccggtgaagaacggcaggcatgctggggactcgactccggtgaagaacggcaggcatgctgggaactcgactccggtgaagaacggcaggcatgctggaaactcgccgcctaagagaagaccaagtgctttgaagaccccgaggagaaggatggtcaagatctccagtccaacgctgtacagaagcagagctataatgatgaaaaggaggcattcctgtggtgcaaagattgaagaacccgaagaaaccatccctgtctcttgagttatctcccctcccaagtagattttatcttagtcctgcaaaatgatcgacagcagctggatgaagaacctgtcatcgtccctcgagttatttctccaa

SEQ ID NO: 278 - DNA, 1137 bp, Hordeum vulgare
caagcaacgaagccagattagaatagcggcgccgatgggctggactagttggcgccatccgcgtgcgccaccaccaaccgccccctgccaccacgccgcgccatgctctccctcgcccgccgcccgctctccgccgccgtccccgccggcaacctcctcggcatccacctcttccagtgccccgacgcggtgggcatcgtggccaagctgtccgagtgcatcgcctcccgcggcggcaacatccacagcgtcgacgtcttcgtccccgacgacgcccccgtcttctacgcccgcagtgagttcacctacaacccaaggctatggccacgcgacgtgcttcgcaccgacttcctccatctctcggactgcttcaatgcgcagaaatccaccgtgcgtgtacctgacattgaccccaagtacaagattgcagtcctcgcttcgaagcaggaccattgtttgtttgacttgctgcatagatggcaagaaggcaggcttccagttgacattcattgtgtgataagcaaccatgatcggcctgtagataatcatgtaatgcgtttcctccagaggcacgaaatcccctatcattacttaccaacgacttctgggaataaaagagaacaagagatattggaattgattgaaggtacagattttgtcgtgctggcaagatatatgcaggtaatgtctgaaagctttcttaaagcatatggaaaagatattatcaatattcaccatggccttcttccctcgttcaaaggaggaagtccttctagacaggccttcaatgctggggtgaagttgattggtgcaactagccattttgttactccggaacttgatgctgggccaatcattgagcagatggttgagcgagtttctcacagagacacgttacatagctttgttgtgaagtccgagaaccttgagaagcagtgcctagcagaagctatcaagtcatactgcgagctccgtgtgctaccatatgaagtgatgaagactgttgtgttttgaatttcttttaatggttattatgatgtgtattcttttccaaaattagcagtacattattcttttattaatatattcacgttgagccattaggtgtatcttaacctgggttgaggttacgagaat

SEQ ID NO: 279 - DNA, 2059 bp, Hordeum vulgare
gactctcgccaaacccaacccccacacacacgaacacgcggccatgtaccgggcggcggcggcggccatttcgcggtcctcctcctcggcgctgcgcaggcatctcgcgcgcggcggcggcggcggggagcagcggcagtgggcgcgcgggtatgcggcgaaggaggtcaccttcggcgtcggcgcgcgcgccgccatgctgcggggcgtcaacgacctcgccgacgccgtcaaggtcaccatgggccccaagggccgcaatgtggttatcgagagaccgaacagatcccccaaggtcaccaaggacggggtcacggttgccaagagcatagagttcgaggacagcgccaagaacgttggggcgagcctggtgaagcaggtcgctgatgccactaacaaggccgcaggagatggtaccacttgtgcaactgtgcttacacaggcaattctcacggaaggatgcaaggctgtggcagcaggggtcaatgttatggatttgcggaatggcataaacaaggctataagcgctgtcactgctcaccttaaaagtaaagcatggatgattgattccccagatgaaataaatcaggtagctacaatttccgcaaatggcgaaaaggaaattggagatctgatatcaaaagctatgggaatagttggaaaggatggcgtcattactattgctgatggcaaaacgttggataatgagcttgaagcagtccagggaatgaagttgactagaggctacatatcaccttactttgtaactgatcagaagactcagaaatgtgagttgaaaaatcctttgattcttattcacgacaagaaaaactcaagcatgaattcacttcttccagcattgcaaatttccatccagaacaacagaccccttctcatttttgctgaggatgtagaaggagaagctctatcaatgcttgtactgaacaagcatcgtgctggactcaagatatgtgctgtcaaagctcctggatttggtgaaaacagaagggcaaatctggatgatatggctattttaacaggagggcaggttattagcgaggaacaaggtcttgatcttgataaagttgaactacaaatgctcggcacagctaagaaggttactgtatctcttgatgatactatcattctagatggtggaggtgaaaggcaacagatagaagagaggtgtcagcagcttcgagaatcactcgagaacaacaccgccatgttcgacaaagaaaaggctcaagagcgtttatcaaagttatctggaggcgttgctgttctcaagattggtggagctagtgaagctgaagttggtgagaaaaaagacagggtaacagatgctctaaatgctgcaagggctgctgtggaggagggtattgttccaggtggtggagttgccctattatatgccgccaaggagctcgaccagattagcacgtcgcatgaggatgaaaggattggagttcaaattatcaagaatgctttgaaggcccccctgatgaccatagctgcaaatgctggtgttgatggtgctatagttattgggaagctactggaacaagacaatcttagtttgggctatgatgcagcaaaaggggagtatgttgacatgatcaaggctggtatcatcgaccctgtgaaggtgatccgaactgcacttcaagatgcggcaagcgtttctctgctgatgacaaccacagaggccgcagtcgctgagctcccgtcgacaaaggccagaatcgccagtcgaatgccggacatgagcggaatgggcttctgaggacagtgcagcatgctgtctcatttacctgtttttggttaaagacatgagaaacgtaacttccccggcctatacatgaatggaaattcccctccctatcaagtgagatgagaggtgcaaagctggcacctattttggttttcgaaaaactcacggttcagtgctgatgtaaccttaactagatttagagccctttcattttgggtcgaaattcgagtaggctcagacaagacaagcattatcttggctttgaatgttaactgggcaacgtct

SEQ ID NO: 280 - DNA, 1481 bp, Hordeum vulgare
acactcgcactccacaagacactccctcctccgcggctcattcacaccaccccaccccaccccaccccacggtcgatcgaggtgcagaggcatgaggggttcacggtggtgctgctgctgcttcggccgaggcggcggcggggccgggcggtcggggagcgtggccgacgacgggctggtgtgggacgtgggcctcaaggcgcacgcctccggcgagtactccgtcgccgtggcccaggccaacgaggcgctcgaggaccaggcgcaggtgctcgtctcccccgcctccacgctcgtcggcgtctacgacggccacggcggccccgacgccgcccgcttcgtcaacgcgcgcctcttctccctcatccaagagttggcgtcccagagcgggggcctctcggcgcaggtgatcaagagggccttcggcgccacggaggaggagttcatgggcatggtggagaagtcgtggccgtcgcagccgcggctcatgtccgtcggctcctgctgcctggtgggcgccatcgaggacggcacgctccacgtcgccaacctcggcgactcgcgcgccgtgctgggccgcctcgccagcaccgccgggaagaagcgccgggcccgggcggtggtggcggagcggctgtcgcgggaccacaacgtggccgacgaggaggtgcggcgggaggtcgccgaggcgcacccggacgacccgcacatcgtgatgagcagccacggcgtgtggcggatcaaggggatcatccaggtgtcccgctccatcggggacgcctacctgaagcggcccgacctgtgcagcccggcggtgatgcagtcgctctgcccgttcccgctgcgccgcccggtcatgagcgccgtgccgtcggtcacctcccgcaggctgcgccccggcgaccagttcatcatcttcgcgtccgacgggctgtgggagcagctcagcgacgacgccgccgtgggcatcgtgtcccgcagcccgaggaagggcgtggcgatgcgcctcgtgcgggccgcgcagctggaggccgccaggaagaaggacatgaggtacgagagcatcgcggccatcgagaagggccggagaaggcgcttccacgacgacatcaccgtcgtcgtgctcttcctcgacaacaggtgcgagggcacgccgcagtccacggtcggggccggcgagatcgacggcacgcgcgcccccgtcgacgtgttctcgctcggccccgacgaccacggggacgacccgaccaggcccgtgctgcgctgatcgttctgccagccggtcagtcggtcagcgacgtggatgctcaccgaaaacgtgctcgcggtgttaattttcagagactttttgctccctgaaacggaagatacggagcgtgcgttctttgctttctgcatcgaactaagaggattttcatatgttatgtttaattagttgtgtagataattagtgccgtgtcgtgttggtgtgcagagaatta

SEQ ID NO: 281 - DNA, 1098 bp, Hordeum vulgare
attgcaacttgagcgagcacgctccctgtcccatggagccacatcaccctcggcgcgctccgacggcggccatggatcccccgacgcctgcgggggcgaggccggcgatgtcccactcctccgccttcctcctcccgtcctccgcaacccccgccggctccggggacgcgtacgcggtcgtcgtcctcaaccagcgcctgccccgcttcgcccctctcctctgggaccgcgcgcaggtgcgggtgtgcgccgacgggggcgctaatcgcgtgttcgacggcatgccggagctgctccccggccacgcccccgacgatgtacgctccagatacaaaccagatgtgatcaaaggggatatggattcagtgcgaccagaagtgaaggaatattattccaatttgggcaccaaaatagttgatcaatcacacgatcaggacaccaccgacttgcacaaatgtgtagcatttatcactgacaagtctcctggcccagacaaatcgaatctatgcatccttgtcctcggagcactgggaggtaggtttgatcacgagatgggaaacatcaatgtactccatctcttcccaaacattaagatcgtcctcctatcagatgattgcctgatctttctgctcccaagaacgcacagtcacaacatccacattgaacggtcagttgagggcccccactgtggattgattcccattggcacgccttcgaccagcaccactaccaccgggctccgatggaatttagataatgctcatatgagcttcggtgggttgattagcacatcgaacatcgttgatgaggaccaggttatggtcacttcagattctgacctgatctggacaatatctctccgacactgagtttttggatgaattttctcgtcagacaatacttgtatgagctacggtggattgattagcccgtccaacatcgttgatgaggaccaggttatggtcactttagattctgacctgatttggacaatatctctctggcaccgagcttatgctatgcagaacgtttgagatatcgccaattttgtctcgtttaatttatgtctatgacaactacacccagcagtgatgtgat

SEQ ID NO: 282 - DNA, 5599 bp, Hordeum vulgare
gcaaatcgagtgagcatgaggggtgggagcgctaaaggcctgggtgatgggatcaccggaggggcggctcgttgagctgttgggaacagttaagtcgcggatgccgcggcggggagagcactcgccgccgcctgcgccgaaggctgctgctgccgatgtgccgcagccgcatgacttgtccagagacttctggatgccggaccaaagttgtcgcgtgtgttacgactgcgatgctcagttcaccatccttaatcggcgtcaccactgccgccactgtggccgcgtgttctgtgcccgttgtacggccaattccgtgccccgctcgctgggggacgccacgcgggaggacatcgagcggatcagggtctgcaactactgcttcaagcgctggctggaggaggaggcggtcactccgagggatgtggcgcagccgtcgggcctgtcacattcggccacgagtgcggggagcgaaaaatcatgttccaccgggcgtagcagcacggtgaccagcgaccagatgttgtcttatgcgaatgcctgctgcactgactctgcatcacggtcggtgggcagcgagggcaactgcggcgagctcgatgcttctctggagttgcagcatgctgcgatggagggcgtggagcatgtggcttatgtggacaattcgcctgatccattcaatttctgcttgaataggagtgatgatgaagatgatgactacacaattttccgctctgattcagaagtacaccacctacaaaactctggtgggcctatgtgttttgatgatcatcaagttgtttgcagtgatgctgctaaaggttcagtatcaccaagaaaagatacagcaaccttagttaattctgagggaatgtgtaagactggagatcatcatatcattgataatgctgaggattgcaatgctcgatcttcttcgttgtatggcatggaagtgctagaaaatgaacttgtggattttgaaaacaatagctcactttggctacctcctgaagcggaggatgaagaggacgaccatgatggtgctccatttgatgatgatgagggggaggatgccacaggagaatggggttatctacgctcaaacagcttcagtggacattgtcgaagtcgagataaatccactgaggaacacaagaaagccatgaaagatattgttgatgggcattttcgggcattggtggctcaacttcttcaagctgaaaaggtagaattggctgacaaaattggcaatgagagttggctagatatagttacctctttgtcttgggaagccgcatctcttttgagaccagataccagcaaaggagggcgtatggaccctggaggctatgtaaaggtgaaatgcttggcttgtggccgtccaagtgacagtttggttgtaagaggagttgtttgtaagaagaatgttgctcatcggcgtatgtcaacaaagaaggaaaagccacgaatcctaattcttggtggtgcacttgaatatcagcgtgtatcgaatttgctttcaagttttgatactttactgcagcaggaaacggattatctgaaaatggcagttgtgaagatcaaagcacaccaaccaagtgttgtattggtagagaaatctgtgtctcgttatgctcaggatttatttctggagaaaaacatttcacttgttttaaatatcaaaagaccacttctggaaaggatatcccgttgcactggtgctcatatagttccctcaattgattatctgtcatcccaaaagcttggaaattgtgatttattccatgtggagaagtatattgaagagcatgggactgctggagaaggtgggaagaaaatgctgaagacccttatgttttttgaaggctgtccaaagcccttgggttttacaatcttgctaaaaggagctaatggggatgagttgaaaaaagtgaagcacgttgtgcaatatggagtctttgcagcctatcacttggctcttgaaacatcttttcttgtggatgaaggtgcaaccctaccagaactccctcttaagtcgccaattattgttgctttgccggacaaaccttccagtgctgatagatccatttcaacgatacctattttgcaaatgcctactatttcatcacccaacaacaacctgcaagcatttgatattcaaaaggatgactttacattcagtggttttagaataatggaccaaacggcagcagcatctttccctgataacaaatgctgtgaaagattgggagttacccaagcatcatcagttcaaatcaatgaccaaactggaaacattggctgtttgcttggtatgaaccctcaatcatataatgatcctctggttcagcagttgagaatttcattctgccattgccctgcttgtactagagatgttggtagcaaaatgaaatttgaagaactccagcctgaaaccaatagacatgcactggctaatggtttgagtgtgttgcctgctcatcctgcaaatttggtggctgctgaaagtgatctttcatttgcccataacgccaacaatggtgccaaggtagcggctaagccatctgctcctctcaacttacaagtttcttataataatggcagttcaaatgatggttcaatagtaaaaagggatgagattccagcatctcctgccgacaaccagagtatattagtttctctgtcctcacgttctgtttggaaagaagctatctgtgagaggccacaccttcttcgcataaaatattatggtaactttgacaaacctttaggcaggtttttacgtgaccagctatttgatcagagcaaccgttgcctctcttgtgagctggcaccagaggcccatgtttattgctatgttcacccccaaggcagcttaacaatatcagtgcggaaactcatagtgaagttacctggtgaacatgatggtaaaatctggatgtggcatagatgcttacgctgttcgcgcgataaagggctccctccatcaactaaaagagtagtgatgtctgatgctgcctggggcttatcttttggtaaatttttggaacttagtttttcaaatcatgcagcagcaagtagggtagccagctgtggtcattctcttcacagggactgccttcgtttttatggttttggtgaaatggttgcttgcttccgatacgcatcaatcaaggttcactcagtctatttgcctccgccgaaacttgattttacttcccagcatcaggaatgggtagagcaagaagcaaatgaggtggttgattcagctgaactcctgttcactgaagtactgaatgcactccatcaaatttcagagaaaaggccaattacaggctcttttgatggcaatatgaagattcttgagttaagacaaaacatagtagagttggaagatatcctgcaagcagagaaggtcgatttcacggagtcactaaagaatctactgaaaaaggaaatcagaaaggggcagttattcattgatattcttgaggttaacaaactaaggaggcagctactatttctctgttacttgtgggatcaacgcctaagtttcatagcaacctcaggtggcaagtattgcgatgctttgggaggtctacgagttggaagtaataattctgaaatcaatgatagatcagctgatagcgatacaaacacaaagttggtgaagaactcaaagggcaccgattcaaatgcacttcatgctgatgacgaggagatcaaccaacatgatcaatctaatgaaactaactcgagaaatactgaagagttgaatggtgctgaaggtacaatagctaaattaaatcatgcaaacagtgttaatgtcaatgatcatttagatcatcaaggatcaattatcggcgttcgtagggtttcttctgaaggtcagttccgagtagctactgacatttcagataaactggatgcaaaatggagaggtgaggatagacctgctcctgatgcaagcctggtgaaaccactagctctgttagaaggtacagctgcggatgtgaaaaaacaagctaaggcagtaccacggcacacttctgcatctgtcaggtctggggatacagtagaagacttactaagctgccttaaaatgccatacatgacattttataattccttgaacacaaactctggcacagcaccgacattcggtaccttggccgactacaatcctgtatacatttcattgtttcgcgatctatcacagcaaggtggagcaagactttttctgccaactggagctaatgatgttgttatcccggtatttgatgatgaaccgactagtattatttcttatgcactcgtttcacctgtgtatcactttcaaatgtcagtagagagcaatcaaaataaagacagcggagattcttcactttcgttgcctgtttatgattcaggaaattttaacctgttccatttatttgaggattttggatcctctgatgattttgcttcatcgatatcttccagtagagggtcctttgctcgtgatctactgcactccagagtttcttttcaagatggtgggccacttgggaaagttaaatacactgtgacatgctattatgcaaaaaactttgaagaactcagaaggtcttgttgtccatcagagcttgattatttaagatctatcagtcgatgcaagaaatggggagcacaaggtggcaaaagtaatgtgttcttcgcaaaatctctggatgatagatttattataaagcaggtcacgaaaacagagcttgaatcattccttcagttcggcccagattattttaagtatttgtcagagtcagtaagcactggaagccctacatgccttgcaaagattctgggaatctatcaggttacaattaagcatctgaaaggtggcaaggaatcaaaaatggatttgctcgtgatggaaaatctcttatttggacggaatattacgaggctttatgatctcaagggatcttcaaggtcacggtataatgcagactccagcaggaacaaggtccttcttgaccagaacttaattgaggcaatgccaacgtcgccaatttttgtcgggaacaaggcgaagcgccttcttgaaagagctgtttggaatgacacttcttttctagcaggaattgatgtaatggattattccttgcttgtgggtgttgatgaggagaaacatgaacttgtcctgggaataattgatttcatgaggcagtatacatgggacaagcaccttgaaacatgggtcaaatcttctggcattcttggtgggcctaagaatgccgctccaactgttgtctcacctatgcagtacaagaagcggtttaggaaagcaatgtctgcttattttattgtgattcctgagcaatggatgcctgcaataatcaatccagaccaatcatcgtcaaatatttgtgaggacgattctcaaaatgcttcaccagagtagcacggtgttctgtgcgttattaatggacggaggttgctggatttggtcctactgcagtcatgagaaatactgacctgatgagttttggtactcgggcggcactgaaatgatcttctggctggacagtttatactcttgtggtcatttgcacagatcgaattc

SEQ ID NO: 283 - DNA, 1102 bp, Hordeum vulgare
ggttagtcgttcgtttgcttgttgggtgggtggctgatccgggatggaccgcctgctgctgccggtgagggtgaaggaggagtggccgccgccgccgcctccggaggaggaggaggaggagttggaggagcaccggggcctggcgccgcggccgatggtggggctgcacgagacggggccgccgccgttcctgaccaagacgttcgacctggtggccgacccggccaccgacggcgtcgtctcctggggccgcggcgggaacagcttcgtcgtctgggacccgcacctcttcgccgccgtgctgctcccgcgcttcttcaagcacagcaacttctccagcttcgtccgccagctcaacacctacggttttagaaagatcgatccagacagatgggagtttgcgaatgagggtttcattaggggccagagacagctcctaaagatgataaagagaaggagaccattgtcttatctcccttcatcacagcagcaggcccttggctcctgcctcgaggtcggccagttcggattcgacgatgaaatcgaagtgctaaagcgcgacaagaacgccttactctcagaggtggtgaaactgaggcaggagcagcagagcacgagagctgacatgcgagccatggaggagaggctacaccgggcggagcagaagcagctccagatgatgggtttcctggcaagagcaatacagaaccctgacttctttctccagcttgtccagcaacaagataaactgaaggacctcgaggacccttacccaacgaagaggaggaggtccatcaacgtaatgccgttccttggccctgaggggacgagtcagagtgagcaactcgagtccacattcatttttgaggacagggaattttcagagctggagaatttagcaatgaacattcaagggatcaggaagggcatggaggatgacaaaggtggtcggagtcagggctgcggtgaggccgagctgactgatgacttctgggaggagctgctgagtgaaggaatgagggatgaggctgagatgctagagctggaaaggaggagatctagatatgtcgacgcgtagcgcgaaagctgggtcgtctaagta

SEQ ID NO: 284 - DNA, 1092 bp, Hordeum vulgare
attccgaatcccatttctccaacccaatcactcctcccccctcccactcctcacccacggcgaggagacggacaggcccgccgctgctgcaccgtccggcaggggttgccttgatcccttcctccattatcgatgggggacattgccaaggacttgacagccggaaccgtcggagggatcgctaatctggttgttggccacccatttgacaccatcaaggtcaagctccagagccagcccagccctgctccaggccagctacctaagtatgcgggcgcctttgatgctgtcaagcaaacagttgcggctgaagggccgaggggattgtataagggaatgggggctcctctcgctaccgtcgcagccttcaacgctctcctgttcactgtgaggggccaaatggaggctctcttgagatcggagcctggggtgccattgacagttaagcagcaggttgtcgctggtgctggtgccgggcttgcggtctccttcctggcatgcccaacagagctgattaagtgcaggttgcaggcccagagctctttagctgaagcaggtgctgtctccggcgtggcgcttcccaaagggccaatggatgtggcaaggcatgtcataagggacgccggcttcaaaggactgttcaagggcatcgtcccgacaatgggccgtgagatccccggcaacgccataatgttcggtgtgtacgaggccgtcaagcagtacatggccggcggccgggacacgtcaggcctcggccagggctctctcatcctcgccggggggctcgccggaggggcgctgtggctcacggtgtacccgaccgacgtcgtcaagagcgtgatccaggtggacgactacaagaagccgaggtactccgggtcgatcgacgcggtcaagaagatcgtcgcggccgacggggtcaagggcctgtacaaggggttcggccccgccatggcccgcagcgtcccggcaaatgccgccaccttcgtggcctacgagatcacgcggtcggccatgggctgactgacccaaggtcctggcgccgccctccgtttcttctccgacgcggctgaagcggcattaagcggataa

SEQ ID NO: 285 - DNA, 1384 bp, Hordeum vulgare
taaacctcctccgctcttctccccccagccgcctcgccgccgcccgccgtccgccgcccgccgcccgcgatggaggccctccacgaggagacgcccttcgacctctccttccacccctcgtcgcccctggtcgccacctccctcatcaccggcgagctccacatgttccgctacgccgacggtctgccgctcgagaggttgttcgcagaaaaaccccacaaggactcatgcagggctgttcgatttgtggactcgggaactgtgattctgacggggtctgctgatatgtcgattgtcgcttctgatgtagaaacaggcaaagtcattgcccgtttggatgatgcacatggtgacgccataaaccgccttgtgtgtcttactgaaactacagttgcttcaggcgatgatgcgggttgcattaaggtgtgggatactcgacaacgatcttgctgcaacacttttcaccgccatgaagattatatatcagatatgacctatgtagctggctcagatcaaatattggccacaagtggtgatggaactttatctgttaacagtctccggggtaacagagtaaaatcgcaatctgaattttcagaagacgaactcctatctttggtgataatgaagaatggccaaaaagttgtttgtggaactccaagtggagccctgttgttgtattcgtggggacattttaaggactgcagtgaccgttttctggggcacgcacagtctgttgataacttgctgaagctggacgaagaaactctgatatctgctgcagcagatggcgtgatcaggttggtgggtatcctaccgaatcagataatccagccattggccgagcattcagaatttccgatcgaggcgcttggtttctcgcatgataggaagtatctaggcagcgtttcgcatgacaaaatgataaagctctgggacatggaagaactcctgggcggcccgcagttgaatcatcagaacgacatgccggaagccactgcggtcgccgttgaccacgacgacgagctgcctgaagccaacgccgccaacgctgtccaacacgaggagttgcctgaagccaacgttgccgccgtcgatgacgaccagttgacggctcaggccgacagcgacgacgatgggatggacgtggacatggagccgagctcttccaacgggtcgaggagcaagaagaaaggcaagggcaagaagctgaacggattcgcgccggacttctttgcggatttgtagggcgggcagacgcaccgccgggcaagaagctgaacggattcgcgccggacttctttgcggatttgtagggcgggcagacgcaccgcccttgaaattcgcgtcgggttgactttgcgaggtttcgatgtttaggttg

SEQ ID NO: 286 - DNA, 1945 bp, Hordeum vulgare
caaccagcaccccagcagcgcgcgcggggcaatggcggaccccgtcgagctcgtgcgccgcctctgcctccgtttcccgccgcggctgccgcctccgcggcgctccagggtgccgccgccacagtcgcgatgcctcgtcagggctcgcctccgcctccagcgctctcccctgtcgctccggtgccgcgcgctcgacgccagcaagtcgtcggcggtcaagggggagccgagcgaggagtacgacgatgatgacgaggagccgtacttttccgtgacatcgtcgaggctgtcagaggtggactacctcggggagagcaccaagggggatttgaacgtgcgcaggaggcacctcgatgcgctcggtgggaatggaaagtcaacattgcatggtcctatagaggagatagcttggaaagaagcaagacaagctgaaacgttgctcagtgacctgggaattgcagatcctttaacagtaaggaactctcctcgtggaattttctgcaccagaacactaaatcttcgatctatcagtgtcattggctatgacatggattatacattgattcattacaacgtcatggcctgggaagggcgggcatatgattatgggatggccaacctgaagagcatgggttttctagtagatgaccttgaatttgatcctgacctggttattaggggtcttattatggataaagtaaaaggaaacttggtaaaagctgaccgttttgggtacatcaagagggtcatgcatggtacccaaatgttgcccactcgtgctgtgagtgaaatatatggacgagagttggtggacctgcggaaagaagatacgtgggagttcctcaatacccttttctctgtttcagaagctgtcatgttcatgcagatggttgacaagttggatcaggggttggtgcctgctgaacttgggccactggattacaaagggctgtacaatgctgtttccaaagcactctttcgagcacatgtagaaggtcaactcaagagcgaaataatggctgagcccgagcgatttgtagagcctgatccagaactgcctctagctcttctagatcaaaaagaggctggaaagaggttacttcttattactaactcagattaccactatacaaacaaaatgatgaatcatgcattcaatcgctttcttcctaatgatatgggatggagagatctatttgaaatggttatagtctccgcaaggaaaccagagtttttccaaatttcgcatcccttgtatcaagttgtcactgacgatggattattgcgtccctgttttaaagcaaattcaggtggcctgtactctggtggttgtgctcagatggttgagaagtcactagatattcatggagatgaaatattatatgtgggggaccatatttttacagatgtcagccaatcaaaggttcatttacgatggaggacagcattaatatgccgtgaactggaagatgagtttgacgcactaatccaaagccatggtcagaaagaaaagcttgtcacgctcatacagcaaaaggaaattgtcggagaccttttcaaccaacttcgcctggctcttcagagacgcataaattcacgtcctgcacagacgcttgctgcaacttgtatgaatgaccaggagcttacagaaagtatgcaaaagttgctcattgttatgcagagattggatgaaaagatcgtgccattgctggaatcagatggagaacttttcaataaaagatggggttggctgtcacgtgctggcctatgggacaagagtcatctaaccaggcaaattgagaaatatgctgatatatacacatcaagggtctcaaactttctacactatactccattcatgtatttccgatcacaagaacagacgcttgcacacgatgtccattcttattctcgcggtcaataatattggtgccaacgggcttaa

SEQ ID NO: 287 - DNA, 584 bp, Hordeum vulgare
gcgccatggagactctggtcatctcgcagcagcgcagccaccaccaccaccactctggtcgccggaggaagccatccccgcactactcgtcgcctcagcccatgcgtggctaccacgccttcaactgccgtgccttccactccagtatcagcatcggcatcctgccgtccccacccccacccccagccccgcctgcaccccgggctcggacctactccccggagcccaagacgcccaagcagcagctgcacaacggcaaaaagcgcagccgggcgatccctataactccatcaggatctcctccttcccgtcctgagctttgggctggcccggcatactccaactcgccgccacccagctcactgccgattcccaagttctcgctccaccagaagcgcagtgtatcacttgagttgccacctgctgacaggacagagcatgtggaggtgcttgtgcatgccaagtcagcaccttcgacacccactgctggctcaggatttggcttctttggtgagaatgatactgccattgccacggagaatctgaggaggatccttaatttggaaatcaccgaggactgatga

SEQ ID NO: 288 - DNA, 1069 bp, Hordeum vulgare
cttactctcctagcccgttcgcccacccgccggatcccgtcgaaccaaaccctatcccacccgggacggctcgccgtcgtcgccatgccccgccgcagccagagcagtgaccccatcgacctcgacgaagaggatgagtgcaagagcaagcgttctcgagcgagtataaggcgagcaccgaagatgcctgggagctcaaatcgcattgcaagtagcagaagggacaaggaaaatcaagacaaactggatacccgtatctttgatttatacatggaggacctttggaagcgtacagatgaagatcagaagaatgcttacgcatatttggatccgttatggtttaacagttatgtcaatgggggcaatgaacagaaatcaagaattcttagatggacaaagaaactgaaaatattttcaaggaaatatgtgtttgtccctattgttctttggggacattggaacctccttgtcctatgccactttgatgagacagactgctcggatgcaaaaaaaggaccgcgaatgctgctgctggattcacttaacacaacagatccaaagaggctgggacctgatatcagaggattcattcgtggtatttatgaaatcgaagagcggaaagaaagcgcgcacttcatagaaaaaatccgtctcgagtttcctaaggtgccacaacaaaatggggaggaatgtggtatatatgttctttactttatcaactgttttcttcaaaacggaaaattggcagaagttcttcagaataaaacactggaagaagatttcaaacagctgtttgatgatggcacgtttgatccagaggaactagagaacttccgcaaggatgttcatgcattccaagtagaaaggagtaccgaaaccggacagtaggtggactgtagcattgtgctgcatatatgtagttagttcttacaaggcagtggaaaatttcatcttcgctggtggtgaattctgaggaagcttgaaggtcgtggagaagctggtggtaatatacagcttatgcagccgagagaaagccgacaccatggagctttgtgacagttagcaggtg

SEQ ID NO: 289 - DNA, 1582 bp, Hordeum vulgare
aaaggatccaaccctagcctagcctaccctcgcccgccccgccatggcaagtcctccttgcccgccgtcaccgctcgccagggtgcggctcgacgacgtggcgccccacgacggcgcggccgccccgggctacgcgcgcgccgtcggcgccctcgccgcctcgctcgcccgccgcggcgccgccgtgctcgagctccccgcggcggacgcggccgtcgtccgctgcgccctcgagtccgcccgcgccttcttccgcggccgccacgccgcctacctctaccgcgccgggaggactttggaagatggagagttgtcccctgcttgcatggctgatgctttcagatgtttgggcaaagcagcccgggccgccctctgtgcaatagcacggcacctgcgcctgcgtaccgatgtattcaaccaattacttgatgatactccactgccggttaacgagatctcctcatctgagttgctggtgtcatattctcacgaacagctccaaagtggtcaggcactcatgggatgtcccagcaggtcctcaatgcctcaagttgataggggatttgtaatgctagttgcttccgattgtccaggaattgaggtttgtgacccaaatggccattggtacatagctgatggggtttcaggcccaaataatctattgcttctgactggaagggccctaaatcatgttactgctggtctctgcccaatttcccactacagggtcaccaatgagaatagggcatcactcacctttaggttggtgcctcatgccaacgccatattggattgctctccaattttagctgctgggcattgcatacgacaggtgtaccaacccatacctgcaagccaatttatggatgattcctgtgccgaagaacatgctgtttccagtcacttggatgaaccttctgaatctcagggcaactttgttagtgacccatcactgagaagtgtcctgtcagaccctctgtctgggtcatttcttgaagatgccatggttctccaatgtgggcactcatttggtggcctcatgctgaagaaagtcattgaaatggctaggtgcaccatttgcaatggagaagttgacccatcctctttgttccctaatctcgctttgagagcagtagccacggtggtgaagatggaggatgataggagactgtttcataacgctgctcttcggaagcgcaggaaagatgtgaccgagcatacagatgtgccaaagcggactgggagtagcaaagacaacaatgagcttgctctggatgctggaagcccggtggcattcaagggagtgcagtacccttttgtagtgggcgagagggtcctgatcatggggaacaaaaggacgcccgataaattcgtcgggaaggaggcagtcatcacttcgcagtgtctgaatggctggtatcttgtgaaggcgctcgacagcggagagagtacgcggctgcagtaccggtcactgaagaaagtgtcggagctgcaactacagacgcaagcgaggctgcagcccctggcatttctcggaggcagatgataagagatggtgatgaaggatcatgtggaattcttt

SEQ ID NO: 290 - DNA, 730 bp, Hordeum vulgare
ggaggctggtccatcgagcggccgggactgacatgaggccgccgtcttcttcttcttccatcgttgccgccgctgcaacagctccctcctcctccactgctccccctgttgcagtcacaaccaggagagcacttctcttctccacctcgttcatcgcgctcgcacctgctgcagcagctcaggccgccaacccctcctccacgccctactcccagtccaggaccctgcagatcggcctcgacaccaacgggaagattcggacatgcccctccaccaatcccgggtgcgtgtgcaccaaccccaccgtcggcgcctcctcctccgtcgcctccccgctcatcatcccggagtccacctccgccgacgctgccgcccagttgttgcggcaagccatcctcaagacgcagaagaatgtcagcttcaacgttgatcagcaaactcccaatggccagtacatccaggcggaggtggacggtggtttcggccgggacgtgatggagttccttgtgaagaaagacgccggcgtggtggcctaccgctgcgtggccaccaaggtcacctttgtctaccccttcaccaccgccgtcggcgactcgcggggacaggagcagagggtcgccgccgtcgcgcaggagctcgggtggtacgcgcccgacataagatcctccgtcgacgacgttgctacgtaatcaagctacgtaacgcgccgactgtgagatgcgtttcaaga

SEQ ID NO: 291 - DNA, 955 bp, Hordeum vulgare
gcggcagcatgagctctgctggttctgcaaggattccaaagaggagacggactaccaaggcgtcggaggctgcagaccgacaacttcgggagcgacagtttccggacctgaacttgcttccagtggttgaagcactcaatactgggggttcactctccattaatgagcctgtctcacacaggcagcccccccctatggtggttagcctgggttacgagaccacacaggtcgtggtgtcatctgctgctgcagggtcaaacattggcatgaatagtttccccatcaacgtggaagtgattgatgatgatgttgcgatttatacctcagggccgccccctcaagcaaggcaacagtcgtccaggacaggacctatcactgtgataatagatgatgattctgaaactactgctggaccagcaggggaagctcttgatgagcatgtgaacactctgctgtctctgggaatgaacccgaggcacaatccctcgagagcacaacccaacactgaccttgtaataaacatagtagacatacctgagaccaacaacacaccgcccaaggtggcccaggctgcccctgaacctgtgaaggagatcccaaaggaaacaaagttcagctgtccagtctgcatgaatgagctggtcaatgcatcatcgaccatctgcggccacatcttctgccagaagtgcatcaaggcctccatccaggctcagaagaagtgccctacctgccggaggaagttgaccataagcaacttccaccgggtctacctcccgatggcagataattaaaacttatccagccattcttggagcattagagccgatggcagataactaaaacctatccagccattcttggagcattagagccgtggcagctgtgacccttttttggcaccggcattgtggtgattgtatctgagctattcttcacagggtcatcatgaacaatc

SEQ ID NO: 292 - DNA, 752 bp, Hordeum vulgare
agggcatggagagcgaaggcagcacgagcgccaacggcggcgccgcctgcgcggtctgcggcgggtccgcggccttgtactgcccggcggacgccgcggcgctctgcgtgccctgcgacgcggctgtccactccgccaaccctctggcctcccgccacgagcgcgtgccgctggcggccgccgtggccgtggcggcgacctccggcgtgtacgacggcctcttcgcggctgacgacgaaggcgcggcgtcctggccgactccggtgcagggaagccccaacagcggctcgtctggcttcagtaacggcagcggcgtcgaggtgagcctgtttgacctgctctccgacgtcgacctcgtggccaccggcgccggcgggagcgtgtcttcggacggtggcgtcgcgccgttgtggctgcagcctggccttgtctctgctgcgtggaactcctcttggtcggcgtcagaggccgtggtcgtcccgtcgccggcggacagggcggcgagggtcatgcggtaccgcgagaagcgcaagaaccgcaagttccacaagaccatccgctacgcctcccgcaaggcgtacgccgaggcgcggccgagggtcaagggccgcttcgtcaaacgccctgccgcggcggcgacggacgacggcaacacgagcgccgccgaggccgccaaattctggctctccttctccgacaacagcgtagggtttcacgttgcttcccatggagtcgtgccaagcttctagtag

SEQ ID NO: 293 - DNA, 437 bp, Hordeum vulgare
caagcatggaggccaagaagtcgccgcccacccctgcctccaccggatcggcggcggcggggaacggatacttcagctccgtcttctccgcgtcgcctgcggcaaatccaagagacgccaggcagatggacctgtacacgatgctgaacaagcagaaccccaaagggcagagcggtgggggcactgcagatggcaaatcccaaggaagccctgctaaaggtcgtgttgcttacaaagatggaaaacaattttacccaaacgagtcctcagagtcgccttattttggttcgtctgtgcattacggcggccgggacttctatgacagctctccacacaagcaggccaatgaatcatcgagaaattataaggaggataacacggatggctccctggctaccagaggtgattggtggcaaggttcactgtactactaataa

SEQ ID NO: 294 - DNA, 644 bp, Hordeum vulgare
cacccatggcgacggctatgatggctgcagccaccacctcctgctccccgcgccgagcgctcctcaagccagtggcctcctccagctccgcgccgccgcccaggccgcagccacggtccttcctcaagcagctcccggggctggctgcgacggcggcggcggcagccgtcgcctccgtgcccctcccggcgctggccgtggagatggagaaggcggcgctgttcgacttcaacctgacgctcccggcgatcacgatcgagttcctgctgctgatggtggcgctggacaagctctacttctcgccgctgggcaagttcatggacgagcgggacgccaagatccgcgcggagctcggcggcgtcaaggacgcgtccgaggaggtgcggcagctggaggagcaggcccaggccattctcaaggcggcgcgcgcggagatcgcggcggcgctcaacaagatgaagaaggagacgaccaaggagctggaggcgaagctcgacgagggccgccgccgcgtggaggccgagctcgtcgaggcgctcgcgagcctcgaggggcagaaggaggaggccatcaaggcgctggacgcgcagatcgtgtcactcagcgacgagatcgtcaagaaggtgctcccatccgcgtgatga

SEQ ID NO: 295 - DNA, 1087 bp, Hordeum vulgare
gcggaaagagagaaagcgtcccccaccccgcgcggatcccgcgaccgggcccatgtccccctcgacactgctcgtccggccaccggcgccggcgaatccgtcccttccgcctcgtcggtgcgcgcccgtatcagcagcggcagcgacgctccgcacgtctcctgccgcctcctccgtggctcacttctctaggctgcgaaccaagtgcaggtttgctgcccccggtgtgagagaagattactcttctacgccaatcgatgtcgtagccgacgtgaaaacagagaagattgtagtcttgggaggaagtggatttgtcggttctgctatatgcagagctgcagtagctaaaggcattgaggttgtgagtctcagcaggtcaggaagaccgtcttactctgatccttgggctgatgaagttacttggctagcaggagatgttttctatgcaagatgggaggacgtactagtaggggctactgctgttgtgtctacccttggaggatttggtaatgaagaacagatgaaaaggataaatggtgaagcaaatgccatagcagtagacgctgcaaaagaatttgggatcccgaaatttattttgatctctgttcatgattacaaccttccatcctttctccttacctcgggctatttcactggtaagagaaaggctgaatctgaagtcctctccaaatacccatcctcaggtgttgtattgaggcctgggtttatttacggtaaaaggaaagtagatggctacgagataccgctcgacatcgtagggcaaccacttgagaagctactttcgtctgtcgaaaatttcaccaaaccattgagtgcattgcctggttcggacctggtcctcgcaccccctgtgaatgtggaagatgtcgcctacgccgtgatcaacgccgtcatagatgacagcttcttcggcgtgttcacaatcgagcagatcaaggaagcagcagccagtgcgagagtgtagagatctgcatatctggaagtaccttacggagttatgagggagcagtcatgttcttgcaaatcttccataatactagtggatagctcaatgccgaactcatag

SEQ ID NO: 296 - DNA, 1607 bp, Hordeum vulgare
ccacaatccctctaacgaccccccgcccccgagctcgcgaatcacccgaagccgccgccatgggcgactacggcaacgcgatgatgcggaaccaggatgcgggcgtgcagacccgtgtgaaggcgcagagccgcgccaacctcctccagctcaagctcatcgggcagagccatccgacggggctgacgacgaacctgctgaagctgttcgagccacggcctccgctcgagcacaagccgccgctcgagaagcgcaagttgccagcttacactgggatgtcgcagtttgtatcgcggttcgcggagcctggtgacccggagtatgctccgcctgtccccacgtgcgagactagggctgaaaaaaaggatagaatccgccaacttaagcttgaggaaggtgcagctaaggttgctgaagagctccagaagtatgacccacaaaatgaccccaatgtcactggagatccatacaaaacactctttgttgcacgacttggctacgagacatccgagcagaaggttaaaagggactttgaagcttatgggcctattaaaagggtacgactcataactgaccaggtaacaaataagcctagaggatatgcattcgtagagtatgcgcacactcgggacatgaaaagtgcttacaagcaagctgatgggagaaaagtggataacaaaagggtgcttgttgacgtagagcgtggtagaactgttccaaattggcgtcctaggagattgggtggtggacttggatcaagcaggattggtggtgaagatgctgcccagaagcattctgctagagagcaacagaacgctgctgggcgccccagatcagaagagcctaggagggatgatcgttctgcagatcgggatcgcgagaaatctcgtgatagggtacgggaaagagatcgtgacgagaaaactcgtgaacgctcgcatgacagggctcgtgatcgtgatccaagggaagatagacaccaccatagagatcgtgagagaactcgtgatagggatcgagaaagggaccaggagagagaccgtgggcgtgaccgccgtgatagggataggcacaaggatcatggccgggatagagaccaggacagagacaggaaacgtgagcgctctcatggcagaggcagggaccgtgacagagattacgagcgtgcaagtcacgaacaggaccctggcagggaccgagattacaagcgtgcgcgccatgaacatgaacgtggtcacttgcaggcgagtgatgctgattatggtaatggtgagcctggctataaccagcatgagcaccacagaagtcatgaacagtatggttatggcctagatggacatgatcgctcgaagcgacatgagcattaccgtgatgattcacacagtaaaatggcaaccaaccatcaggggcaacctgaaaatgcagaacctgcagtccccgaggagggggaggcatatgaagaaggggactaccagcatatccaagcgggtgaatacaggaactaaaaacttgaaagctgtgtggtaaggcttattaatgcagtaaaaatatttgcatcagttttgctgttcccagtggttctctcgttgcttagggagtaggaattc

SEQ ID NO: 297 - DNA, 338 bp, Hordeum vulgare
gttccatggccgggctgcagaggtcctcactgacattcaggaggtcaggatcatcaggcatggtctggggcgagaggctcatgtcggatgaacatagccagtggacctcaggggagccagaattcagggagctacggcactcccgcagcgtagggtccgtcggtgcgcagcgcaggcgcaacgacggcaccgagcatggcggccaggcattccggacacggcgggtagcccctgccatagatccaccatcgcccaaggttcctggctgcatcttctgtgggattttcaggaaggcaggaccttcgcagccatctaaggccagaaggtaccactagtag

SEQ ID NO: 298 - DNA, 806 bp, Hordeum vulgare
cggagatgagcttagcacttctagggggctactcctccgccgaggacgaggaccccgccgccgccgagctcagcgactccggcgactcatcagccgaagaggccggatctgacggggacgagaagtccgctccaccgaagccggctgcaaagccccgcccccgcgtaaaccctagccccggagatggggactcctcgctgccctcggcgctagatgtcttcgccgagatctccggccccccggctttcctcaaccgcagagtggcccagcccgaggaggtcggggaggcgctcggcgtgctcgatcgccgctccaactccaagcagaggagaaagccgccacctcccggtgcggttgtggcggcgaaaccacagatggttgccatccgtgaacgagttagcagtgacgtgaagaatggtgccaatcctccagttgctgttctgtcggcgaaaccacagttggttgctggtcacgaacgagttagcagtgacatgaagaatggtggcaaccctccaggttctgttgatggaaagaggaaaataggcgctgcaaatcctggtccagaagatgctgccgagcttctaagaatgtgcctccaatgtggtataccaaagacctattcacacgcccaaggaatggtatgccctgtttgcaacgatagaccagtgcaggcaaaagaacccgagaagaagaagggttctgctgtcaaggacaaggagaaagtgaagaggatgagagggcaatcgtcacatgcatcgtggaagagcgagactgagatggctctgcggcaacagttcgactaataa

SEQ ID NO: 299 - DNA, 819 bp, Hordeum vulgare
acacaaccatcaagatcggagcgagcggccatggggcggtcgccgtgctgcgagaaggcgcacacgaacaagggcgcgtggacgagggaggaggacgagcggctggtggcccacgtccgggcgcacggggaggggtgctggcgctcgctgcccagcgccgccggcctgctgcgctgcggcaagagctgccgcctcaggtggatcaactacctccgccccgacctcaagcgcggcaacttcagccgcgacgaggacgagctcatcgtcaagctccacagcctcctcggcaacaagtggtcgctcatcgccgcgcgcctgccggggaggacggacaacgagatcaagaactactggaacacgcacatccggaggaagctgctcggcagggggatcgaccccgtcacgcaccgccccgtcaccgacgccgccggcaccaccgtctcctttgtccacccagagccgcccaaggcggagccggtgacggaggagagcaagccgcccaggtgcccggacctcaacctggacctctgcatcagcctgccgttccaagaggttgaggaacggccgccggcgagagcatgcgcgaagccggtcaagatggagcagctgcagggcggcggcggcggcctctgcttccgctgcagcatcctacgagtgagaggagcggcgacggagtgcagctgcagcagcaacttcctgggcctaagggccggcatgctcgacttcagaagcctcgagatgaaatagaaatttgggaataattattccatcaaactttctgctgtaaattgttgctccctccctcctaccaagttttag

SEQ ID NO: 300 - DNA, 1325 bp, Hordeum vulgare
gcgccatggcggacagcaggccggcggcggcgccgctgctatcgccgcggaagaagccgtcggcggcgcagtacacccggagcgcgtcgcacgcgggggacgagctgcgcagcttccgggcctgcctccgctggatgtgcatcgaccacacggacgggccgcgctccgcgggctcctgggcggtcttcttcctgctcgccgtcgccgcgcccgccgcggtcgccctggcgctcccggccacggccccgccgcggccgctcgacgggcaggtgcaggtctccctcaccctggccgccacgctcgccttcctctccctctgctctctgctccgggtcggcctccgccgcctgctctgcatcgaccgcctccgccacgactcggacgaggtgcgcgccgggtacaccgcgcagctcaaccgctccttccgcgtcctcgcctgcttcctcgcgccatgctccctcgccgacgccgcctacaaggtctactggtactgggccgccgcgcccttccgctcgccatggtggaacgcggccgcatgcgcgctcgaggccgcctcctgggtctaccgcactgccgtcttcttcatgatctgcgtcctcttccgggtcatctgctacctgcaggtgctgcgcatggtcggcttcgcgagggagttcggcaggttcgccgacgtcgccgtcgttctcgagcaccaccgacggatcagggaccagctccgccggatcagccaccggtaccgtcggttcataatcttctgcctcgtgctcgtcaccgccagccagttctccgccctgctcgcaaccaccaggccacatgcgcggatcaatatcgccaccgccggcgagctcgcgctctgctctgtgagcctcgtggcggggctgctagtctgtctgcacagcgcggccaagatcacgcacaagacacaggccatcacgagcgtggcggcggcgtggcacgcggacgccaccatccacgccttcgacaacgacctggaggaccccgatcccgccctgcccgccgccaccgggtacctggcgccggccaacgcctaccgggtggcccccggcgaggagtccgacagctatggggacgacgacgacgccatgagcgagggctccatcgacgactccaagctcgtgccgttccaggtcaacaacatgagcttccagaagaggcaggcactggtgaactacctggagaacaaccgggcgggcatcacggtgtacggcttcgtcgtcgaccggacatggctgcacgcgctcttcatgatcgagttctcgctcgtcatgtggctgctggggaagacggtcggtatatcttgatga

SEQ ID NO: 301 - DNA, 967 bp, Hordeum vulgare
actctccacagccatggacgccgacgccgacacggtggtgttcgaggcaccggcgcacttccgcttctacaagagcggcaagatagagcgccttcaccggcctcccatcctcccagccggagtcgacgaggccaccggcgtcacgtccaaggacgtcgtcctcgacgcggacaccggcctctccgtgcgcctctaccttcccaagctccaggacccttccgcgaagctcccggtcctcgtctacttccacggcggctccttcctcatcgagtcggccgactcctccacgtaccacaactacgtcaacgccctcgccgcggcggccggcgtcctcgccgtgtccgtcgactaccgcctggccccggagcacccgctccccgctgcctacgacgactcctgggccgcgctccagtgggcggcgtcggcgcaggacgactggatccgcgagcacggcgacacggcccgcctgttcctcgccggcgacagcgcgggggccaacatcgtccacgacatgctcatgagggcggcttccaaccacagcagcccgagggtggagggcgcgatactgctgcacccgtggttcggcgggaccaagccggtcgagggggagcacccggccgcgtgcatggtcaccgggatgctctggtcctacgcgtgcccgggcgcggtgggcggcgccgacgacccgaggatcaacccgctggcgccgggcgcgccggcgctggagaggctcggctgcgtgaggatgctcgtgaccgccgggctggcggacgggctcgccgcgcggaaccgcgcgtaccacgacgccgtggccggcagcgcgtggggcggcaccgcggcgtggcacgggtccgatggggagggtcacgtgttcttcctcgagaagcccgggtgcgacaacgccaagcagctcatggaccgcgtcgtcgccttcatagccggtgcctgatagagagttggtctgcag

SEQ ID NO: 302 - DNA, 454 bp, Hordeum vulgare
attgacagcccaccttagcagctaagccagcctcgcatcccaacaatggcgtctcgcacagccgtggtggtcgtggccgtgaccgcgctgctgttcgcggcggcgtccgcgcaggagatggacatgggcatgccgccagcgccggccccggtcacgggcgcggccgctggggccgcggcctcggcgctggccgtggcctgctccgccgtgctgtccctgctcgtcgcgggcgggctcgcgcactaggcggcgaggaggtggcggtggcggtggcggtggactggtggtgcgtcgacgctcgtccggcgacggtcgcttcgcttcttgagctttagggggggtcagtagtaacgggtagtgatgggtcgtgttgtgttcgtctgagtggggtatgactctgttgcttacttctattcttttgtatcatacattgctgcgtgtattatttccgtct

SEQ ID NO: 303 - DNA, 477 bp, Hordeum vulgare
agaaacagaaggggccgtggggaacggaggagcgcggcggcggcggcaagggagaagcgatggcgaggggcgatagctgcttggcgcgcatcggcgccggagtcgcaatcggcggcgcggtcggcggagccgtcggtgctgtttatgggacttatgccgctatcagattgagggtccctgggttgctgaagatcagacacatcggacaagccactgtcggcagcgctgcagtattcgggcttttcctcggagctggaagcttgatacactgcgggaaaaattactaactcgcgtcaagtcacccctgcttttattaggttttaaaggattgtctgcgtaaagcatttgtttgatctttaaggaacattggagttctgctactatttactcggtcctagcttttgatatgtttgccttactgttgatgtggaaataaaatctttcgtcatctgtatgagaggtaggtggtgaaagcag

SEQ ID NO: 304 - DNA, 1695 bp, Hordeum vulgare
caactcgtgagccttcatcagcttccaaattcacggtgaccaatccttctcgggcctcggcggatctacgagggagccatggggaaaggcaataaagttgataggctcagcgcgttgcctgatgacattctggtcgacattcttgaccgactcaatgtacccgaggctgcaagaaccagcatcctctcaagacggtggagtcagctctgcgccaagctctctcggcttataataagtgctctggacttcctgcccgagggtgtgtcacgcagcagtgccgacatctctgacgatgaattggttcggatcaatgaagctgtggttcaagcgacaaatagcgtactggcgcgcagaaatccaggtgaacacaccatcgaccttctgtctacgacgttccacttgagagatgatctccccatatccatggggcatgctgttggtcatgccatagcgacacactcggtcaagaatgccaaattttgtgttaggacaaggaaggatgacgccgctgaaattgatgatgatgaagaaatggtcatctgggcgagagaattcatgttgttctttgatgcctgtccaattgcatttggtggtctcactactctcaacataggcaatttcagatttggtgaatcagacatatccagcatcctcaccacttgcaagcggctgaagcatatgcacttgtacaattgtgactctggtgattgtagcactctgcaagttgaacatgctaatctcagtgagctttgtatcatggattgtcgtcttgagcaagtaaagctgaactggctccctcaactcacacggatagtctttgacggttggatagatttccaagatccactggttcttggtcttgttcctttgctcgagtctgtaagcctcacaaatattgctatcagtgtcaacaagatggtcaggttaagttggtttcttagcagtacctctgtacgagttctgaagttggggtttagttctgaaaagatttgggtgcagccagaatgtccaacgcaaggtctggcatctgtgttccgccaactaaggtttgtcaacctagttaaacttcctgaagggtatgatctcacctggacaatgtttattcttgaagctgcacccttactgaaggagctatacatgacagtctgggatgatttgtgttcaatggaattggacgaggagaagagaaaaaatggatcgtatagtgagaacaagggcgtagaatggggctcggccgcagctgatttccaacaccacagtttggtcacactcgtcatctttggctttgaatctgaagattatgctgttaattatgtcagacgtgttatggtggcggcagtcaatctagaggatgtgttcctctatagtaggttggagttggagtgtggcgactgccaggacaagaagcccactaggttcgcctggacgaaaaggcagaagatttcactgaagaagagaatcaccgcggggattgagtcgtttgccataatccactccaacaagacaatacgagctgaccatgaagcaaaactgttttacccacagtgctcacactttgacacaacaagtggttgaattaacggtgtactgtattatcaacagtggttgctttgaacttttgtaagtgttttgttagtaccttggttattaagagttatcattttcttttggccgtctgaactgtattgttggttg

SEQ ID NO: 305 - DNA, 3513 bp, Hordeum vulgare
catataatttccttctccgctggcggcggcggcggcggaatggcggcggaggagccgtgctgcatctcgcacgccttcgaccgcgccgcgcgccgggaccccgcccgactcgccgtagtccacgcagtggccaacggcgagcgccgcttcgcctgcggcgacctcctatccgccgtctcctcgctctcccgccgcatctccgccgcgcttcctcgcccttccaccgaccaccgcggctgctcggatcgacacgggggaggcgccggcgcgacgcctagggtggtggggttgtacgcctcgccgtcggcggagtacgtagccgccgtcctcgccgtgctcaggtgcggggaggcgttcctgccgctggacccctcgtggccggaggacagggtccggtcagctgtctctgcctctaatgcggcgctagtcgtgtcggcaggggtctcgaatgaagacgatgttcttaagggctgcccttgccctgttctgcgattcagcggagaaatccggcaagggttatatgatggagaggttgggattggtggagatgggcttgcctggccgtgcgagcgtcggaggccatgggagttctgctacgtgatgttcacgtccggttctaccggaagacccaaaggggtttgtggaacggagaaaggtctcctgaatcgctttttgtggatgcaaagaaggaatcctttgtgttcggacgatgtgttgttgtttaagacatctgtcagctttgttgaccatcttcaggagtttctttctgctgtgttgactagcacaacactggtcattccccccattgattggagagctaatccaacatcatgggccaccttgattaaggcatatcgtatatcaaggatgactatagttccgtcgctgatggagataatactacctaccctggagaaaaatatttcatgtggatataactctcttaagatcctggtatttagtggggagattctgtccttggtgctttggaagagggtccgtgaaattatgccagagactactatcataaatttgtacggaacaacagaggtttctggtgattgcacattctttgattgcaaagatctgcctgcaattttagagcatgaagaaataaccagtgtaccgattggatttcctatagcaaattgtgaagtttttcttatgacgcatgctgggatggcagatgaaggtgaaatttgtgtcagtggagcatgtttattcaatggttatttagctgagtttcttaggagtaatcacactgaaggcagtgaaggttcaacatactacaaaacgggtgattatgctcgacggctgaaggctggtgaacttgttttccttgggagaaaggaccgtacggtcaaaatttatgggcagcgtttttcactagaggagatagaatccacattaaaggaacatcctgatgtcagtgatgctgcagttactttccaaagtaaagggtctccaaattacaaggcatacctggtgtttaggaataatgatgaaattgtgaaaggccgcccgcagtatagagaagtaaattcttctcaagatatcatggcatcaattcgaagttggctcattaagaaggttccaccagctatgattccaagcttctttcttccaatgaagtccttacctttgacttcgtcaggaaaggttgactatttcaagttatcaagtttggagtgtgcattggaaccatgtgaaatggagcaaattgactctggaagtggtccagttaatccacatttagaagttattaaaaaggcattttgtgacgccctgcttgttgatgaagtttctgagtttgatgattttttcactttgggtggtaactcaatttctgccgctcatgcagcccacaagttggacattgacatgagactgctttatatctatccaaccccttctaagcttttgcatgctttagttatggagcataataattcagtttctcctactgatgagcctcaccctaagaagggattgaatggatctgcaagcatacagagactgtttgactcaattgctgcaaatacgaatgacagttttcatgaaggcaaagcacagataaatggaaagcgtgcacattatcacattgcagggagttatggaaatggaacagatggccagcttagcaaatatccattctctcctaatgatagataccaggcaagtgacctcaacttggatacatgcttgaaggacagaaacagtgtcatggggagccagtggatcctgaacttttgtttacaaaaaaagtggtctattgggcgtagcaatagatttatgcatgactatgaagggaagttgctacttgaagattgttgctcatatgtttcatgcaacaaaagaggttatcttcaggaactttggaacattcctttggattcatgtgttgatgcctcacctttgcttgtcctgaacaatgggatgatgaacatatttattgggtcccattcacatttatttctctgcattgatggttgcaatggttcagtgaggtggagtgtcaaattggaaggacgtgtggagtgttctgctgctataactggtgatttttcagaggttgtggttggatgttataaagggaatatttactttcatgatatgttgactggtaaactgtcgtggacagttcaaacagatggagaggtaaaaatgcaaccagttgttgacaggacaaagaatttaatatggtgtggctcttatgaccatcatttgtatgcactaaattacaaagatcgttcctgcgcttacaaagtatcttgtggtggaagcatatatggttctcctgctgtggacatggcacaaaacatgatctatgctggatgtaccagtggccttgtgactgcaatatcccttgaggttccatcattcaggatagtttggcaatatgaagctggggcaccaatgttcagttctcttgccttcgatcatcagagtggaaatgttatttgttgcttggtgaacggtctggtgattgcattgaactcgcatggtactgttgtctggaaggcaactgttggtggtcctatttttgctggtgcgtgtgtgtcatctgcccttccttctcaggcgctgataccttcccgtgatggaagtttatactcttttgatactgcatctggtgatcttctttggtcatatgacgccggcgacccaattactgcatctgcttttgtggatgaagtgttagcatcaacgccatctggatcatcagagagatttatttgtatctgcacaagctctgggaagatccgtgtccttgggattagaactgacgctgagcaggagaaagatggttactctgtgcaagagtttacagccatggatcttcctggagacatcttctcgtcgccattgatggtgggtgggcgcatctttgttggctgcagagatgatcggctacattgtctctcgatcgcctcacatccataatctatttcagacatatccaggcaaactgttttgcttagtggccaatagaagaactagtggtgatgatgg

SEQ ID NO: 306 - DNA, 1056 bp, Hordeum vulgare
gatctgagttcaggcttgacggcttgatcatggaaggatccactcccacgatcacaaggatcgctgtggtcaccggcgggagcaaggggatcgggctggaggcgtgcaagcagctggccggcagcggcatcacggtcgttctgacggccagggacgagacgaggggaacggcggcggtggagcagatcaaacggctgggccactcggatgtcattttccatcagttagacatcacggatgcttccagcatcgctcggctggcagatttcctcaagacccgtttcgggaagcttgacatcctggtgaataatgctgctaccgatgggatcgagcatgtcatcaacccggtttatggtttgattcccggcgatgaaacgttcaatggcatggatgcgggccagaggatggattggatgtggaccacttgtcgacagacgtacgaaactgcaaagcagggcctgcagacgaactactacggcacaaagcgggtgacggaggcgctcctgcccctgctccgatcctcatcggacggaagaatcgtcaatgtctcctccaacttcggattgctcagctttttcaggaacgaggagctgaagaaggagctgaacgacgtcgacagcctgacggaggagaggctggacgagctgctggccatgttcctgaaggacttcgaggccggcgcggtggaggcgcacgggtggccggccgagttctcggcgtacaaggtggccaaggccgccatgaacgcctactcgaggatcctggccaagaggcatccggagctgcgcgtcaactgcgcgcaccccggctacgtgaagacagacatcaccaggaactccgggatcctgacgccggaggagggcgctcggaacatcactggcgttgcgctgctgccggaaggcgggcagaccggcaagtacttctccgaaggcgaggaggcatcgttcgtgtgaaaaaataaatcatctgtagcactactgttttgttgcgccaatctgtggtgggataataatctgtgagttgaagaataaagcaggtatgttcgtttggactacg

SEQ ID NO: 307 - DNA, 885 bp, Hordeum vulgare
agctgagtcgggatgggcggcaccagcaccagcaccttcgtcatcaggtggatcaacttcctcaccatgatactggcgatacttgtggtgggttttgggttctggatgagcacccacaatgacgagtgccgacggtcactcacgatccctgtcatggcccttggaggagtaatttttctcatatcgctggcgggattcgtgggtgcttggaagaacatttcctgcttgctttggacatatctaatcatgctgttcgtggtcctggtggcaatcatggtcttcacagtgcttgcgtttatcattacaaatactggaactggtcatgctgttgctgggtccaaatataaagagtatcgtcttcaggactacagctcttggttcgtcaaacagctcaatgacactgataaatggattcatctgagaagttgccttgtgaagtcggatgattgcaatagcttgtcgaaaagatataagactctaaaacaatacaagcttgctgatctgactcccattgagtctggctgttgccgcccaccagcggagtgtggatatccagctttgaatgcttccacttttgatttgagctatcatccggtgagcacaaacgtcgactgcaaactctacaaaaatgatcggtccctcaggtgctatgactgtaattcttgcaaagctggggttgcgcaatacatgaagacagagtggcgggtggttgccatcttcaatgtggtattgtttgttattttgtcattcgtatactttgttggctgctgcgcacgtcgacatgctgggggtagcgattctaaagttcctggaagatgactgtactttgaactttgaagtgaatcctctctatgattcacgtgtcacagcgagagttaactttgc

SEQ ID NO: 308 - DNA, 617 bp, Hordeum vulgare
ctaaaatggcaatggccacagcacggctaatccatccatgcttggtggtatccaagagcccaagaactgcaccaacacccttgctcctccacacccataagcccctgacctcatcgtttcacttcacgctccactccgtcgacgtctccaaggacgacaagccgctggacacggcgctcgagaccaaacaagaagatgcagccggcgtcggcgtcggcgacctgacgacgccactgccgggggagttggacgcggaggaggacgtgccgaagcttgacccccgccggttcgaggagcagttcgcggtgctgaacacgggggtgcacgagtgccggtcctgcggctacctgtacgaccaggccaagggagacccgtcctacccggtgcccccggggctgccgttcgccaaggtcccggacgattggcggtgcccgacgtgcggcgcggcgcagtccttcttcgacagcaagagcgtcgagatcgccgggttcgcgcagaaccagcagttcgggctcggcggcaactcgctcacctccggccagaagacgctactcatctacggaagcctccttgtcggcttcgccttcttcctctccggctacttcttgcaatgatga

SEQ ID NO: 309 - DNA, 586 bp, Hordeum vulgare
accctaggcaacaaggcagctcacatttcgctgctcaccgagccctcgaggcgcgctatccatggccacctactacccgtccggcgcttccgcgctcctgctccccgtcccgcgaacccgcgccgcctttccgcaggggtttcccggcccggcttccgggaggagctctccctgtgcggttgttcggcggcagcggaggggaaggggagcggtggtgggtgtcgtgcgagcatgcttcaatcctttcggggacgaacgcatcctccgggaggccctgaaggagccagttgcattcatgggtggtgtgtttgctggtctcttaaggcttgacctgaatgaggatcctctcaaggagtgggtaactcgaacggtagaggcttctggaatagctgaggagaacagtgccgaggaatcaaatgagggagctcagaatgatggaccccagcaaattgagattgagtgaggtgcattagttgccttttgccctcctttacagccttacttgtaacttatcctgaatatttgtaatatctaagcagtaaaatgcttgcccatattttgggttcatagtacaggttcaagttaa

SEQ ID NO: 310 - DNA, 1251 bp, Hordeum vulgare
gcgttcgctcaaactcaagccgcggcgagcggaagcggtgggcgcgcgacggcggcggcggttggccctctcgagtcatggtgctactcgccaccctctcgcgcgatgccggagctcacccgtgccctgcgcaggaattccagggggaagcagggccgccgcgcccgcgcaggccgtccgcgttctacagctctgtgttcgcgcagatcgaagaggtcgggtgggggcagctggtgagcgccgcaggcgatgatggcgtgtcgtgcctcaccttccgcgtcatggatgagcagcgacggcaccatttactggagatcacactgcccatgaactacccgacatgccctccttcaattgccgcggatgttccttatctccccaaattacagtggtcaaaaagctcaagactgaaggatgttctctgccagttccaagagcacctgaaggtattgcaagattactggtctacaatggatggcattgacaaggccctttgggttgtcgatcctacaaagccgacatatgctatgtctcatcgtcgcatagctttgggtgatgattgctatattttactacacgttgatgcacagaagcccaactctttaccagagtgccgcttcctaggcacagatgggaaactggaaaggctgataaagaattggagaaaaaatcgtaaaagatggagtgctgacaaaaagttccatgaaaacctgtcaaccgtcctagattttgcactgccgcaacccccttctatgtgcatcaaagatgaccagcaagctgattgtgggatatgttacgccacgcatctgccagtcgacgacgaactcgggactcagagcgggtgcgcggcggactacaagtgcgaaaaccctagctgcagcagagccttccactcggtgtgcctgagagactggctgcgcaccattaccacaacaaggcagtcgtttgatgttctgttcgggaactgcccttattgcagcgagcctgttgctgtgaagagcaccgacagctgaacttgggtttggcattcacaaattgaggcgctgagatcagatcatatgtttttagacaatgaccttcaagcagaagcaggtaagattccaggtttcagacgggccaataaaaaggaaggggggagaaatcagagacatctaggttgatgcgtccgtcaggtttgtgctaaaggcaggtcgtcatgacctataccgtcatcaatggagctgcaagaggtcgaaattgctgttggtttct

SEQ ID NO: 311 - DNA, 1730 bp, Hordeum vulgare
ctcacttcatccgtggaatctcgcccactttcccggctcagatccgagctcgtacgcgaaatggtgatcctttgtgctggccaccctgctccttcggttcattctgaatttctatctggatggctatcactcaacagctccagaaggccttaccgtttgagctcaaccggaaggaacatcagaaagcaaaacagacatcagcgggcgattaccttcgcaaaaagctcttcattacaagattcagtggcctctgtaaaaccatctcgtcttctgcccacagtagaaccaaaaacatttcccaatagtgtccctgatgagatgctatcaaaactcagattggaagaatctgatgcattttacatactagagctgtgcacaagtagagaacttagttcctctttgctagataagaactccgcgatcttagtctgcttaattgatgttgacggtgactccttgttacaaagagtaccagcaatctatggggaccaaccttcacatggcaccaaggcatcacaattcctcccctttcaaagtggttcagttgatatcattacctttaaaggtcccaaattgcagacaatcaaagaaatctggattggccttgaatcaggttcatggagattagatggtttaagtttgaaagtgatccatggagcacgggatacacctgaagatcttaagggaacactcgagctcaagttcagcggtttgcagtacacgttcgacaagctgagtgcgctgcttggtgaggagggagcttcagtagtggaagcaaggcctattgctgtcactgacctgtcaggaattagcatttctgaccttcaagagggacagctatcctcagcaaggacagcctcaagcattaaggaattgaaggaggatggactgagggagtacgctgatctcaaacaatccttgctgctttacgacatatctattgttataacaggtttctctgccttcactctggcttcgaatgatggggccgcctactcgttcctcgtcggcgggattggagggttcctgtatctattgctactccaaagatctgtggatgggttgccggcaattagttctacttcagaagtgagcagttcagagccctctgtgaatttcagtggcgtaagaaggccatggttgatattgtcgattgtaatggttgctggggctgttgcactgaagtacggtgctagtggtgacagctttgagctgactccaactgagctctttgttggcgccgcagggttcctggcgaacaaggttgctgttcttctggcagcattcaaacccttgcaaagtaatttggagagtgacgatggatccgtggactgatcttcctgacaatattgctctgaatatactaccatgctttttagaagggtgtaaaatgtaacaagaagtagcgtttcatagtagctcgacagcattcaagatctgaagctcggtatcgaaagtgcaggggacaagctcaggggtagaatggaaaggtgtatgcttgtcacttgagcctcttggtaacttcattccatcagcatgcccaaccacagaagttcatctcgtagcatccgtttgagagtcaatcaagaacaaaaggtatggttaataaaatcataaaatacatttctggctatagtaatgctactcaaactcgaattgttcagcttagcctatgcaaactcgagtacttggctgcgctcaaaggcatgtagaccgtgacacctggagat

SEQ ID NO: 312 - DNA, 654 bp, Hordeum vulgare
ctccattcacgtgccctaatcctcggccgcagctctcgtctccgtccgtccgcccccggaatggagcccaagaggtcctcgccccagccgcgcgcggcgacgactaagaagtcgcctccccgcgccgccgccgccgacgccgccggggccgactcgccgctcagcagcctgttccacccggcgtcgcacggggtaaacggcaaagagcaggacctgtacgccattcttttcaaagggcagaacggcaatgctcaggctagcatgacagatggtcaatcccagtggagtcctgctaaaagccgtacaacatacaccaaggataacaagtatgactcggttggcacgtcgtcttgttttggttcttctgtgcactatggcggccgagactattatggcagctctgcacctaagcaagccgcggaatacagtgattacaaggtggataagaaggatcctgtcgcagattctcatggcgattggtggcaaggctcgttttactactaagcaagtgcttggtgtcctctcccttgtcgaacaaggaaatcgaaggggggaaggtgttgtacctattttccttgatagcagttattataccttacatagtggagaagacattcgctcatcggtggtggcagtatttggacgcatcatcac

SEQ ID NO: 313 - DNA, 1157 bp, Hordeum vulgare
ctaacggcgaagctctctagctttcggcggctatggaggacgacgacgactgtcctcccctcgccgtcgagctccctccgcagaggacctctcctctggttcccgcttcctcctccgcctccgcgccggtcggcgtcaccgtcatcaccggctacctcggcgccggcaagtccacgttagtcaactacattttgagtggacagcatgggaagagaatagcagtaatactgaacgagttcggagaggaaattggagtagaaagagcaatgatcaacgaggggcaaggtggtgcccttgttgaggagtgggtggagctagcaaatggatgcgtttgttgcactgtaaaacacagcctggttcaagcactcgagcaacttgtgcagactaaggagagaatggatcatattttattggagacaactggtttggctgatcctgcaccacttgtctccattctctggctggacgatcaattggagtcatcaatcagactagactctatcattacggttattgatgcaaaaaacttcaggcggcaaattgatgaacacacaaactcttcctcgttccctgaagcatttcaccaaatcgcattcgcggatgttgtgatattgaacaaaattgatttagtaaaagatgatctcgaggatttggaaaggcaaattcatgatgtcaatgagcttgttacagtggtgcggtctgtgcggtgccaggttgacttaaatacaatatttgatcgacaggcatatggtgtgaagaattcatcgcaactacaggagcttctggagtacagtaaatcagcaccacctaatagtcgtcatgataacagtatttccacgttgtgcattcatgaacaggatccagttaacttggctaaggtggaatcatggcttgaagatcttctttgggagaagaagtccaacatggatatatatcgttgcaaagggattttaaatatccataattcgaaccaacttcatacattacaggcagtaagggaagtctatgaggttgtgccggctcgagaatggtctgagacacaacctcgcatgaacaagatagttttcataggccgtgatttggatatcagtacccttcaagattcatttagtcgctgcaagcactgatcaccgaattatttgcacgtcaccatgtag

SEQ ID NO: 314 - DNA, 731 bp, Hordeum vulgare
cggacatggctagcccgcagtgctgcgcgaacccaccgacgctcaaccccgccgccggcgagggcaaggtcgtcgacagcttcggcgggatcaaggcgtacgtcgccggcgcccaagagtccaaggccgccgtagttctcatctccgacgtcttcgggtttggagcgccgaatctgaggaagatagccgataaagttgctgcgtctggatatttcgttgtggtgccagatttcttgcatggggatccatatgtacctgaagacgctgacagaccaatagcagtgtggatcaaggagcataccgcgggaaaagcatttgaagaggcaaagcctgttatcgctgctctaaaggaacaaggagcgtctagtgttggggctgcaggttattgttggggtgcaaaggtagtcgcagagttagcgaaagctaatgagatccagacagccgttatgtcgcatccttcttttgttactgtcgatgatataaaagaggtgaaatgccccatcgctgtacttggagctgaaactgatgtgatgtccccaccagaattggtcaaggagttcgagcaggttctatcatctaactcagggattgctcactttgtcaagatcttccctggggtttctcatggatggaccgtgagatataatggcgaagatgcggctgctgtaaagagcgccgaggaggccctgacagacatgattgactggtttaacaagaacctcaagtgatga

SEQ ID NO: 315 - DNA, 2097 bp, Hordeum vulgare
gagaagagctgtgggctgtggctggaggcggcggccagccaatgccgcggcgggcgcaggggtagggagtggcgcatggggggagggaacggcatcgtcgacggcttccgccgcttgttccaccgccgcacgccctccggctccgtgctcggcagctccaaccagtcctccgccggcgaggactcctcggagctcgaggccgtcgaggacctggatctcgtgggcctccgccccatccgcgtccccaagcgcaagatgccgctccccgtcgagagccacaagaagaacataatggagaaagaattcttcactgagtacggagaggcaagccagtaccaaatccaagaagttgttggcaaagggagttatggagtggttgctgctgcaatagatacccgcaccggcgagcgggttgcgattaagaagatcaatgatgtgtttgagcatgtctcggatgccacacgcatcctccgtgaggtcaagctccttcggctgctccgtcatccggacgtggtagagatcaagcacataatgctccccccttctcggagggagttccaagatatatatgttgttttcgagctcatggagtcggatctccatcaggtcatcagagctaatgatgacctcacggcggagcattaccagtttttcctttaccagcttctccgcgctctcaagtacatccatggggctaatgtatttcatcgcgatctgaagcccaagaatatactggccaacgcagactgcaaactgaaaatttgtgactttggacttgcgcgtgtatcatttaatgatgctccttcagctatattttggacggattatgtagcaacaaggtggtacagagctcctgaattatgtggctcctttttctcgaaatacactcctgctattgatatttggagtattggatgtatatttgccgagcttctcactggacgaccactttttcctgggaagaatgttgtacaccagttagatataataacagatcttcttggaactccatcatcagaaaccttatctcggattcgaaacgagaaggccaggaggtacttaagttgcatgcgaaaaaaacatcctgtgcccttgactcagaaatttcctaatgctgatccgttggcggttcgcctactggggcgtttacttgcatttgatcctaaagaccggccttcagctgaagaggctttggcagacccatatttcgcatctcttgctaatgtggaacgtgagccttcaaggcatccaatttcgaaacttgagtttgagtttgagagacgaaaggtgacaaaagatgatgttagagaattgatctatcgagagattttggagtaccatccacaaatgctggaggagtacatgaaagggggagatcagattagcttcctctatccaagtggggttgaccgctttaagcggcagtttgcgcacctggaggagcattacagcaaaggagaacgaggttctccactgcaaagaaagcatgcctctttaccgaggcagagagtaggtgcatcgaacgacagtaataatgaacagcatattagtgatcaggagatgagtgcagagcctgatgcccatggtgcagtgagccctcaaaagccacaggatgcacccggtgttggtcagaatggtctgagccccaccagcttgagctcgcggacctacctcaagagcgcgagcattagtgcttccaagtgtgtcgttgtcaacccgaataaacagccagagtatgacgatgcgatctccgaggaaacggaaggggccgtcgacggactatccgagaaggtctccaagatgcatgcctagtgcagcgccgatgacggaagtcggcaccgcatttctcatttccgtcaggtacaccggatgctgatagcaaagcagtgcggtcctagggaagcactgcatacaagttggagattgtttagcgagtgtgtgatcctgccaagcatcgctgctgcacgcaggaactgttgccctgcatgggttgatgtatttttacactcaagattacagatgtaacaccgggattagttcctacacatatcatctatgcatgattgtaacgaacagagcaagacatctgaaggtacc

SEQ ID NO: 316 - DNA, 642 bp, Hordeum vulgare
agagcaacgcgagccacccaaacggagggacctcgtccttcctgccgaaatgctggccgccaccgccgcctgccgcgcgccggcgcggccgctccccgccgcgcgacccggaagcagctacctcctcggtcgcgtccttctccccaagcggagagcgccggcggtgaggaggaggggacggagcgcggcggtgcggtgcgggctgctccccgtggacccgtgggctcccggcgtggactcccagagcatcgcgtcgcagctcttcgccgtgtcgctgttcccctacctggggttcctctacttcatgacccggtccaagacggcgcccgggctcacgctcttcggcttctacttcctcctcgccttcgtcggcgccaccatacctgctgggatatatgccaaagttcattacgggacctcgctgtcaaatgtggacctgctgcacgggacggcggaatccctcctcacactcaccaatctgttcatcgtgcttgggctgaggggagccctgaggaacttggataaagcagaggagagcagccctgaagctcctcgggacagcaaggagaagagttcagtataggtgcttgtaaattgttggaaaacctctgttttttagtgtgtgtagtgatgctgatgaca

SEQ ID NO: 317 - DNA, 308 bp, Hordeum vulgare
aagagatggcctccttctccaaacaggcggcactcttcttgctggcagcgctgctgctgtgcctcgtctgcactagagggcaagcagcaaggcctacaccaggatccagccactacaaatcacaggatgctggctccgccattttccacgagaaggttgctgcaggagccgagatggaaatggagcaggaagatcaggaggcggtgagaggatgcgagggaggggaagaagtggaggagtgcctgatgaggaggaccctcgtcgctcacaccgactacatctacacccaggggaagcacaactagtag

SEQ ID NO: 318 - DNA, 404 bp, Hordeum vulgare
cagccatggcttcccagctctccgccatgacctccgtgccgcagttccacggcctcaggacctactcctcgcccaggtccatggcgacgctgccgtccttgaggaggaggaggtcccagggcatccgctgcgactacatcggctcctccaccaacctcatcatggtgacgacgacgaccctgatgctcttcgccgggcggttcgggctggcgccgtcggcgaacaggaaggcgacggcggggctcaagctggaggcgcgcgagtccgggctgcagacgggcgacccggccggtttcacgctcgccgacacgctcgcatgcggcgccgttggccacatcatgggcgtcggcatcgtgctcggcctcaagaacaccggcgtcctcgaccagatcatcggctagtag

SEQ ID NO: 319 - DNA, 1889 bp, Hordeum vulgare
ataacgttgcttgctcttgctctcgaaggggaggaactttccttcaggaagggattgagcagagttttgggttgaccgggcttgtcatggagccattgactgggttccgggcctctgtctggagctgcttcaagtttttgcccttcttctgtggccttcttctcctggggatcatcaaaggtgttctgtttggcccatgggcctggtttattatggcgatcggaatatctgcactcgttctgggattatggcctatgcatgtgatttggacatactactgcatcatcagaaccaagctggtgggacctgttgtgaagctgctgcttcttatttctgtatctggggttttagtcatgtggctaatagttggcgtccttggaagtgtacttgctgggttagcatacggctttctagcaccagtaatggccacatttgatgcactcggtgaaggaaaagaaaggccactcgttcattgctttgtggatggaacatggagcactatcacaggaggctgtacagtagtcagggacatgaaagacatgctattacattcatatcttgcatatatggatgatctacggttccacgaacctcctggcggaaaaccatttgaaataagagtgcttgatattcctggcgcagtactcgctgctgcatgtggactcctaatggatgggataatgttcacagtaattgccttgtacaagttccctgtgatgcttttcaaaggatggaagcggcttattgaagatctagttggcagagaaggaccttttcttgagacagtgtgtgtgccatttgctggtctggctattcttctctggccatttgctgttttaggagccttcctagcctccatgatctccagtgttcctctaggcgcatatgctgccattgtggtttatcaggaatcatcgcttttcatgggactatcttatgcaatatcatcagtatccatcttcgatgagtatacaaatgatgtacttgacatggcaccaggatcttgctttcctaggtttgtataccggaagaatcaagcttccgtggaaagtggaccgctctcaaggcctgcctcattcagggataagcaagatggaaagaaagccccagcacggattacatcatttaagagtagctttgatgagttcaatccatttaagttgctagatcacctattcgaagagtgtcagcaccgtggcgaggctctggttgctgaaggagtgataacaccgaaagatattgaagaaacaaagtcaggcaaaggcggcagcggagtacttaatgttggtttgccagcatatgttattctcaatgcactcctacgatctgcaaaggctgattctaatggcctgcttctgagagatggctgtgaaataacatctgacaacaggcctaagaatacactatttgattggttctttgaccctctgatggtcatcaaggatcaaatcaaagccgagaattttacagaagaggaggaggcgtaccttcagaaacgcgtattgttgatcagcgacccgaagcgcctcaaggcgactcttccacatttgccatccctgaatgagcgaaaacaagcagaaatagacgcatttgctcggaggttgcaagggatcacaaagtcgatatcaaggtaccctacatccaagcgccgtttcgatgaccttgtcaaagcgctttccgaggagcttgagagggcaatgggcggcagccggtctgtcagaggatcacagtttcagaagctcaaaagcggccttgttagaatgcttagccagagatcgatggggaagacaacaagcatccgaggatatgatcaagaggcgcagctcaacagcgacgcaagcgctgcataatatttcaaaaaagcggtgaagagaagattgcgttgttag

SEQ ID NO: 320 - DNA, 3659 bp, Hordeum vulgare
cgcagatctccgaccaacccctgggttcgtgttgattggcgaggtgcgtgtgcgtttgcagattcgcggctgtgtcgccatggacggcggggagacccaggtcgtggacgacggagggacgccgccgctggggtctccggttagctccggcgacacgacccagagcgggggcgaggaggatggcaacggtctgcgattagggtctccagttagctccggcgacacgacgcagagcgggggcgaggaggacggcggcgtgctgtatggcgagacgcagccgctggacgaggacgacgaggagaccgaggcggttgaagaatttgagggggagggggaggagaggatgtctgatgacacacaggtggtggaggactcagaggatgatgccggtggcttcgctgggcagacacaggcagtagaggaggaagaggaagatggtggcagcacggaggatgaagccggtgatggtgataggacccagttggttgaagaatgcgaggttgaggatggtgggagtggcgagacgcagttggccgaggaatgccaggaagaggaaagagaaaatgatagcagcgacgatgaggctgctgttcaacgggggacgacccagttggttgaagattcggataaagagatgggtggtgatggtgatgatgagttgagccagggcactcaagtgcaaagtgacgacgagggcctgccaaataatgagggagatgtgaaggattatgccgaggattcggttgattctgatgcttccacggaagaagagggtgccacagtcaaaagtttggaacaagggaaaaggcatgcttcgaccaatggaacatttctccggacggaaattgtagacaactctacctcatgtaatgcgtcctttggtgattgcccaggtcgtaggattgatgacgggtcttttgggtatgtacagagccatgaaaaagatgggagtaaaagcaaaggcaggtgctcaacagcaaagaagctttttgctgacacaacgaacgaacagaaggaaatcaagagcaggtgttttagtggactaagctatctcggatcacaggagcctggtgagctatctcaagcaaatgctttggacgttgtggaggggttgatctcaattcatggcggcatatcgtctcaagaaccatcaccaaaaaaattagaaaaagcaaagccacctgtttcagttaagatgggaactttactattggctgagaaggttgaccggcgtagaagttccagtggaaaagcagaagtctttgcatgggtggatagtcgcgaggatgatggcggaggtgattttttcaggaaaaacaaggatatcttgttgcaccaatcagctggcagagggaaatcaaaaattcccaggccaaagaaatgctccacaaaaattgcacctcctgacaagaaaataatagaggggcgcaaaaggagaacgaggtccaaactttgtgagaagactgaaactttaccttcatcggattcgagactactcaaaagtgaggtgaagagtaagagggcttctggaaaaaggactgagaaaaagcttttgaaagacttggatgatcatctatcgactgccaaacctattgaaagacagcaggaaaaggtcagtgtggatttgcatgatgttggtcaggatactcaaatggctgttgaagctatagaagcactggcacaaagttcccctgctgaaaacttgtcagccagagttgaacctccagtgaagagagatctgagagttggatctaaagtagaaaaaggtaacccaaagagtggccctcctagaaagagaaccagcagcgtccaggaaggtgtcacgacacgttctaaaagaataaaagtaactgagatgaaccacaagcctcagaaaggacagggaggaatagaaatgcgacataatttagaagattgtgcaacaaagacgaaacataagcaggcaaagccagtaccacagaagaataaagttgcaaacattgttgatggaaatagttatgacagtacacctgttgttcgtcgaacaaggcacactggtagaaataacctctatgagtctcccgagttatgttctaataagaacttgaagaaggccactgttgcagatgtaagaaataatcatagcgaacatggacttgagagaccggtgattagtgagagaaccgcagaatatggttcagattctatgttcaaagaaaacacagaaattgcatgtgcaaataatgctcagggtcttcagccaagtactgatgcaagcatacagcataccagtgcaaatgttgctcagaaccttgaaccattaagagatgaaccaacaactcatgtcttccgcagagagccctcatctcaccccaaacagagaagaacacctactgcagtggtacaggcaaaggctcctgcagttaccgaggctgctacaggtcatgatatgcaaccagaagtgacaaggccatccaagaaaagacggatttttattaggagttcagaactgctaacgtatgcaaggagggagcgctccgattgcagatcaaattgtttgctgtctagtattctcacacaatcatcagctgcttctcctgttcttgattcttcatctggagttaacagcaaaacttctggtgttagtagctctgatcagcgacaaaagaaaccatctggtgttaaggatgcaggaaactcaccaaaatgtaactctccggtcccgtgtagtggcctgaaaacaccttctaaagtggtaagcaaattgtcacctactttcagtcctctaaatccatcaaaagcttcaagtaggagcctgttgaaaccctctattgccagagagctgctggagttagatcctgaaaatgctctaccaagtcgataccgaaaggattctagaagaaaagatatgaccagttgcagtattatttttagccatcatttggatgaggatgtgatcaagcgtcagaagaagatcttggcacgcttaggagcccatgaagcatattccgttgcagatgcaacacattttgtggcggatggtttttaccgcacaaagaatatgctagaggcagttacacgtggcaaactggtagtgacatcaatgtggcttgaaagttgtggagcagcaggctgttttgtaaacgataagaagtatattctgagggatgccaaaaaggaaaaggagatgggtttcagcatgcctatatcactggcctcagcttgcaagagtcctctgctgttggggaaaagagtgtttgtgacacaaaatgtgaagccaagtcgagaggtggtgactagcttggtttccgcatcttctgggcagccattggagaggatgggtaggtccataaggaaggaaaaggaagcagcagatgacctacttgtcatctcatgtgaagaggactatcaaacatgcgctcccctcgttgagaaaggcattgatgttttcgatgtggagcttctgctgaacggtatagtcacccagaagctcgattacgagaggcaccgccttttcttggaccgtgtgaagcagacccgctcgacgaggtggctgaaagacggcgcccacgggcagtttgtgcccgtatcaaagagttgataccataccagtgtaaatgtatggtgtgctgtggccgatgcctgttttatgcccatcctcaagttctagctctgtcgtg

SEQ ID NO: 321 - DNA, 1641 bp, Hordeum vulgare
attttgtcggcggcaagggatggcggcgtgggcggagcagctgcagcgcgagctcgccggccgcggcctcgccgtcgcctccgttccagggaagggccgcggcctcgtcgccgcccgcagcttcttccccggggaggtcattatttgccaggaaccctacgcttctacgcccaacaggatctcggttggatcgagctgcgaccactgcttcgcctccggcaacctgaggaagtgctcggtttgtcgagtagcttggtactgcgggagcgcgtgccagaaagaagaatggaagctgcatcaacttgagtgtcaagccatctcagcgctcacagaggaaaggaagaagatgcttactcctacaatccgtttgatggtgcaacttatactaagaagaaaactgcaaagcgaaaaggccattgcatcttcagcaacagataactacaatctagtggatgcgttggagtcccacatctcgaaggttgatgataatcagttggtcctctatgctcaaatggccaatcttgtgcagctgattctcccttcaattgaacttgatcttaaggaaattgcacatactttttctaagtttgcctgcaatgctcataccatatgtgatcctgaattgaggccccttgggactggactgtttcctgctatatcaattattaaccacagttgtgtaccgaatgcagttttgctatttgagggtcggactgcatatgtgcgcgcattgcaacccttgagtagcaatactgaggtatcaataagttacatcgaaactgcagcaaccactttgaagagacacaatgatctcaagcagtacttcttcacctgcacatgtccccgatgtattaaggattctgaggaagatgatctcctggagggatacagatgcaaggaccaaaagtgtgatggctttctgctgcctgactcgggaaagaaggcttatacatgccagaaatgtagcatttctagagatgaagaggaggtaaagaaggtgtcaagtgaaatattactgttgtctgacaaagcttcttcgcttctttcatctggaaataatagtgaagcaggttcagtgtacaagatcattgagcaactagaacagaagcattaccattctttctcgatcactttgcttcacacacgtgaaacactcctgaagatatatatggagttgcaagattggcagactgcattgatgtattgcagattgactattccagtttatgaaagagtttacccaccttttcatccaatggtcggactgcaattctatacttgcggaaagctcgaatggttgcttgagtacacggaggacgctctgaaattgttaactagggcagcagatgtacttcggataacacacggcacacaatcccagttcatgaaagagctatttggtaagctggaggaagcgagggctgaagtttcatttcggctgtcgtctggagaggagcaaatttcatgagaaggcacaactcaccgcgatggcagatatggatcgtcaatctcaggacagcggtatagggtactactaaggatagcccattagcaccctgcagacgatgcctgaagatgatacaaagtataccgtggtaacaatgagattgaaatccaatctttcgtagagggagggtgatg

SEQ ID NO: 322 - DNA, 1588 bp, Hordeum vulgare
tctgctctgttcgccattgtcgtccggtgaagcaatggcgcgctgtggtgtcgccgttctcttgccgatcctgctggcctgtgtcgcggcgtcggctgccgcgggcggtgcggatcggcagcaccggcgggggagcggggcgtcggcgcggctgcagctggtgcccgccgctccgggcgcgtcgctggcagagcgcgcgcaggacgaccggcaccggcacgcctacatctccgcgaggctggcgtcgtcgtcgtcgtcgtcaagccggcgccgcgcggccgagacgtcgaccgccccgatgcccgaggcgtcggcgttcgcgatgccgctgacgtcgggcgcgtacacgggcacggggcagtacttcgtgcagttccgcgtgggcacccccgcgcagcccttcgtgctcgtcgccgacaccggcagcgacctcacctgggtcaagtgccgcgggcgccgcgcgtcctcgccggacgcgtctccgttagcgtcgccgcgcgtgtttcggccggccaactccaagtcgtgggcgcccatcccgtgctcctccgacacgtgcaagtcctacgtccccttctccctcgccaactgctccgccggcaccaccccgcccgccccctgcggctacgactacaggtacaaggacaagtcgtcggcccgcggcgtggtgggcacggacgcggcgaccatcgcgctgtccggctccggctcggacaggaaggcgaagctgcaggaggtggtgctgggctgcaccacctcctacgacggccagagcttccagtcctcggacggcgtgctcagcctcggcaacagcaacatctcattcgcctcccgcgctgccgcgcgcttcgggggccgcttctcatactgcctcgtcgaccacctcgccccgcgcaacgccaccagctacctcacgttcggccccgttggcgccgcgcattcgccgtccaggacgccgctgctgctcgacgcccaggtggccccgttctacgccgtcacggtcgacgccgtgtccgtcgccgggaaggcgctcaacatccctgccgaggtgtgggacgtcaagaagaacgggggtgccatcctcgactccggcaccagcctcaccatcctcgccaccccggcgtacaaggcggtggtggctgcgctgagcaagcagctggccagagtgccgcgggtgaccatggacccgttcgagtactgctacaactggacggccacgagaaggccgccggccgtcccgaggctggaggtgcggttcgccgggtcggcgcggcttcggccgccgaccaagagctacgtgatcgacgcggcgcccggcgtcaagtgcatcgggctgcaggagggcgtgtggcccggggtgtccgtcatcggcaacatcctgcagcaggagcacctctgggagttcgacctcgccaaccgctggcttaggtttcaggagagccgttgtgcacattaattaattaattaggcagcacttagtggtcatttcttctggttccgttttccttgtttcccgtaagggtctcgctgattctgtaaggctctctgtcataagcaagcgttaatgaaatgcatgggatgaaggtac

SEQ ID NO: 323 - DNA, 1145 bp, Hordeum vulgare
aatctcactcctggtgctactcccgttcttccgccatagccatggatgacgccgcgaacgccacccagacctccgccacctcttcggtggccgccgtagccgcggcggcccagcaccagcagctccagcgccagctctttctcatgcagcaggctcaggctcaggcccaggcccagccccatccgcaggcgcagcagctgtcgcagcaggccatgtcccgcttcccctccaacatcgatgcccacctccgccccctcggaccgcaccgcttccagcagccagcgtcggcgccatcgcagctccagaccccaccccagccgcactcgcaggggcagccgtccccgcagcaatcggcgcaggctagggtccggagccccgaggtggagatggcgcttcaggacgccatgcgggtctgcaacccggatatcaagacgcctttccattctctcgaggacgccgttagcaggttattgccttaccatgttgttgctgactacgaggctgaagaagatgacaggatccttgacagcgatgcaactggccagattccctctcgtcttcagcaatgggatcataacattctggtaaaaattgctgagttcacaacaacttttgagaagcaagtgttggcatacaacataatgaccaagaaaagggccatcggtgagtttcggtcggaggagcgactcatgctagagcaggctttgttacaggaggagaagcaggcttcgatggaactaagagcagagatagaatctagggagaaagcaggccgtgaagctgctgaagctaagatgcgtatggcgatggttgagcatgctcgagtggaagcccaaccacaccctgaggtgattggtcatggccctttgagggccaattctgctgcttcccaaggcgatgatggtcctagtcatgacatggcacaagaacatgttgaagatggatgggaaaacactcaaagggatgatgatgatccatccgaggatttcctcaatgatgagaatgagccagataatgggaactctgatatgcaagaggagtggcggcgatcgggggaatttgatctaaactcgaggtaagacagcgagaggaatggtgttgatggtgacaatctgattgaactctaggtaagacaggtgtactca

SEQ ID NO: 324 - DNA, 2706 bp, Hordeum vulgare
aaagatatctaagtgtgggagcgaatgggggcgattggaggcgacgaatccgtgcagtgggacaagatgaatggagctgaggtggtgaacggcggtggaagtggcgcaggaagcctggataggatacaggtcttggtgagggtgagacctctgagtgacaaggagattgcaaggggtgagcctgcggagtgggagtgcatcaatgacaccaccatcatgtttcggagtaccttcccggatcgacccacagctccaaccgcatacacatttgacagggtatttcattctgagtgcagtacgaaagaagtctaccaggaaggggtcaaggaagttgccctctctgtagttggtggcattaactcaagtgttttcgcgtatgggcaaacaagtagtgggaaaacatatactatgactggagtgacagagtgcacagtagcagatatatatgattatattaacaagcatgaggagagagcatttgtgttgaagttctcagcaattgaaatatataatgaagttgttagggatcttctgagtgcagaaaatactcctcttagactttgggatgatgcagagaaaggcacctacgtggagaatcttacggaggttatattaagggactggaaccacctcaagggacttatttctgtttgcgaagctcaaaggagaaccggggagaccttcttaaatgaaaaaagctccagatcccatcaaatacttaaattgactgttgaaagttctgctcgtgaattcttaggaaaggacaagtcaactacccttgtggctagtgtgaactttgttgatctggcaggaagtgagcgtgcatctcaggctatgtcagctggcacaaggctgaaagaaggttgccacattaataaaagtttgctttcccttggcacggtcattaggaagctaagcatgggtagcaatgcacacataccgtatagagattccaagcttacacggatattacaaccttctttgggaggcaatgcaagaactgcgattatttgtacactcagccctgcgacaagtcacattgagcaatcaagaaatacactgtttttcgggagttgtgcaaaggacgtagttacaaatgctcaggttaatgtggtcatgtctgataaaacactagttaagcatttgcaaaaggaagttgctagactggagagtgagttgcggcatccagtttcatcaaactctagtctggaagcacaggtgaaggaaaaggacaaccaaatcagaaagatggagaaagaaataaaagaactgaagacgcaacgtgatttggcccagtccaggttgcaggatttgctgcaagttgttggtgatcgtgatccaaagcaccaggtctcgggaaagcgttcaatcagaagtcctccgtctgttggaatgcccccaagcgctagcagagatgacagttctcagatctctcatgatgattcagagcattacaaggaagtgcgatgtattgagacaattgaaactggaggaaatgaacgtttgtctttgtcagctggtgaaagtaccagcccacaagattcaaataggaattcgagcatgcgtggtaatgattcaaataggaattcgagcatgcgtggtaatgattcaacagcttcagtgaattcaaggcgccttggtgaaactcctattaccttggagcaacatttggagaacatcagaaggccttttatcactaaagatctaggatcttcaacccgcaatccgtcaagttgtagagtaattggtagaagcaggagctgtagatcactaacagggtccactttacttgatgagatggagttggaggattgcacaccagtaaacagaagtttggtaattttcccaggaagacctgaagagtaccagagaagaggatctgcattaaactatgatgcagggagtgagactccttcaagggcaggatctgaaattagtactttgaagggagctagcaaggcaggtgatgcagaatttaccggtataggtgaatttgttgctgaacttaaggagatggctcaagttcattatcagaaacagttaggtgaccagagtgcgaatggaaagagcgtcggattagacccaatgatggatgctttgcaatcaccttctagatggccattggaattcgagaggaaacagcaggagatcatcgagctctggcacgcttgcagcatttcgttggtccacaggacatactttttcttgctcttcaaaggagaatcagccgactcgatttacatggaagtggagcttcggaggctgttgttcctcagagacacctactccaggggaagcacccccagcaacgtggtcgtaggcagcctcagttcttcccctgtcgcgagcgccaagaagctgcagcgcgagagggagatgctggcgaggcagatgcagaagcggttctccgtggaggagaggaaccacatgtacaccaagtggagcgtcccgctggactccaagaagaggaagctgcaggtggctcggcggctgtggacggagagcagggacctggagcacgtgagggagagcgcgtccctggtggccaagctgatcgggctacaggagcccgggcaggtcctgagggagatgttcgggctcagcttcgcgccgcagcagccccccacccggcgctcctccaacggctggagatatgggatcccctcgtttggttgattgaattggttggttgattaaggtaccttt

SEQ ID NO: 325 - DNA, 1023 bp, Brachypodium distachyon
agtggcatttgtccctactctctacccccgtcactcgaggaagaaaggagtggtctccgttggccgcgcgctatgggcatcggagcactgcagccggcggcggccatggccccggccgccactgcctcgaacgcagccccccgaatccaccatcgtccgtggacgcgcgctgccgcccctaggactctggtctgcaacgcgggatcaggttcttctaacaccggcgctccgccgcagccgcggacgacgaggggccgcttcgccgcgaccacggcggccggggcggcgccggacgccgtgacgtactcctccagcatagacaccgacatgcccctctacgagccccccggggtgtcgttcgacgagtacctcgaggaccggccccgcgtgttccgcgccatgttccccgacgagggccggagccagcggctgggcgacgaccactggagggtccggatgctgccgctcgagttcctcctcatcaccgtgcaccccgtcgtcgtcatgcagctccgcaaccgcggccgcgcgctccagctccgcatcacggagtgggagctgagggggctggatagcggctacacgccggcgagcttcgacctgggggtgcggggctcgctctacgccgacaggtcgggcgggggatcccggctcaggggccacctcgagatctccatcaccgccgtcctcccgccgccgctgcggctcgtgccggacggcgtcctgcgaggcgtcgccgagtcggttctgtcgacgctggccgagaagatgaagcgggatgtggacgtcggcctcgtcgccgacttccggatgttccggatggagaaggcggcttccagagccaccggaacggctgtcgccagagcagagtagtagcagacagagaaagcctgaaggctcgtcaagttttcttctgaccaaaagtttgttttcctccggcggtttgagaaatgcatctttgtatagagcatggattggtactactacgtttttcccggcagcagcgaatcttaaaccgaaatg

SEQ ID NO: 326 - DNA, 1096 bp, Brachypodium distachyon
caaacaccacaaaggcgtgcacgcaatgaggcccttcctgctcacgccgggcgcccggctcgcgtcggccccctcgccgtcaacgctctcgcgcctgctcctcccactccacctacaaaaccgccatgcccacgcctccccctccccctccctccacgcgcgcaccaaccgctcctcgccgcctcttcgccgccgcagcggtcgcttcttcgcctcctccgcctcgtcctctcagatggcggcgcctgccgatgccccgggcggatccgcggacgcgtttgaggtgatccgcgctcaccaggtaaaagctgctcggcttcctcctattgaagaaatacgaaccattctcgaccggagtgtcaggggtgttctggccacccattcccaggaacatgtaggttatccatcgggttcaatggttgattttgcttgcgatcaagatggttcccccatattagcagtgagcagtttagcaggtcactcgaagaatctttctggaagttctaaatgctcacttctggttgccaaagacccagaggacagaacagatactgtaatcactgtatatggtgatgcgacacctgtttcagatgaagaaaaagatgcagtgagaagcgcgtacttacggagacaccctgaggcattttgggttgactttggtgacttccgttttctgcacatcaaaccaaaagctgtgcgttatgtatctggggttgcaacagctatccttggctctggagaatttagtgctgctgagttcaaggaagcaaaagtggatcctatatctcaattttccactcctattacaagccacatgaataaggatcatgctgatgataccaagctcattgtgcaacattcaaccagtgttatggtggattttgcttctatgctggatgtcgatagccttggtattaatgtgaaggctggttatgatggaagtgttctgaagctgcgtatccccttccctaggcgtgcacaggacagaaaggatgtgaagacacttattgtggaaatgctacaggccgcaaaagcctcctcctcacatgctgaatgacctgttttctcggatggtggtggctttgttcatgtatag

SEQ ID NO: 327 - DNA, 783 bp, Brachypodium distachyon
accagcttcactggctcaacaccggcggccacccctcatggcgacctccacctgccacctaccacctctcctccctggccccgcctccccgaaccatctccacctccgatcctcccctcccccgttcactcgccacctccgcaaccctactccggttcgtctcctccgcgccgcccgccgccgccatcccgacgccgtcgtcgtcgtcccggacgcccgtccctgggtcggcgatctatccggatccgcttcctaccgggacggcagcgaggaagatggagacgcggaggaggaggacgaggaggaggaggacgaccgcagcctggacctcctggcccggttcctgcaatcggtgttcaggaaggcctcccgccgcgcgcggcgcgccgccaggtccgttctgccgccctccgtccccgctgagctggtaaaattctcggtcaatggtgtgctggttctcacgttcttgtggatcctcaaggggcttcttgaggtggtctgcacgtttggaagcatggtgtttataagcatacttcttgttcgaggaatatggtctggagtaacttacatcagagaaaaccgatacagttatattcaacagctcaacgatgaaggcaaccggtggagcacagtacaaactgccggttgatcatttcctttccgtcttgccattatacagcacagctgcgcgagatggaaggaaccccatgtgttatgtacaaataagtggttccgttcttcctctgggcgtatacaggagggatgcttgagttcagcaggatt

SEQ ID NO: 328 - DNA, 1294 bp, Brachypodium distachyon
tagattcacatcgcagcacaagatctcctctcttctcctatgcacaagcaaaagatttgctcttgtgagacacagaattcatggaggtgcaggccccatgtactttcacctgctcctacacccactgttccatcggattcgcccctcgggctcgcctccgctgcatcaccaggatccgtgccgcagctcatgatcagcagggcgtcggcgacgaccaaccacgccggactagtcgcctcgccgccgatggacccatacctgctgccgtcgctgctgctgccgcacaaggtcccagcagcagcagcagcagcgtattcggcgccagggacgcggagcttgccatgtgggagaagctaggagcgctcgtcaggctcagctacggcattggaatctacgcggccatggcgctcgccgggagattcatatgccacattgccgggatcgattccacgggtggattccatccgtccctcaccgctctcgtggagggcctcggatatgcatctcccccaatcatggtgctgctcttcatcctcgacgatgaggttgtcaagtattcacctcatgcgcgtgccatcagagacgtcgaggacgaggagctccgcaccttcttcctcggcatgtcgccatggcagttcattctcatcgtcgccgcgagctccgtcggtgaggaactcttctatcgggctgctcttcagggggcactggctgatatatttctcagaggcacagagctcatgaaagatgctcgaggaattgtatccctgagcggcatggtgcctcctttcgttccttttgctcaaacgtttgcagcagccatcactgcggccctcacaggatccctctattaccttgctaccgccccaaaagaccctacctatgtggtcacaccagtaatgcgttctcacaacggccgggagaatatcaagaaactatttgcagcctggtacgaaaggaggcagatgaggaagatatactcccctcttctagaaggaatcctggctttctaccttggctttgaatggatccagacggacaacattctagcacctatgatcacccacggcatatactccaccgtggttcttggccatgggctatggaaaatccaagaccacaggagaaggttacgacaaaggattcaggaaattagacaaagtggctcagacacacaccaatagtccaatagctcatagctagctaggtgaacaagttttgatccacttaattagtctatgatatactactgtagtagctagctatacataggtagagaggatagtacgccaagctg

SEQ ID NO: 329 - DNA, 3773 bp, Brachypodium distachyon
gatgttggttagatttggcgtgatcttatcccgaggggggcgcgcggttctggcggggtaggttttgggcggcaggcgatggaagggacgacggcggcggcggtggttggcggcgacggcgcggcgggggatgcgcagattaagggcggtaaggagaatgggcagcaggcgctgcagctgcagcggccgctgcagccgtcggggggcagcgaggcgctcgagatgccccccacgccgctgccgatcgcgcgggaccttgactggtccgagcatttctccttcttcaactcggcgggcgggttcactgacggcgcgagggggttggcgagcacgggcctgtcgaattccgtgtcgaggccggacagcgtgacccagtgctgcttggaaggcacggacgagagggtggaggagctcacggtggggaattgcatcagctctgatgctcagcctcacgcctctgctggtggaagctcgagcggcggggagaggcctgctgttgtgaggggcctgtggggcaatttcacgctggcatggaggtctagtgatgtggccagcagggaaaacttagcagcgggtcgtggcgacattgcgaacttgaggactggtgatgtggctagcagggaaactttggcagtgaaccttggcaacaatatgatctctcagaacaacttgaggactggcaatgtggctagcagggaaaatttggcggcgaaccttgccaacagtataatcgctcagaacaacttgaggactgccgatatggttagcagggaaaatttggctgcgaaccttggcaacagtatgatctctcagagcattgatgcttcgggcaaggaaatgccattcagtcgtggtgacaatgctaatagcgagttcaatatgtcatttggtaatcagcagcagcctattccgtcttcacggctgaatcaaaccgagcaacgatttgaaagagagaatggtctgaaagtgagtagtttctcaaatagaattattgatcagatgaggaataaaactgccacaccttcatctggggttcaggggtttccatttaagactgcgtcgaagggtaaaggggttacctaccaaagtgcacgtgaggagatacaagcacaagctaatgcaagacctagagtccctatggataggatttctaagattcctagctcaacacacaattctatggccagattggatggtgcatttttcaacggtggtggaaatgcttctgaatctcaaaatgagggaacaagcctgagggaactaattaggcccacaggccaagtgacgagcaagtttgagaaaatgcagttgtttaagcagatccttgatcatgtagacaaatctcatgcacggggtttaactttgcaacatgtacgcccttcatattttatagtctcacctccaaaccaagtaaaatataccggctcttatgctacacaagatttatcagccccagccaaaccggatattgccacagatgacatgttcaataggaaacgacgcttcgatcagaaaaatgcgcaccaagagtttaatggcaatggaaatccaaattcaatcctaaagtatcaaaaggtcggtgatcaaggttctgttgccgtcaggcgaccgacacatacctttcggactgaccacagagggggcaaccaaagtgaagatgttgatcctggtgcttccggacagggaaattctagttgcaccgtcagaggacgttttaacttcggcgaaccttactatggcaatggcaataatgcatcttatgcccaacgtttatccaattacggcaaccaagaatcggtacttgatttgaggttgctagaagatagctggtatagaagcccagaagagctcagtcaactgaaaggcacattcccatcaaacatctacagccttggggttattctatttgagctcttttgctgttgtgaaacatgggagctgcattgtgctgcaatgtcagatcttcgccatcggatcctgcctccaaattttctttcagaaagtcctagggaggctgggttctgtctttggctactgcatccagatcctcgttctcgaccaaaggcaagagacattctaggatgtgacttgataaatgagggtcgggatttgtcgttgttagataataaggtaccagctgctgtcaatgaggaggacacagaatctggtttattactgaatttcttgtctcaactgaaagaagaaaaagaaatgcaggctagcaagttatcagcagatcttgcaggcttacaaacagatattgcagaggttgagagaagacattcgctgaggaatgggttcagtttagaggacatgggagtactggcaagttctaatgatttgccaggcacttcttcagatgccctgagagggggatcgttgtcaggtttgctaccaccaatatgcaggtcaagcatatatgagcagagggtgatgaggaatttggagcaacttgaaaatgcatattactctatgaggtccaccattgacacgtctgagactaatgtaattaaacgttcggataatgatgctttgagggtgcgtgacaacttttaccaacttcatggtgatactgatgccatgaatgagcaaacagaccgccttggatgcttttttgatggtttgtgcaaatatgcccggcatagtaggtttgaagtacgaggaattttaaagaatgcagatatacttaactcaccaaatgtgatctgttccttgagttttgaccgtgatgaagaatattttgctgctgctggggtttcaaagaaaattaaaatattcgaatttgatgctcttttaaatgatcgtgttgatattcattatcctttaatagagatgcctagcaagtccaagcttagttgtgtctgttggaacagctatataaagaactacttggcatcaacagactatgacggcactgttcagctatgggatgcaagcactggtcaaggattcacgcagtttacagagcacaggaaacgagcttggtctgtgagtttctcagaggtggatccaactaaattggcaagcgggagcgatgattgttgcgttaaagtttggagtattaaccagaaaaattgtgttgacacaatcagaaatgtcgccaacgtatgctgtgtacagttctccccatactcctcccgtatgttagcttttggctcagctgattacaagacatactgttatgatctgaggcatacgagaatcccatggtgtaccatttccggacatgggaaagctgtcagctatgtaagattcttggatccagaaacacttatctctgcatcaactgacaataccttgaagatatgggatctcaaccggactaattccagcggattatctagtagtgcctgcagtctgacattgagtggccataccaatgagaagaattttgtaggcttatctgttcatgatggatacataacatgtggttctgaaaacaatgaagtatattcttactacaaaacctttcccatgccaataacttctcataagtttggttctattgacccgataaccggtcaagagacgaacgatgataatcagcaatttgtatccagtgtttgctggagagggaggtcaaatatggtggtagctgcgaactctagtggcagcattaaagtgcttgagctagtctaaacaagctgctgagaattttacagaatgagaaagtctgatcatacagtttccttgctgtttttaactcttaagcctcttagatggctgtatatcgtctcgagcattctgccttctgaatggacaactaagcgtca

SEQ ID NO: 330 - DNA, 1080 bp, Brachypodium distachyon
actgtcactcgcgatggcgcggcctcgggcgggggctcacccatccagcctcgtggcgttgctcctttccgccctcctactcctcctcgcccgcgacggcgcggccaggggtggcggcggcaggggaagctcggtgtacccggcgtccgtggtgtacccgcaccactcccgccagatctcctggaaacccagggtgttcctctaccagcacttcctcagcgacgacgaggccaaccatctcctgtccctcgcgagggcggagctcaagaggtcggcggttgctgataacacgtcgggcaagagcacgctcagcgaggtccgcaccagctacggcaccttcatcagtaagggcaaggatccaattgttgctggtatagaagataaaattgctgcatggacatttcttccaaaagagaacggagaagatatgcaagttctaaggtataagcgtggggagaaagatgaaccgcaatttgatttcttcaccgacactgtaaatactgtacgtggtggacatcgcgcagctactgtacttttgtacttaacagatgtcgcagaaggaggggaaacagttttccccttagctaaggactttacagacacaggtttgcatgataaggatacaaccttgtcagaatgtgcacagaaaggcattgcagtgaaaccgcgaaaaggggacgcccttctgttcttcaaccttcgcccagacgctgcaacggaccccttgagcctccatggagggtgcgcagtcatcaagggagagaaatggactgccacaaaatggatccgtgtagcctcattcgacaaggtctatcatatgccaggcaattgcagcgacaacaacgacagctgcgtgagatgggcagcgctcggagagtgcataaagaacccaccgtacatgattggaaccgcggcattgcccggtcattgtaggaggagctgcaacgtgtgctagcgatttagcattgcatggggaaacagaatcgacggtaactggcttgttgttcaatcaggtccatacatgagcaacgatagctgtttaacctgagtttgttcatgaggtttggcactacaaattgc

SEQ ID NO: 331 - DNA, 621 bp, Brachypodium distachyon
gccatctcaagctagctcaaacacgcaacggagatacagtaaaagaggacggattgagaacaggaagatggaggtggagatgcagctggacgacgacgtcttcttcgcggagctcagcaagcggatttcgctcctcatcaccgacgacgacgaggccgatttcggctccgcgcagttccccgcctctctgcccgttccgggtttctccatggcgccccatgtgccgcagggggcttcgatgttggcgccaccggcctacacgttgttccaccacgccgccagctacggcgccgccgccgccaacaacaacaacaatagcgccgccggtgacattggcagagcgtggcagcagcaacaacaacaacagtgcggcagcaagggcaccggcgtgttcatcccccggtccacgtccggctcggcgcactctaaaaggaagggcagaaactggagcggcggatccaaggctgccgcccacaaggcgcgggcggcggcggcagcgcagacggaggccgccgctgtcgcagcaggcacgtccgcaaagagacgtgcctgattgtgactagctactcataaaatgatcaagaaggcaaaaaaaaaaagcaaccgattaactagctccag

SEQ ID NO: 332 - DNA, 824 bp, Brachypodium distachyon
acgagatgttttttcagaggaggaattcaaagaaagtgaaggacaccgatggatcatcaccgaagaaggacaaagatggccgtgggaagaatgatttcttcgatcgcgccaagggtgcttttacaggaagcctcaagtcagccaagaatgacgctcaagggagagcggaaaaggttcaagcagatgtgaaggctggctttgaaacaatcttggagaagggatcaggcattctcgagaaagcgaaagaggatgttggaggtcactcagaatcagaagccagccgctcaaaggaactaggtcaaggaagtgaagaacaaggaaaggaggacatggaagctttcaattcaatgctcgacaaggtgaaaactcacccagatgtgatggacaaggtccattcggtcctcgacaaagtgaaaaaacacccagaagtgatagaaaaggttgcggaggttttacatctgggaaaacatgaatccaaagagaaagaagctgctgaggtcaaggagaaaacaaaaggcgagaaaacacaggacgctgacgagggcgcctctggcgataagaccaaaagctcaaacatcctagaggaggctgtggaagaaattcaggctgtctttgcagcggtgcagcagcaagatacagatgaaactgagattccagttgaggctgctgccgaaaccggaactccagctgaaggagaacagcccgaggaagcaaagcgggaggtggagaaagacgacccgaagaagcgaatcgatttcctcgggttcttcgccatgctgtttgagaggttctgctcccctgctgccaagaagaaagactagtag

SEQ ID NO: 333 - DNA, 404 bp, Brachypodium distachyon
caacaatggccaccatcagcgccgccgcggcgaccaccgtcgtcgcccgtgccgtgaccacccggccgcaggctctagggctgccacagctgagggcgaggagcgagagggtgaggtgcagctactccaaggacgccaaggaggcgaccccgaccaccagcgtgcgcggcgccggcgcgtccctgctcgcggcggcgggcgcggtgaccgcgtccgcggcgccggcgctggcgctcgtggacgaccggatgtccacggagggcaccgggctgagcctcggcctgagcaacaacctgctggggtggatcctcctgggtgtcttcggcctcatctggtccctctacactgtctacacctctggcctcgacgaggacgaggagtccggtggcctctcgctctaataa

SEQ ID NO: 334 - DNA, 1829 bp, Brachypodium distachyon
gcacgctccttcttctagtcctacccaatccaccggtccacccccgcgtcgcctccaaaccctagtggcgcgtccctcaactcaagcccaccaccatggaggccgtcgccggcgatgagacggtcggcgagctattgcgcgccgcggcggcgctggtgcccgctgagcactacgccatcgcggcccttgttgccttttcggtcttcgcgtaccgcttcctggagctccacgtcatcggcgacctcctccgcggcctccgtggcggccgcgtcgagctcgtcttccaccccgcttccgagatctaccactgcgtcgcctccaagtgccgctccctccatggcaggtacctggcgacgccctggcttgcaagcccgcatctgcagacattgttcctggggatttctgggagaccaccttcattcacctacaagaggcagttgtacacagttcgtgatggtggaacagttgctttggattggctgctggctaatttggaggatgggatcatttctcaagatgcttcaacaccccttgtagttgtggtccctggattaactagcgattctgacgctgcttatgtaaaacacttggtgcattccatggcgagaaaagggtggaatgttgttgtaagcaaccacaggggtcttggtggtgtgtccattacatcagattacttctacaatggtggatggacagaagatgtccgagaaattgttaattatctccatcagaagtatccagaggctccgatgttctgtgttggtacaagcataggtgccaatattctggtcaagtatcttggggaagaaggtgagaatactcctgtggctggtgctgcatctatttgttctccatgggatctagtggtttgtgaccgatttatttcccgtaagcttgtgcagcggttatatgacaaagcccttgcatttggtctaaagggctatgcagagctacatcaacctatcatggctcgacttgcaaattgggaaggtattaaaaagtcacgctctatccgggaatttgaccaccatgccacttgtgttgttgcaaaatacgagactgtggatacctactaccgtcggtgcagtagtgctagttatgttggtaatgtgtcagttcccttgctttgcgtcagtgccttggatgaccccctctgcacaagagaggcaatcccttgggacgaatgcagagccaacaagaacattgttttggcaactactccgaatggtggccatctcgcattttttcaaggattaactgctggaagactatggtgggtcggagctgtgtctgagttcctctgtgcgctgcatgacagctcttgcatgcatcggcaaaaggcaggagatcatgttttgcagtcgtcgctggagtcgtccattgataagagcccatatgtcagcatcatgggagatggaatggtagctccagtgacaaatgatggctctgataatgacgagcccccatctaaccagattgataatggattaaaactgaataatggggtgaacgattcacaacaagatgaaaaagatcataaaagctgcatatcagtagatgaaacgcctgccaaaacccctgcagggtctgcaaaacagcaaggagaggaacactacgctaataagatccatgatgccattgatcccgttaggagatccataaaccaactctctcgttaccaaggaaagtcagtcggtttgcttgcatacatcgcttttgtaacatcatggccgctccttggctccctagctctcatcgtgcttaggaaaaagttcaggaaacctttgtctgctaaattgtaaagtgaacttgctcgtttggtctactag

SEQ ID NO: 335 - DNA, 1439 bp, Brachypodium distachyon
gcctctgggagttggattggcggatggttgcgaaccaggaggcggcggccacagaatcagcgccggcggcgacggtggacgcgatgcggctggcgtcgcggtggcggtccccggcggagtgggaggccgcggcggcggcgctggaggccgagcccttgccgtcccagctcaacaccgacaacagctcgggcctcttcgcggtcgtgtccatcgacaagatgtccgtcaagtaccttggcgtcaaccaccacggccatgatgtcggggtcgtgcaggccgactgcccggcccccacccaccgagccgtctactacttcgagatgaccgtggtgaacgctggcctcaaggggcagacctccattgggttcaccaccgagagcttcaagatgcggcgccaacctggctgggaatctcaaagttgtggataccatggcgatgatggctatctttaccggggtccagggaaaagcgagtcttttggtcccaaattcacatctagtgacataattggtgctggcatcaactacatatcacaagaatttttcctcacaaaaaatggatctctggttggaggatttccaaaagatattaaaggcccactatatcctactgttgcagttcatagcccgggtgaagaattgacagtaaactttggaaaagaacagttctgttttgacattgagggttatattctcgaggagaaaatgaagcaacaatcagttagtgacaaattgtacttgcaaccagacatcagtcactggattgttcgttcatatctcctacattatggctaccaagatacactaaattctcttgatatggcaagtgaaactgatcctccggccaatcaccaaaatggttatggggaaccgcctgaaatgtacggtcttagccacagaaaaatgttgcgtcagcttatcatgaatggggatatcgattctgcattcaaaagactagaagagtggtatccacaggtcataaaggacaaaacatcagttatttgcttcttactccattctcaaagattcattgaatacatcagggctgagcacctggaggatgctgtaaaatacgctcgtgctaacctcgccaacttcttgacacacaaagcttttgaggggttgctgaaggagagtgtggccctgcttgcttatgagaagccttctgaatcttgcattggatatttgctggactctccgcagcgtgaatttgtagcagatgcagtgaatgctgccgtcctgtcgacgaatcccagcatgaaggaccctgagagctgcctttactcgtgcctcgagaagttactgaggcagctcacggtatgcagctctgagctacgcgtgttcaacaacgatcaaggggatgcgttcctacttcataaagaagtgcagacctgcgaaagatccaggcgttcctaggcacatcaaattgggcatctgtag

SEQ ID NO: 336 - DNA, 2120 bp, Brachypodium distachyon
atcctcatcttcttgatccgtgaggcgaccgcgggcttcctcgtttcttgatccgagggcgcggggaggccatggcggaggcggcggcctcgccggcgcagccgaagctgctctacattgccgtggccgacggcggcgggcggcgggcgttccgctacacgcgccccgtgctgcagagcaccctccagctcatgggctgcaaggctcgccacgccttcaagattagcaagagagtattcaatatgatgaagggtgaattcttggacacatcgaagttggatagggctgttaaagaaggaaattcccctggccttgacatcggggaagatgccaagatgttgaacccagaaacttcagacgcaagtagtaatagcgttccctttgaattgtacaagacccagacaacgattattgtttcaagagaaaagtttctaaatgttgtgtgtgatgcgctctcttcgtacaaatatgttggaccaaaccagaaggctgacttgcttcttgcttgcagaattaaggagagaaaggaatcagtgacagtactcttatgtgggaccagcgggtgcggcaagtccactctatcatctttgttgggtagtagattgggcatcacaacagtagtttctactgattccatacgtcatatgatgagaagctttgcagatgaaaagcaaaatcctcttctttatgcgtcaacctaccatgctggtgaatacttggaccctattgcagtttctcagtcaaaggcaaaacgccaggcaaagaagctcgatatggtttctcgtcctagtacccttgaaggcaaagatgacatttcagatgttcaatcccgtcatggagcctcagaattacctcctagaactgagttgattggcaacaagcaaatggcaatagaagggttcaaggcgcaaagtgagatggttattgacagcctggacagattaattacatcttgggaagagcggaaagaatctgttattgtagaaggagttcacttgagcctgaattttgtgatgggcctgatgaagaaacatccttccataataccatttatggtatacattgcaaatgaggagaaacacatggagcgattcgctgtacgtgcaaagtacatgacattggatccagcaaagaacagatacatcaaatacatccgaaatatcagggctattcaggaatatctttgcaaccgagcggacaagcatctggtgcccaagattaacaatactaatgttgaccagagtgtggcggctatacatgccacggtcttcagctgtcttcgccggcgagaagctggggagcagttgtatgattccaacacaaacactgtttctgtagtggatgaggaatacaggaaccagcgtgcagctaactccttgggttcaaagggcatgtttcagttcattcaaaggaaggggtcttcgaggaatctgatggctctccttaaccctgatggttccgtcactaaggcttggcatgtagatacaagcgatgccaatggaaatggtagtacaagtagtgagaaatcagtcagaaatcatatggttaacccatcacaaattgggaaggcagagtcggttaatctccaatttggttctttcggaatcagtgcatggttgagtgatataggtggcaccagtcatgctggaagtgtagatgacctaagggctgatggcatcgagacggccagtagatacttctcgtcatgctgcagttccccaaagacgtcagattgtgcttccaaagagcatatggaagattattcagtctatggtagtgaagaagaagctgatgatccacctgatgctgaaactgatgatgatctgactgacgaagagagagacgttcatgagattgaagctggctccgtagacgaacattccaccaagtctgacgaggaatacgacgatctagccatgcaggatgtgatggagaacggtaacagctctgatgatgagcaagctgcgggctctggcaacaggagctcagcccttgaggagagcatccttggagcagccgatggagatgatgccatggcgggaaggtaccaccacaacctggagctcttcttcaagatgtccaaggaagtagccgccacagagatgccgtgtgcgtaataa

SEQ ID NO: 337 - DNA, 1108 bp, Brachypodium distachyon
gaatccctaccctgctcctcctctctctctatctcttcctcctcctcctgggttttcgttcttggaggtgttttggaggcggccgccgggcatggacgtgcgccgccaaccgaatgtcgcggcggcggcggcggcggctgctgctgctgctaccctgggtgatttgttcccccaccagcctgccatggatagtggagacaacaacacagaatggctctccatctatttagaggactgcttgtccactcaccctgtttctgcagaacaggcaagtcaaggtgctgtaaaacagaaattaccaccgccttcatcttccaatgccagaaggaagaaaaggagcctggcctctgttataagagacgaagaagagcactgtttcactgtgtttgtggaaccaccactactcctacctgatcagaagcattggctagcagagagtgagctcatccttccgaagaaagacaaagaccaagaacttgttcaacaacaagaacaagaacatgaggaagaaaagaagcgcaatgcaagtgcagaaatgctgttccagcaagagcagatgctggtgtgtagctattgtttatccaaccaaacaccacagtggtgggatggtccatcaggggtattgtgcaatgcatgtggcctgaggttacaggcagggaatgagttcagttccatggagcgctgcggccaagaaatcagcaaagaacaagaacaaggaaagcggcaggagaagaggaggatcaagaggccagcatatattgatgaggagctcccgcaaaagaagaggaccaagaagactacatacgtgaatgaggagcttccaccggaggagccagtgcagaggtgcacccattgcatgtcgcacaagacaccacagtggagaacgggtcctttggggcctaagaccctatgcaacgcgtgtggcgtgaggtacaagtctggcaggctgctgcctgagtataggcctgccaatagtccaactttctcgagttacatgcactccaattctcacaagaaggtcatgcagatgaggaagagtgttgaacactcagggcagtaaactgccggaggggatcatctcctggatctgtcgctgtcaggtttatag

SEQ ID NO: 338 - DNA, 533 bp, Brachypodium distachyon
tggtcatgtccatggcgctgggccgattcacccattggttgtggcccggtagctcggcgcgtgtggccagccacgagctccccagcacggccctgatgagctcctccttcccggacttcccctccgggttccgggagccggacactgtctccttctccactgccggtggcggccgccgtacgcggcagaggcgggtcaggaaccggcggcgcagccgcggggagccgagggttgacagggagtacgacatggtcatcgtgccgtccgacggcggcgggtgcctgtccgggacggagtccgacgattccgattggtccatcggctggctggagccgcaggcgccggagatgcagacggacggtgaccccgagacctgcttcgccgtcctcgttccctgctaccgccacggccgcgcccaggagcccgcggtgcctgagggccgcttccttggcgccggtgctctcgccgacggtggcctctctgatggaaagaattttgtagaacagtggctttcctccctccagaattgatga

SEQ ID NO: 339 - DNA, 1274 bp, Brachypodium distachyon
gcgtcatgtcgcatcatcttcacctgcgtggctcggttcctccgctgtccttccgcggtggactggacgctcgcttttcgcccggtgtgccctggcatttcgctagcagcagcagcaacgtcggcgtggctgcagcatcgtctgcacgaaccctccggccgccgcagcacagggcgaaggtgatggcgaaggaggccggggagcaggagacggcggcgctcggctgggcggcgagggacgcctccggtgtcctctccccgttcgacttctccagaagggctcagaaagacgacgatgtgacgatcaaggtgctctactgcgggatctgtcacactgatctctacatcatcaagaacgaatggggcaacgccatgtaccccgttgttcccgggcacgagatcctgggcgtggtgacggacgtgggcagcggcgtgaccaagttcaaggccggcgagaccgtgggcgtgggctacttcgtcgggtcgtgccgctcctgcgaatcctgcggcaacgggtacgagaactactgctacggcatggtgctcacctccaacggcatcgacgccgagcacggcggcgccgtcacccaggggggcttctccgacgtgatcgtcgtgaacgaggactacgtggtccgcgtcccggacgggctgccactggacaaagccgcgccgctgctctgcgcgggcgtcacggtgtacagccccatgatgcgcttcggcctgaacgcgccagggaagcacctgggcgtcgtgggcctcgggggcctcggccacgtggccgtcaagttcggcaaggcgttcggcatgaaggtcaccgtgatcagcacctcgccggggaagcgcgaggaggcgatcgagaagctcggcgccgacgacttcctggtgagccgggaccccgggcagatgcaggcggcgttcgggaccatggacggcatcctggacacggtgtcggcgtggcacccgatctcgccgctgttcgcgctgatgaagcccatgggccagatggtgttcgtgggcgggccgaccaagccgctggagctgccggcggtcgcgatcgtgccgggcggcaagggcatcgccgggaactgcgtcggcgggatgagggactgccaggccatgctggacttcgcggggaagcacggcatcaccgccgaggtggaggtcatcaagatggactacgtcaacacggcgctggagcggctccagaagaacgacgtccgctaccgcttcgtcattgacgtcgccggcagcctcggcaccaccgcgtagtag

SEQ ID NO: 340 - DNA, 434 bp, Brachypodium distachyon
cggccatggagaacctggcgatgctgtggggggtcatcgggccgggcgtagccggcgcgctcttcggcgccggctggtggttctgggtcgacgccgtcgtctgcagcgccgtccaggtctccttcatccactacctccccgggatcttcgcgtcgctggctgcgctcatgttcaattgcgtgaacaaggaggacatcgggaatgattattactcctcctatggggacgattccgagtggagggtgaagctttggctttttgtcgcatatgttgtttctttcgtctgcctagctggatcagttggtttgttggtgcaagatgcattgacagacaagggtccttccgtgtggactggtgttgctggtgttctgcaatgtgttttcgtattgataagtgggttgacatattggacgtgccactctgaggagtaataa

SEQ ID NO: 341 - DNA, 2164 bp, Brachypodium distachyon
aaagatatccgtcatcatggaggaggacggcgcctccgcggcggaggcggcggtaccggctgccacgaagccgctcacgcccgaggaggaggcgctccggcgcaacaccgactgcgtctacttcctcgcctcgcccctcacctgcaagaagggaaatgaatgtgattttcgtcacagtgagattgcccggatgaaccccagagactgttggtactggttaaatggcaattgcttgaatccaaagtgttcatttcgccatccgccaattgatggtatgtttggtgctccaagtcctggaatacctgcagtttcttcacactatgctgcttataacttgggcaagcagatggtcccttgctattactttcagaaagggaattgcgtgaaaggtgataaatgccccttttaccatggaccacagtcgactggtaataatccaccagaacaggtggcgaaggtttcttcatttcctttggagcagcctcagacccaaaagaacgatttgttgggtataaaggagtctgcacggacaaataatttaattcagcgaggtggtccaataattgatgacaggtccaaaatggccgttgataggcctacagcaaattctgccaagacacctgcagatgcaatacctgctaaacttgcttccagcgcattgaaatctttgcccaagtcagagaagctacaaagcagtatgccagcagcaaagagaagtttcagaacctcttcaggtgaggatcatcctgagtgctatcacaacaatcttatcgaaagtgatcctgtgcaagattggaatgaagattaccgaccacctgctgatgatgacttgccccagaacagtagagaggctgatgaattgccaggtgagtcttcacctggttttgatgttcttgtggacaatgatggagatgctgctgcttatttgcatgacgaggaagattttggaagggatatgtatccagtggaggattatgaatatgctccggctgattttgaaattccgccacatcatgaaagagagctgttcaatcgaatgggcgagcaaggcccagtcggacaaatttatgatggctatgaaaggaagcgccgtagaacatcatctgagaggaacatggacagaccttcccattcagaaagaaggtcccgtcacagagatattggtcatgttgagatagatggatcagatttacgtcaccgtctccgcagaagaaaaataaatggttcttcaggcactagcccggaacgcagtggagagcaccgccggagggatgaacgctatagggaaagggcgtacgatggacaccatacacacagagatcgccatcggagccctcgaggaagcactttaagctctcgcctgcaaggcagaataaagcttcctggaagatcacctgatagagtggttactagctctgagaaagagcaagatagaagaccactccgggaaaggctgtctccagttaagcatatggatgttcagggtgtgaggcatcgggaggcagggcaacatcaagagaggactctgcggagatcaagcgaacttccctccagtgctaggaatgcagatggacagcatttgaggaggaacgtaacagaatcactcaactttggcaggaaggccaatggaagggttgaatctgaagcatctcttgattttgaaggtccgaagcctctcagcatcatcttgcagaagaaaagacaggctacatgtggcaatggctcatctgcccacaatggcaaacaagataaatctgccaaggtctcacataggcaacctgagtctattgttgaaactgagaaggaaggctatgacaacattgtcagttctgaagaatacaagagtagatcaggtgatgaatacaaagaggaaagccgtatccctgcggagggccatggccaatcttcatctcatggtgacaaacctgagacagaagacattattgaagtggatcccgtggtaaatcaagaggctgataactatgagcagggggagggggagtccgactacgatgcagctgaaggccaagaatacaaatctgaagatgagaatgcatatcaaaacgatgaagacgagtttgaagatgacgatgattttgcccggaaagtaggggttgtcttctcttaagctctggttcgtttcttggttatgtaggaattcttt

SEQ ID NO: 342 - DNA, 2450 bp, Setaria italica
aggactgtgctgctgatttgtctgaacccatggagactactagctcaacaaatgaggataccggtagggggacaatgtgggagctggaaaggaatctcgatcagcccatggatgcagaggccgggagattgaggaacatgtacagggaaaagacatacccaacacttgtgctgttacagttagctttccaaagccttggtgtggtgtttggggatttaggcacatcacctttatatgtcttctacaacattttccctcatgaaatagaagacacggaacaagttattggagcactctcgcttattatttactcccttactctgattccacttgttaaatacgtcttcattgtcttgagggcaaatgataatggccaaggtggaacatttgctctttattcactgctttgccggcatgcaaagataaacactattcctaatcagcatcgaacagatgaagacctaacaacatacagtcgccacacatatgatgagaaatctcttgctgcaagtatcaaaagatggttagaggggcaccaactcagaaagaatgtcattcttattattgttctttttggtacttgtatggccgttggagatggaatcctcactcctgccatatcagttctttctgcgactggaggaatacaagtggaagagcccaaaatgagaaatgatgtggttgtcatcgtctctgtggtcatattgattggattattcagcatgcagcactttggcactgataaagttagctggctttttgcgccaatagtgttagtttggttcattctcattggaatactaggcgctgtaaacatctacaaatacgatcggtctgtcctcaaggcgtttaatcctatttatgtctatcggtacttcaagcgagggaggactagctgggcttctttaggaggaattatgctcagcattacagggacagaagcactgtttgctgatctttcatatttccctgtacaagctattcagattgcttttaccgtggttgtgtttccctgccttcttttgcagtatactggccaagctgcctatatagctcagaatacacacagtgtcccccacgctttctattattcccttccagcttctatactttggccgtcattcattgttgcaacagctgctgcaatagttgctagtcaagccactatatcgatgacatattcgattatcaagcaagcacttgctctagggtgcttccccagagtgaggattatccatacgtccaagaagtatcgaggccagatatacagtcctgatatcaattggatccttttgatattctgcatcgctgtcactgctggatttaaaaaccaaagccagatagcaaatgcatatggtactgctgtgataatggttatgcttgtgacaacatttctcatggtccccataatgctgctggtgtggcgcagccactggaccttggtcattcttttcaccacgctgtcattgattattgaaattccatacttcactgctgtggtgcggaagatcgatcagggtggatgggttcctcttgtgtttgccgctgccttcctcgtcatcatgtatgtatggcactacggtacactcaagcgctacgaattcgagatgcacagcaaggtgtccatggcatggatcctaggccttggtccaagccttggtcttgtcagggtgcccggtgtcggcctggtgtacactgagctggcgagcggtgttcctcacattttctcacacttcatcaccaacctcccggccatacactccaccctggtcttcgtctgtgtgaagtaccttcctgtctacaccgtgccactggatgaaaggttccttgtgaagcgaatcggccccaagaacttccacatgttccgctgcgtggcgcggtatggctacaaggacattcacaagaaggatgatgacttcgagcagatgctcttaaacagcctgatgctctttgtccggctggagagtatgatggaagagtacacagactctgatgagtacagcaccggccatgagctgaaccaggcaggcaacgccaacccaagaatcaatggcatcaacaacagttcaaacatggagctcagctacacatcccacgactccattatacaggtgcagtccccaaaccatactgggaacagccagttgatgtcgtcaggccagacgtaccagacggtgggcgacgagatcgcgttcctgaacgcgtgcagggacgctggggtggtgcacatccttgggaacacgatcatcagggctcgcagggattcggggttcctaaagaagattgctatcaactacatgtatgctttccttaggaagatctgcagggagaacagtgccatcttcaatgttccccatgagagcctactgaatgttgggcaagtgttctatgtgtaagcactgaaagtaaatacatacaagtagatgagatgttcttcagcctcaggtacc

SEQ ID NO: 343 - DNA, 4999 bp, Setaria italica
aaaggatccctagctaggatggaggaggagccgcttgccgcccgcgccaggaggtaggggcgggggcgcggccgatcggcggggtgggagtgaggggaatgagggcgctgcagcagcgaaccatgcgagatctctacgatcatacgcggcacaaggatctcgcggcccccgaggaaccagcggaagggcgcggcggaggacgcgcggaggggtcggggtaccgcgaactggtccccaaggaggacaaggctgcagtaaggaaaagattggtaccgagcaatagcactcgtttgaaggcagagtcaggcacctgtaatgtctgttatgctccttgctcctcctgcctacaccgaagtcttgcagttgaggattcaaatgctgaatgtgcatcatctcaaacatgctctgcaaggtcagaagtaagaaacaattcactcgttcgtagtgagaaagggctccacaataaaggagaaaacgacgatgaatttagtgcaacctcaggtcatgtttcctactctataaccggtggaaataataaagtgttcgcaagaccatccattgcagacgactcttcagaggtagacatgccagcaaaacgtagaaggctattaaatcaaaacaaaaaacaatctagagcagaacaccatgatgacagcaactcgtgtgttactggtacatcagcagaaggcaagcttcacgcggataagaaaaaactatcgacttctgcatccagtcgagatttgactgctaatgattataaagacaacagcatggtttgccgcagcagattaaaaaatcaatgtgttgatgaatctaagaaaggatctgatgctcatgacatgcatcctagctcatctggtagactgtttcctgcagattctcctatttcaacaaagaagttgctgcgaacccagtcttctgtcagtgcatcaagcagattatctcctaagaagaaagctcacgaatgtgggacagtgcaagataattcatctcatcaatcttgtgaaaaggtttctctttcaaagaataacgttgaacaaccgcgaggtggaaaactggacccttgtgtagctggcagcggcaaccatggcacgttggcaggttacagtaacataaatgcaaacaaagccggtttctcatcgaaggatctggagaatggcagctcatgccgaaaagatgaaattcaggaacatgctggcatccaatctaatgatggtgttactaggaatgagggtgacaaacaagaatgggatcaagattgttcaatggatatttctagtgatggaaagttgaatatacaacatgacatgatgacagactgtgggacttcggaaggcttgatagatgttaatgtttgtgatatatgtggagatgttggtagggagtatcttctagctacatgtactagatgccttgagggggcggagcatatttactgcatgcgagtgaagttggataaagtcccagatggtgaatggttgtgtgaagaatgccagcttagggaggatcagaacaatacaagaagtaactatggtgtcacggcggttaatatgtctgaaggaaagaagaaccaaagttcagaaagtcgaaacaagccaaaggcattgcaaattgttgtgcctgaattggatgctcccgaaagcacacgcagcacaccaaaagctgatcagtgtgatggtaagaataaaaaattgcacttagcttcagctgatacacaaacacggcaagcaaaggttacccccctagcttctgaaagactggatgtgaagagcaaaaaattattgagcattgcaaaccgtaacaagcaagtgcttccatctgatttggatgcacggccacacactcatggaacaccgacggctggaggctcaaacaagaaatgtcaaagttcagaatttttgttaaaccgcaagaagttgcgagtttctaccgatatggagtcaccatcttcaagtgaaggcctacggagtccaacaatgtcatgtaagagacaggcagagaataattcatcccctaagcctaggctcttaaagacagacagctttagaaaacatgatgtcatctctcgtgagaactcgtttaagaaatcagacaagggaggtttaacttcagttgataatgctccagtaagaactactcaagcagtcaaaaattctcaggccttgtcacggtcatattccttgggtaacatggttgctaaaacaccagttccttcaccaaaaggtcttttgtcgaagcaactgtctttcaacagcaccaacaatggaccaaaggtcaagcagttggctgaaggggtggctagcaagttgagacctgcgaaccattccccaagagatcctagagataagggggccgtaaaaaagctcgtacaatctggatctttcaaacgcgagggttcagtttgcttagatgctggctcatcaaaacaaaagcaaacatttcatttgtctcaagatgaaaaaccaggaatattgaagccagtgaaggaaaagaatttgatggaaagaagggcttcctttagttttaaaaaaccgagtattccttcatctccaaggcctgacagttgtatgaagttaggtgaaagaaagaacgaccaggatatttcaaggtctggatcaagcatacttaaaagtagcaaaagacctggaaatgttgaaaagaagcagagctctgatttgtctaaaagtgacaatgacaagcaagatgttactatacatccaaaatcaatgggagttgtttctggtaaagttgctcatgtacctgatccaccagtttcatcaaaatgtgtcaaaaaggaaagctcaaatggtgtgtctaaaagtgacaatgacaagcaagatgttactgtacatccaaaatcaatgggagttgtttctggtaaagatgctcatgtatctgatccaccagttccatccaaatgtgtcaaaaaggaaagctcaaatgatgttgaggatgaagatttattcatttcagtgaaaaatggtagcagaatgccaaatgagtctgcagaggtggttctcacatcgtctactaccatgacttctgaatcaggtttgcgagatgtggcaatagcaagcacctccgaagattcagctcctaaagtggtatgcttccaacaaaagcctttggaaagcacaggagatgactcctgtaaaattgtagaggcagctcaagcaacaggaagtatattgaatgagattccacccggtgttcagatggcacacaatctatacccccctgatgataaattggataaacctgatttgaagcaggaagctttcatggatcaatcatcagctcttgaaaatcctttaagagatttagttattccagagcagtcttacatctggcagggcagctttgaggtttcaagacatggaaactcccctgaaatatttgatgggtttcaggcttacttgtctatttgtgcctcgtccaaagcacgtgaagtaggtgaacaattaccagataaaattcagctagcagaagttccgcggctttcctcatggccactgcaatttaaagaagtaaatccaactgaagataatattgctctttttttctttgctaaagatgttgaaagttatgaaagggcatatggtaaacttttggaaaacatgcttctgggtgatttatcccttacagcaaatattagtggcagtgaacttctcatttttccatccgataaattgccagagaggattcaacgttggaatggtttacttttcttttggggcatttttcatgcccggaaagcaagtagcccaccggaacttcctctgactgggacaaataattgttcattacaacaaatcactgggtcagatgtgggttcccctaaagcactacagtctttgggtatagatttgaacgagtgccccaatgatgatatatctgacccagctatttcacttggatcagagagtgagaagtctggtgcatttgtagatcataatacttttttggtgtccaaacatgaggataggaagcttaatgcaagtgaaatacatcatgaagaaactgcagacgcaaaacaaattataccaggacatcctactgcagcttcctatggaattcatcctcccacattatcaacaggagaaggtcatgacatgattcggaattattcaactgctgcaaaaggtagcacaggaacagcaggtagaaacaaaatggaggaagatcagaatgaagctctcttctgtgctgcacagcagccaggtgccattgggtcaatctcagatgagataaaacctaagaaacatgatcttctgccctctatagaagtatcacaacgtcattttattggatcaaagatatgtgatggtccaagcaaattaattccaaattcagatatgggttcttttgatcctgacctcacctacaaaaggcagaagacttcatacggaaaatactctgcttgcagttttggagatgaaatgcaacctagcaaatgcttgtccaagatacatcccttaccggttggacagcataatccatttgatgatttacagtataattacagggttccctcagatcctggctcccttaaacaacctgtacctgatcatatcatccacgttctttcatctgatgatgaagattccccagaacctagtactagcttaaataaggcatcactgaaggcagatgagagctcctccccattgttgtcactttccctgtctatggtggcaacgaagcataatctttctggttcagatattgtagatgatgaaccgctgtctctctctcttgggctccctagtgttgtggaagggggtcgggctctggagatgaagcagtttctgccggagaagccaggcataaacacttagtgctttttaggtttgcgagtgtacagttttgtgctatgtttagctgtatggagtttagacagggtagatggtatagcttttaaattatgaaacattttgccttttcttttctcactattacatgcatctgctgctgttgatagtgatgctgggatatcttt

SEQ ID NO: 344 - DNA, 1929 bp, Setaria italica
acagtagtgttgtgttggcagcctcgctctctccgtcctcgtgagcgggcatggaggtctcagccatggaggaagccctccccaaccccaaggcgaggagggagggaggcctcagaaccatccccttcatcatctcgaacgagatcttcgagaaggtagccacgttcgggctgacggccaacatgatcctgtacctcaccgagcggtacctcatgtcgaacgccttcgccaccgtcgtcctctacaactggaacgccttctccaacttcctccccatcttcggcgccgtgctcgccgacgcctgcctcggccgcttccgggtcatcgcactcggctccttcgtcagcctctctgggatgtgtctgctgtgcctgacggcgatcctgccggtgtacaagaagacgccagagtgcgcggcgcgggtggcggactgcgaggtggtgccgtggcagctgccgctgctgttcacgtcgttcgcgctcatgtccgtcgggtcgggcggcatccggccgtgcacgctggcgttcggggcggaccagctggacaggcgggacaacagctccagcaacgtgaggacgctgcagaccttcttcaactggtactacacggtgctgggcctcgccatcgtgttcgcggccaccgtcatcgtctacatccagcagaccaggggctgggtcgtcggcttcgcggtgcccgtcgtgctcatggtcaccgcgctcacgctcttcctcctcggctcgcccttctacctcaaggcggcggcagacaggagcgccatcgtcggcctggtgcaggtgctcgtcgccagctacaagaaccgccacgagcccttgccgccggagaccgccgacgcctcgaccttctacaacaaagccggctccaagcccaggacgcccaccaacaagctaaggtacttgaatcgggcctgcgtgcttaggaacccgagcaaggagctgagcgccgacggggcggcgtgcgacccctggaggctgtgcacggtgcagcaggtggaggacaccaaggccgtcatccgcgtgctccccatctggtcgacggggatcctgcccggcgtgatcgtcgggcagcagatgttcccgacgctgcaggcgaagactatgcagcgtagggtgggcggcctggagatccccgcggccaccttcggcgtcttcagcatcctgacgctcaccgtctgggtggccgtgtacgaccgcgcgctggtgcggcccctgtcccggctcacgggccacgcgcgcggcctcagcctgcgccagcggatgggcgccggcctggcgctcttcgccgcggccatggccgtggccgcgcgcgtcgagagcgcccgccgcgccgccgcggtcgccgaggggctccgcgactccgacccgcggtcgggcacccccgtgcacatgtcggccatgcggctcgtgccgcagcactgtctgatggggctcgccgaggggctcaacctcatcggccagatcgagttctactactccgagttccccaagaccatgtccagcatcggggtgtcgctgctggcgctcgggctcggtttcggggccctgctgggcagcgccatcgtcggggtcatcggcgcggcgacccggggcggcgggcacgacggctggctgccgagcaacctgaacaggggacactacgacaactactacctggtcctggcggtgctgggcacggccaacgtggtgtacttcctcgtgtgcgcctgggcgtacggggaggagggccacaacagggtggtggcggccgacgccgaagccgaagcggcggtggaggacggcaacgtcaaggaggagcagcaaaaagcggtgatcatttaggcgtagggccagttaccggctttgagcactaggaaaacagtatagtgtttgatctgagatggtatctttctctggtctaaatcgtggtatctgg

SEQ ID NO: 345 - DNA, 1373 bp, Setaria italica
gggaaatggtgggctcgggcgcggctgggggcggcggggatcacgcgcggagcaaagaggccgcggggatgatggcgctccacgaggccctccgcaacgtctgcctcagctcggactggacgtactccgtcttctggaccatccgtccccgcccgcggtgccgcggcggcaacgggtgcaaggtcggcgacgacaacggcagcctgatgctgatgtgggaggacgggttctgccggccgcgggtggcggagtgcctggaggacatcgacggcgaggacccggtgcggaaggccttcatcaagatgtccatccagctctacaactacggagaagggctgatgggaaaggtggcctctgataaatgtcacaaatgggtcttcaaggaaccttctgaatgcgagcccaacatctccaactactggcagagctctttcgacgcacttcctcccgaatggaccgatcagttcgcatcaggcatccagaccatagctgtgatccaagcggggcatggcctcctgcagctgggttcttgcaagattatacccgaggacctgcacttcgtgctgcggatgcgacacatgttcgagtcgctgggctaccagtcgggcttcttcctctcccagctcttctcctcctcgcggggggcctcgccgacgccgccgttcccgctcaagcagccggcgccggctgccgcgcgccccccgccgcagctcttcaactggccgggccaccagccgccgcagctcccgccggccgcgggcgcgtcgccgctcttcccgccaggccccgcggccgcgttccacccgtcggccgcgcgcccgatgccgccgttccctggcggcaagcaggacgagggccacatgttccacctcccgccagcgcaccatggcggcggcaagccgccgcacatggacgagcagcaccagcagcaggcgatggggccgggcggcggggaggctcccgacggcgacctccggtggcctaacgggctgtccttcttcaccgccctcaccgggcgcgcggacgacgcgaagctgctgttcggcggccccggtggaggcggaggcggcgcggacgaggagaaggcagcgccggacgccgcacagggcggggccgagaacgtggaggagtacctcagcctggagagccactcgaacaaggcgaggagggtggagagcgccgcccagagcaccaagttcaagaggagcttcacgttgcccgcgcggatgagctcgccggcgtcgacgtccccgtccgtgtcggcctccacggcaccgccgccgccgcagcagcagcagcaagggatggagtaccgaggcccgcacgagggcggcgtctactcggacctgatggagacgttcttggagtagtag

SEQ ID NO: 346 - DNA, 595 bp, Setaria italica
ccgaagatgggggcgtcagcagcacccttcaccggtggcttcctctgcccgaccaaaccaaggacaccaccgctcccgtcctccacctcccgatcttctcactcccgcctccacttccgcatccgatcccccaaacccaagaacccggcggcggcgcccgtctcctctcgcatggaagcgtccctgccccaggcgcgcgacgcccagggaggggcggagtcggccatgaagctgctgttcgtggagatgggcgtcggctacgaccagcacggccaggacatcaccgccgccgccgtgcgcgcctgcaaggatgccatatcctccaactccatccccgccttccgcggcgggtctatacccggagtgaacaccgaccagatgaagctgcagatcaagctcggcgtgccgaggtcgacacagcacttgctggatgctgagagagtcaaagccgtcttcccctatggcgagataatcagcttcgaggttgtcgatggcggcatgatctgttcgagcggcgtgtgcctggaagcaatgggggacaaaaacgacgactgctacatagtcaacgctgcagtttacgtcggctattgatgag

SEQ ID NO: 347 - DNA, 1439 bp, Setaria italica
tcagcacaatgcgcctcgccggaatcctctccgcctccaccgtcctcctcccccttctcctcgtcctcggcgcgtctccgccgtgccatggcgcctcaggccacaacatcacggacatcctcgcggcccacccggacttcaccgagttcagcgccgccctgacaagcaccggcgccgcggcggagatcaacaaccgcaccaccatcaccgtccttgccgtcgacaacgacgtgatgtcgcagctcaaggcgcagcagctccagccgagagacctcgagcgcgtgatctacctccactgcctcctggactacttcgatgccaccaagctcggtagcatccggggtggtttcgtccaggccactagcctctaccaggcaaccggcaaggcgcagggaggagaaggaatggtgaacgtcaccatgttccgcggcgggcgtgtcgcgttcgctctgtccggcacctcgaacgtgccgccggccgcgttctaccagaaatccatcaaggaagagccctaccaaatcgccgtcctgcaggtgagcgccccgatctggtctccagcgccggtggccggggcgcaggcgcccgctccagagccgccggcgccgggattggcggatctcctgtccaagaacgggtgcgggggcttcgccagcctccttgccgcgacggccgacgctgcggcgaaattcgagcgcagcgccggcggcggcggcgggctcaccgtcttctgcccggacgacaaggcggtgacggccttcgacgccaccttcaagaacctcagcgccgacggccagctcgcggtcctgctgtaccacggcgtggcggcgcactactccgcgcagtctctcaagacgatcaatggggatgtgaacacacttgccactgacggatccaagggctacaagtacaacctcaccgtccgtgctgacggcgacacggtggaactgtcgtcggcgtcccagagcgcggccaaggtgaccaagacggtggtcgacaaggggcccctcgcagtctatctcatcgacgccgtgttgctgccaagtgagctcttcaacgccagccatggccgcactgcgcccgctcctgcgccggcctcgtcacctgcccatgcgccgccacctgctcctgcgccggcctcatcgcctgcacatgcaactccacctgctcctgtgccggcctcgtcgcctgcacaagcacccacaccgccagccattgcgccggcgactccacctacgcccaggcgccaccccgcgccaccacaagaggcggacacccctgcggattcgccggacgccgacagccagccgcctgcagatcagaagaacaacggagctagggacacggtgtcttggagtcttggcatggtggtggccgccgcggtgccggtgatcgtgctcctgctgcagtgaagggttcatgctggttagaatgataggcct

SEQ ID NO: 348 - DNA, 1367 bp, Setaria italica
caacaccacctgccattgccgcgccgagctgagcctctagccgcgccaggagggcgcccgcctctgcctgcctgcctgcctgcctgcctgccgacatcttcggtagttgatggagttgcacaagtactggggcgtcggtggcaggcggtgcggcagctgcgaggcggcgccggcggcggtgcactgccgctcgtgccccgcggggggcgcgttcctctgcacggcttgcgacgcgcgcccggggcacgcgcggctcgcccacgagcgcgtgtggatgtgcgaggtctgcgagctggcgcccgccgccgtcacgtgcaaggccgacgctgccgtgctctgcgccgcctgcgacgccgacatccacgaagccaacccgctggcgcgccgccacgtgcgcgtccccgtcgcgcccatcggatcggaggccgcggccgccgccgtcgaggccatgcttttcgggaccgccgaggcggccgcgtccgaggccgatgagccgcacaacgccacggccgcggcggcggccgggcaccagcaccagcaccaccaccagcaccacgcgctgaacctcaacgtggaggccaaggacatgaagctcgactacctcttctccgacctggacccctacctcagcgtcgagatcccgcgcttccagcacgccgacagcgtcgtccccaacggcgtcggcgccggcgccgggggtgccatcgagctggacttcacgtgcggcatcggcgtcaagccctcctcctacagctcctacacggcaacgtccctcgcgcacagcggctcatcgtcggaggtcggcgtggtgccagaggccttctgcggcggtggcggcgggagcttcgagctcgacttcacccggcccaagccccaagcctacatgccgtacaccgcgactcctcagagtcacagcgtgtcgtcggttgacgtggaggtggtgccggagcggggggacatggcggcggcgaggccggtgccgctgatgggggagagccgggaggcgcggctgatgcggtacagggagaagcggaagaaccggcggttcgagaagaccatccggtacgcgtcccgcaaggcctacgccgagacgcggccgcggatcaagggccgcttcgccaagcgcgccgaccacgacgccgacgccgacgacgctgaggccgaggccgccgtgccgtcgtcgtcgtacgtgctcgacttcggctacggcgtcgtgccaagcttctgatgatggcgacggtctcggtccacggatggccggccggcggcgccgcgcttgacccggctctcgatggcgcgccagccttgtacttgtatcgatgtataggggaggaatagtaatcccatgtactctctttctgcattga

SEQ ID NO: 349 - DNA, 1389 bp, Setaria italica
cgtctcgctgaattggttgcgcgcgcgccgtaccggtcggggacctgcgctccgcctccgctgctaccagcagaaactgcttctaggtttcctgcttttttctgtgggcacatctgcaaccgaattggtaaagatgggttgctgctttggaaagaaagctgaacaagccgttcaaggcgatggtgatgtacatagcgtgaaagtcttttcttacagtgagttgagaaaggctacacaagatttcagtggcgcaaataagatcggcgagggtggttttggttccgtcttcaggggagtgcttaaagatgagacagtagttgcagtgaaagttctatctgctacttcaaggcaaggcatccgggagtttttgactgaacttacagcaatatctgacattaagcatgaaaacctcgtcactcttatcggttgctgcgcggaaggctctcacagaatccttatttacaattaccttgagaacaacagcctttcacagacattgctaggaaccagatatagtaacattcggttcaactggcgggcacgtgtcaaaattgctgtgggtgtcgcccgtggacttgcatttctccatgaggaaatccggcctcccattatccaccgggacataaaggcgagcaacattcttcttgacaaggatctcaccccaaaaatttctgattttgggttggcgaggctcctaccacccaatgcaactcatgtgagcacccgagttgcaggcacattagggtacttggctcctgaatatgcaatccgaggtcaagtgacaaagaagtccgacatctatagttatggagttcttcttttagaaattgttagtggcagatgcaacaccaatacaagattaccttccgaagatcaatttcttcttgagaggacatggggcctctatgaggaagaacgtttggaagagatcatcgatatcgacgtcggtgatgacctggatgtcgaggaggcatgccgtttcatgaagataggcctgctatgcacacaggacgcgatggcgcgtcgtcccaacatgaccaatgtcgtccggatgctcacaggggagaagagaatcaacgtagacaagatcactaggcccgccatgatcaccgactttgcggatctcaaggtcagcaacaaggggcaaagatcaagcgagacacgctctcccgcgacgactgcacccacaacgttcaccactacagaaccattctcatcgtcagaaacgcccacgcagtcatccatgtgaaattctgaacgtcagaagcgtcctttttttctctccctcagtttgtatattgtgtgaattgtgatagaagggtcaggttacatgcaatttttgatgagtttcttgtttgatttgttatgaggaaagatctcataggcagc

SEQ ID NO: 350 - DNA, 1031 bp, Setaria italica
aaactcctctcttgcccattggcaacactgaggtttgaaagatggctatcttggttatctcggtggacctggaatgctgccgctgcagagccaagatcaccaaggtcctggactgcctcaaagaggagttctgcatcgagaaggtggagttcgaggagaagctcaacaaggtgattgtgcgcggcaagttcagcggcgagcagctctccaagaagatctggtgcaaggccggcaggatcatcaaggagatcaaaatcgtcgaggtctggccgccgccgccgcccaagccggacccccctaaggaagatccaaagccagagccacccaaggaagaacccaagccacccaaggaagaacccaagccggacccccctaaggaagatcccaagccccccaaggaagatcccaagccgcccaaggaagaacctaagccgccgccgccgcccaaaccagaggtgaagtgggtgccatacccgtaccctctgccgtacccgtggtcgccgtcgcagagctggccgtgctcgtgcccgccgcagcggccgtgccagtgcccgccgccgcggccgctgccgtggcctcctctgccgccgcactgcacgtgctccaagaatgacgacaagcacgacaggtgcagcgcctgtggcggcgaaaggcccgacccgccggcaaagccgccgtgccagtgcggcgggaggccgccgtggccgccgtgcagctgcggtcccaacaaacagccgttctggtggccgccgccgcctccgccgccgccgggggtcgtctacccgccgccgtggtgcaatatcgtcaccgaggacaacccgggatgctccatcatgtgacaactgctgcatgctaatggcatcagcactctgctctagccgggtttcgatttcctctgctaatgggcctcggagatcgcaataatccgacactagtcggtgccgttcgtgcacactctgaagctttttgtggttggtccttgcgtcgtgttgccatttgggttgtgcagtgtgtgcgttgtgcgttcaact

SEQ ID NO: 351 - DNA, 1035 bp, Setaria italica
ctccactccaagaacagcaaagcccacgcacaccgaagcagtgagcgaccgccagccagcccaaaccccacatggccgcctccgcaatgctgctcctgttcctcctgctggcgtcgccggcggccacgcggctggcctccgccgcctgcgcgagcgagaagttcccggcggggcgggcgtacgcgacgtgcgaggacctccccaagctcggcgcgtcgctgcactggacctacgacgcgtccaagagctcgctctccgtggcgttcgtggccgcgccggcggcgcccggcgggtgggtggcgtgggggctcaacccgaccggcgagggcatggccggcgcgcaggcgcttgtggcgctcaaggggtccgggtccggggcccccaccgtgaagacgtacaacatctcaggctacgggctgggcgcgtcgtccccgctcgagttcccggccaccgagctcgccgcggacgccggcggcagcggcggcaagatccgggtgtacgggaagctgcagctgcgcaaggggatgaaggccgtgaaccaggtgtggcaggtggggtcctccgtcaccggcggggcacccgacaagcacgcgttcggggccgacaacctctccgccaaggccaagctcgtcctcgccggcagcaaggccgccgccgcgggctccccttccctctcgcccgtccccgcgcccgaggccggcggcccgtccgcgtccggcagcggcaccgacagcggcgcggcgtcgtccatggcgccgtccgcggggaagagccctaacgccgctgcgctcaccgcggccggtgtgtccgcgccggcgctcctgatgatggcgctggtgggtttcttggtgacggtatgatgatggcggtagatggattctaccaagcatcattcatcagcgaaggtggcggcggcggtgggcaggagaggaagtattgcgctatttttgctgggtgtttttttggctgggggaggaaataaacattgttgctgtacttgttggttgttgaatgttgagctgttgtttggtagca

SEQ ID NO: 352 - DNA, 1514 bp, Setaria italica
gcggaatggcggggggcggcgggaagcggcgccgggtgggaggtgggggccacgaggatgaggaggaggaggagatggtggtggaggaggaccgcatctcggacctgccggacgcgctgcggatgcagattctgagcctgctgccgctcaaatccgccatccggaccggcgctctctcctcgcggtggcggtgcctgtgggagcagcggtggccggagccgtcgtcggtccgcatccgcctccctcccggcgcggcgggggcggcggcgcgggtggagcagttcgggctcatcgaccggcgcgggaggcgccggatggactgcttctcgctcgccttccacggcgggcagctcacgcagccggacctcaggcgctgcctcgactacgccgcggtgtgcgaggtcgaggacctgcacctccgcgtcgacggcggcgcggggaggggatcgcgcgggggcgggggcacccgcggccggggcatgctcaccgtccacttccccgtcgggagccgcctgctcgcgcgcctctcggtgcgggggctcaacctcacggcggccgccaacgcgatggtcgccacgctcgaggtgatccacctccactcggtgttcctcaccgacgccgcgctgcgacgggtcgtcgccgcctgcccccgcctccgggagctcgacctccgctactgccgccgcctccgccgcatcgacttcagcgccgtgggggtgcccaacctcaggaccttcaccctcgtcgactgctcccgcaccacggaggtgcgggtccccatggcgccgcgcctccggtcgttccggttgagcggcgccttcctctccagcaacatcctcacgggcgctgggggctcacttgagcatctctacctctgctccggcgggccggagaacggcttgccgcccaccaacttgcccatctcggttccccacctatcgaacctcagtgtcctcaccctctgcagcattgcactccagtacatttctgctttcacagctaaggccgtagtggagagcaagctgcagagcttgagagagctcaatttcctcatgttcggcatggccaactccaaccttgctgacatctacagcttcctcaagacatgttcctgtcctcagttggagcggctctttgtgcagctcccgacgaacgttcgtgattcattcacggagaatttcttggaggtagcggaggaagagccacctaaaggtggattagaaaacctttggttagccaagatgacaaacttcaaggggcaccgtaatgagatgcaactagtagaatttctgcttagaaagtctagttgtctgaagaaactatttctgattgctcctacagaggatcaccctcaaggactccgcaagattcagtcggatgtgctgcccagttttctgaaaacagaaataatgcatttggaaagagcttcagcaaatacccagataattttcagtgagcctgatggtcctcagatccaaccattgcattcggaggtctttgtcaggttttagtag

SEQ ID NO: 353 - DNA, 1037 bp, Setaria italica
aggaatctatggcggcgtcgacggcggcggcagcggcacccccttcctcctgcgagatcgcgcggatcccggaggacctcctcgcggcgtcgatcgcccgcaccacgccgcggaacgcctgccgcgccgccgcggtctcgccggccttccgcgccgccgccgactccgacgcagtgtgggcctgcttcctgccgggcgacctcccgccgcttgccgacggggagctctcccccgcgccgccgtccaagaaggagctcttcatgcgcctctctaacagcgacagccccgtcctcctcgccgaccgcctcatgagcatgtggttggacagggacaccggcgccaagtgctacatgctctcggcgagggcgctgtgcatcatttggggcgacacgccgcggtactggcgctggatccctctcgctgactccaggttctcggaaggtgccgagctccaggatgtttgctggttggaaatacgtggcaagatacattgcaagatgctctcgcgaaactcaacttatgctgcttacatggtgttcaagatatccgatgaatcctatgggctggattatccaccccaggaggctgcagttacaattggggaaagcaaattcactcgtcaggtttgcctccaaggccatgagaacgagggtgagggcatagaagaggtgcctcagaattaccgatctcttatggttccagccatcacacgaaggttaagaagaaaccgtcctttgcctcatggagtgactgtgcctaagaaaagggctgatggctggatggagatggaaatgggtgagttcaacaatgaagaaggtgaggatggtgaggtgtctatcagtctcatggagacaatacaaggccactggaagaaaggtcttattgtgcagggcattgaagttagagcaaagaaataaaactgggagggtgggatatcgtctttgcacatcaaaataaggctatatgtatatgttttgcagcattgtgttggtggacaatgtgcttttgtttgccaacgagctgctaactacacatag

SEQ ID NO: 354 - DNA, 428 bp, Setaria italica
tcagagagaccaaggcaaggcagcgagagaaagagagagtgagcggcagagcgttctacatgggcggcggcggcatggtgttcgagccccacgccggcgcggccgtcggtggcggcgacgtcgtgttctgcgtcgccatcgcgctcctgtcgctcctctccatgatcatcttcgcggcggccgccgggggcgaagggaagccgcggcgaagtgggcgcgccagcgggccggtgttcgtcggcgggaagggctgcggctgcggcgggtgccgcgcgggcgccggcgtctgcggcacctacctctcctgaatcctgatcgaccacgcgcacgagcagagagcatcggcgccgcggcctcggcgaccggcaaacccaggctcgccggcgtgcacgcgctgtacatacacacggcactgctctaaactttag

SEQ ID NO: 355 - DNA, 1477 bp, Setaria italica
ctgccgcggtaccctatggccccggccgggcggctcctcgcggtagccgccctctctgtcctctgtttgcagggtctattgcgcgattcaggcactgcatttgctcagagccacctgccgcttcaccggatcgttcacgcaggcgaaaatgacggcggcctcatgccggagctcccgcccagcggcctcatgcccatgcccgagctctcccccagcggctcaccgaagccatttgttcccttcctggctcctgctccgctcgcgcccttctttaacaacagcacgcccaagctctcagggaaatgcacattgaactttaccgctgtcgataagctgatgaccaccacagctgtcgactgcttcacctcgtttgctcctttcttggccaatgtcatttgctgcccccagcttcaggcaacactgaccatcctcatagggcagtctagcaagcagacagggtctctcgcattggatcccaccgtcgccaactactgcctgtcggatgtccaggagctgctgctgagccaaggtgccagcgataacctccacagcctttgctcggttcacctctcgaatgtcaccgagggatcatgtcctgtcagcactgtggatgcatttgagagtgtcattgactcgtccaagctccttgaggcctgtcgaaagatcgaccctgttaacgaatgctgcagtcagacatgtcagagtgctataaacgaggctgcccagaaaatctcgtccaaggatggaggtttgacgagctacactgggagcctgaaaattgatagttgcaggaacgttgttctcagatggttgtcgagcaggcttgacccaccgtccgcaaagcaaatgctgaggcagatatctaactgcaatgtcaacggagtttgcccgctaagctttccagacactagtaaggtggcaaaagagtgtggtggaataatcaagaacggtactacatgttgcaaggctatgttaagttatgtagcccatttgcaaaagcaaagcttcataacaaatttgcaagctttaaattgtgcttctttccttggggcaaagttgcaaaagatgaatgtcagcacgaatgtctatagctcttgtcaaataacactaaaggatttttcacttcaagttggatctcaagaatctggatgccttcttccaagtatgccttcggatgcatcctttgaccgcatttctgggattagcttcacatgtgatctgaatgataacattgcggccccatggccatcttccatgcaagcaccatcctcatcgtgcaataaatctgtcaatattccagagcgacctgctgcgacatcggcacaaaatggtgtgaaccacaagaacctgaagctaagcctgcttgtttctctggtctcccttgttctggtgctcgtggtgcaagtttagtgcagtccagtttggcaattattgagattcattcaggagagctaactggaagtgttggtgaagagct

SEQ ID NO: 356 - DNA, 4119 bp, Setaria italica
aaaggatccgcgacatgccgtctctgcagctgctgcagttgacggaccgcggacgggggcttctggcttccaggaggaggactctcgcggttgtttctggcgcgctgattgctggtggagctttggcctatgcccggtcaagtcaaagccagcggagcaggcgttcggaggcaaattatggcagcgaagccagtgaattggccaccaatggggatgggttgagtcaaaattgtagattggctgcaacaaagcagaaaaagagtgggcttaaatctttgcatttcctaactgctatcctgctcaagaagattggtcccaatggcacacgctaccttctaggcttggtattaacagcggtgctgcgtactgctgtggggcatagattggcaaaagttcaaggctttttgtttaaagcagcatttcttcggcgtgtcccaacatttacacgcttgatcatagaaaaccttatactatgtttcctccaatccacattatatcagacatcaaaatacttgacagggtctttaagtttgcgtttcaagaaaattttaaccgatatcgctcatgctgattactttgagaatatggtttactacaaaatgtcacatgtggatcatcgagtatcaaatccggagcaaaggattgctagtgatatcccaaagttctcttctgaactaagtgagcttgtacaggatgatctggctgcggttgcagaagggctaatatacacctggcgtctctgttcgtatgctagtccaaaatacgtgttctggattatggcatatgtactagttgctggtggggcaataaggaaattttctcctgcttttggaaaactgaaatccacggaacaacaactagaaggagactatcgtcaactgcattcacgattaagaacacatgctgagagtgtggcattttatggtggtgagaacagagaagcatctcatattatgcagaggtttgatgctcttgttgggcatctgaatcttgtgcgtcatgaaaactggtggttcggcatgattcaagatttctttctgaagtattttggtgccactgtggcagttgtccttatcattgaaccattcttctctggcaaccttagacctgattcatcaacccttggaagggctgaaatgttgagcaatcttcgatatcacacaagtgtgatcatatcattgtttcagtcccttgggattctttctatcagttcaagacgtttaaatatccttagtggctatgcagaccggattcgtgagttattggatgtttcacgtgagttgtctggtattcgtgataaatcattgaatcacaattcttcttctggaaattatatcagtgaagcaaaccatatagaattttctgatgttaaggtagtcacgcctgcaggtaatatcttggttaacgatttgactctccgggtagaaactggttcgaatcttttgatcactggtcccaatggtagcggaaaaagctcccttttccgggtccttgggggtctatggccactggtatctggccacattgttaaacctggtgttggttcagatctgaataaggagatcttttatgtcccgcaaagaccttacacggctgttggaacactacgtgaacaactaatctatcctcttacagaagatcaggagattgaacgtcttacctatgatggcatggtggaccttctaaagaatgttgacctggaatacttgctagaacgctaccctcttgataaggaaattaactggggtgatgagctgtcccttggtgagcaacaaagattgggaatggccaggttattctaccataagccaaagtttgccatccttgatgagtgcactagtgccgtaacgactgatatggaagaacgtttttgcaagaaggttcgagctatgggtacatcctgcataacaatatctcatcgcccagctttagttgcatttcatgatattgttttgtccttggacggtgaaggcggctggaatgttcagcatagaagggaggactcttccttttccactgaagagtctgatttttcttcattagaaactgatcgtaaatctgatgcactgactgttcaaagggcttttatgagcagggcaaagagcaatgcttcgttggggtccaaggaccattcgtactctacagaggtcatagcaacatcccctaaggtggaaatagaacatgcagtacggacatctcgggttccacatttgcgatgccacccaagacctttgcctctcagagtagctgcaatgctcaaaatactagttcctaaactacttgataaacaaggcgggcagttgcttgctgttgctgtacttgttttctctcgtacatggatctctgatcgtattgcttcattgaatgggacaactgtgaagttcgtcttggagcaggataaagttgcctttattcgcttgattggtgtcagtattctacaaagtgctgcaaattcttttgtggcaccatctcttaggacccttaccgctaaacttgcccttggatggcggattcgcatgaccaatcatttgcttcgatattatttgaaaagaaatgcattctacaaggtattcaacatgtcaggtaaaagtattgatgcggaccaaagattaacacttgatgtagacaagttgaccactgatcttgctggcctagttactggaatggtaaaaccagtagttgacattctttggtttacatggagaatgaagctcttgtctggacgaagaggagttgctatactatatgcttacatgttactgggtttgggcttcctgagagcagtatcccctgactttggtcgtctctcaggccaagaacaagaacttgaaggaacattcaggttcatgcactcaagactgcggacacatgctgaatcaattgctttttttggtggtggttcaagagaaaaagctatggttgatgctaaatttgtaaagttacttaaccactcaaagattctcttgaggaaacagtggctttacggtattgttgatgattttgttacaaagcaacttcctcacaatgtgacatggggtcttagtctattatatgctttggagcacaagggagacagagctttgacctcaactcaaggagagctggcacatgctctacgattcttggcttcagtggtgtcacagagcttcatagcctttggcgacattcttgagttacataagaagttccttgaactctctggtgggattaaccggatctttgagcttgaggagattatatgtgccgctcaaaggaataccgtggtgtcttccaatgccatcagtgcatcctcagaagatattatttcatttcatgaagtggacattgtaacaccatcacagaagctattggctagcaaactgtcatgcaatgtggtacaagggaaaagccttcttctgactggtcccaatggtagtggaaagagttctatatttagagtgctcagagatttgtggcccaccttctctgggagagttatcaagccctctgaagggatgtttcatgtccctcagcgtccatataccagcctaggtactctgcgggatcagatcatataccctctctcaagggaggaagcagagatgaaagttctctcgttacatcaagctggaaacagatctagtgcttccatcctgcttgatgatcacctgaagacaattctagagaatgtgcggctggtgtatcttctagaaagagaagggtgggattctacaccaaactgggaagatgttctgtcactaggagaacaacagaggcttgggatggcccgtttgtttttccatcatcctaagtatggcatcctcgacgagtgcaccaatgctactagtgttgatgttgaagaacatctgtacaggcttgcaactaacatgggcataactgtgatcacttcctcacaaaggccagctctgatacccttccatgccttggagctgaagctcattgatggcgaagggaactgggagctatgttcaatccgccagtgagtgatgccacacctgagctgatgctatcatatgcgccgtcagctgcatgtacaaaagcaagcagctatcgcattgccattgtgtatgataatagacagtggcagtgttggtgtcctgaaagacagctgaattcttt

SEQ ID NO: 357 - DNA, 809 bp, Setaria italica
aaaggatcctctagtcaaggtccgtctctccttgccgcctccgctcctgcgccgcccgcttcaccgcaggcatccggcagccggctctacaacccgacgacgtgatctccccgccttcaattcctctctcgtcctgctctgtgcacaccaaggaagatggtccgggaggtggccgagagctgcgtcgacggggtggtcatggagatggtagcggcctactgcggccgcttctacgccgccaagcccgagctcgcggcccgccgcatcgaggccatcggcttccaggtcggtcaccagctctccgagagatataccatggagcgccctcgatttagtgatcatcttgaagcaatcaaatttatctgcaaagacttttggtctgaactattcaaaaagcagattgataatcttaaaacaaatcacaggggtacctttgtccttcaagataaccgttttcggtggcttactcgtgtttctctagatccacctgcagagagcactgatgcaactgacaatgactctgcaccattgggtgatactgcagcccaaacaacaagcatgcttctgtattttccatgcgggttgataagaggtgccttgaccaacttaggaatttcatgttccgtctctgcagatatgtcaaaccttccagcatgttcctttgtggtgcgcataaagacatgaactgcgagaaatgatacaaatacagtattaagtgctggcttgtggttcaagtcatttgacacctacctgttttcactgtctttcaatgaaattccttcttcgccttcatgaccatagaattcttt

SEQ ID NO: 358 - DNA, 2580 bp, Setaria italica
aagaacaagcgagcgtggtggggaaggggggacgtcggggccaaccaccgatcgacggggcaccggcgccggcgcacgccatgaggctgctcgtccccgacggcgcgcgccgccagcggctgctgcagtgcgaggcgcacctgccgcctgcatctccgcccccggcgccggcgtcccctgctccggcggcggagccggcggcgggcgggaggacggtggtggtggggatcaggcgggacgccgccagccgggagctgctcacctgggcgctcgtcaaggtcgccaatgccggggaccgcgtcgtcgcgctccacgtcgccgcgcagcacgtcgccgccgccgccgacggattgctcatggggctggatgagcggagcagggccgcggactcgctcgcgtcggtgctcgccgtctacgacggcttctgcaacctcaagcagattaatttggagctcaaggtctgcggaggatcgtctattcgcaaaactctggtcaaagaagcagcttcctgtggcgccgcccatctcatcctcggtgttgccaagaattcccggtccttcggatcctcctccacatcagttgccaagtactgctcaaagagagttccggtgggctgctcggtccttgcagtgaacaatggcaaagttgtttaccataaagatgggggccacgggatgcaacatgaactgtaccaaagcacaatacctgagacaccaaggaggagctaccggaagctcttgtcatccatgataggagagaagctttgggatgaacatggaaaggacaacaggtccatttctcgtgccgtcaccatgccaatgaggtctcctgcctcatccataccaatgaggtctcccgcgcggtcaaaagaagtttcactagcattggtcccagtgaaggcttgccgccgcgaatcaccagaagtagcaactggatggcccctcttgaggaagaagttcttgccagaccggaaagcttccctgcctgacaaatcaaagatgtccgtggtgcagtgggcgatgcggctaccgagtaggtattctggagtttcaccagtccattcggaatacagaaccacaagaccagactccatgagtaccagtcatattctccgtgaccggttggttattcccttgaggagcaattcaggaaaatcttctgtagtaattcaagaattggacaaggaaactccagaggaactgaccttgctgaaagagaaattctcatccgtttattcttccttcagttacagtgagcttgcaaagatcacctctgatttctcaccagagtgtgtagttggacaaggtggcactagtcaagtttacagaggctgtttggcaaatggcagggagctagcagtgaagatcctgaagtattctgatgaggtgctgaaggagtttgtctcagagattgagattgtcagctctcttagccacaagaatgtcatttccctcattggtttctgcttcaagaatgatgaccttctgttagtgtacgagtacttgcaaagaggcagtctggaagagatactgcatggtgaaaaagaatgcaagaacatatttggttggactgagaggttcagcgtggccgtgggagttgctcatgctctggattacctccatggcaatgacaacagtcgtccagtgatccatagggatgtcaagtcatcaaacatcctcatctcagagtgctttgagccaaagttatcggattttggtctcgcagtctgggctgctgatgtgacatctcagatgacgtgcaatgacgttgcaggaactttcgggtacttagctcctgaatacttcatgcatggtaaggtgaacagcaaaattgatgtatatgcttttggcgtagtccttcttgagctcatctcgggcaggaaaccactctgcaatggttgtccaaaagggcaggagagcctagtgatgtgggcaaattccatcatacaaggagggaagctcacacaacttgtagatcccaacttacctactgaaggccataccaatgaagttgagaggatgacccttgctgcttccctctgcattagacaagcacctcagaaccgtcctcaaattgatgctgttctgaagcttctcgaaggtgacaacgatatcctcaagtgggcacgatcacaagtcggattagcatacgaggtcgatggtgatgaatgtgtgatgacaccaccagcaccagggagcaacgccaacatccagtcctacatcaacctagcattcgatgtggatgatgactccgcctctgtcagcagcaccgacttcattgcagccaacacctccttggaagagtatctgaagggaagatggagccggtcctcaagcttcgactgactgatccgtggcagagttacaccttgctagtgtatagatcctttttttttaattaagttacatttttgggccttggatgagagttggcacatgcaatgccctccaccgggaatttcatttgatcatgtatggcttagttttttttttatgtgggggtctttttacctctctgaagggaccccttttttactgtctgaagagacttgtcatacccaggtattctcatccaaaggga

SEQ ID NO: 359 - DNA, 1232 bp, Setaria italica
cgaccatggaggtatcctcgaggctccaaagcctcctgaggcccctcctccgcctcccctcccgcaccacaggcagagccctccaaaccctagcccttcgccccccgccgcctcctccccgcgtcccatcctccttcctcctcctccgcccgcgccgcctcccgcctccccatcctgccagcgccccgtcgcgcctcctcctccgccccttcgcctccgtcgccccggtccccgggagggaccacctcgactccaaggaccagggacccccgcccgcacccttgcccccgccgccgccggaggagctcgcctccgacgacgaggcctactaccacgagcaccttctcgaggtagcacaggagaaccagacaagggtcgtccccgtcaaggcgttcttcctatgcaccagcatcgacctgcggagcctccagtcccagaattccttcaatgtcatcccacccacatcgcgtgccaccaactacgtcgtccttagatactacgatgtcaagggagaccccgagggttttaagtctggtgtcatagatgagagccattgtcactacatggtcgttttccaatatgggtccatcgtgctgtttaatgtttctgatcatgaagcagatggatacctaaacattgtcgagaagcatgcatcaggtttacttccagagatgagaaaggatgattatgctgttgttgagaagcctaccttggagacatggatgcagggtggtcttgactatattgtgcttagggatctgagtattgatggaatccgcaccattggaagcgttctgggtcagagtattgctcttgactactatatccgtcaagtggatggaatggtagctgagttcacagatatcaatcgtggaatggaaaaaactggcaccttcactatggaaaggaagaagcttttccagctcgtagggaaggccaactctaacttggcagatgttattcttaagcttggactctttgagaggtcagacatagcatggaaaaacgcaaactatgctcagatctgggaataccttcgagatgaatatgagctgacccaaagatttggaaaccttgactttaagttgaaatttgtggagcacaacatcaggtttcttcaggagatcctccagaacaggaagtcggatttcctggaatggcttattatcatcctgatcagtgtggagatattgatatctgtttataacatcgtccaggagcagatgtagtag

SEQ ID NO: 360 - DNA, 6648 bp, Setaria italica
ctggaaattcacgcgctaagcgcacccgcgaatctacccacgctagcggggccgggccagaggatgctgtccgtggcgggggcggtggaggttggggtgaaggcggccgctccaatggcggagtgctgaggcgctcgggaagggaggagagggcggtggttgcggcttcgaccctgcgaacgagcgagcggggatgattcggtaccagatacggaacgagtacgggctgtcggatccggagctgtacgcggcgccgggggaggaggatgacccggaggcgctcctcgagggcgtcgccatggccggcctcgtcggcgtgctccggcagttgggggatctcgccgagtttgcagctgaaatttttcatgaccttcacgaagatgtgatggccactgcttctagaggacatggtttaatgctccggttgcagcagctagaggcagaatttccagcagttgagaaggcaattatatcccagactgaccactcaaattatccacatgatgatggtgtcgactggcatgctaatcttcaacttaaacagaatatgatcacacaaggagatatgcctcgcttcattttggattcatatgaagaatgccgtggtccaccacacttgttcactctggataagtttgatgttgctggtgctggagcctccttaaaacgatattcagacccctctttcttcaaggcagaacatacctccaacatgttagaaattgatgtttcaattgaaaagaagccccgtcgacttaagaagaaggctatacgttggaggaaaggggcgacacttgaatcattacttgcaaagtctgaatcttttactacccccaaggatcgaacttcgaggaaagttccacctaggacaacaaagttgaaatccaggcatccaaggagtcctgaccataaaactattagcagaatctgcagggagcatctgctagaagtaatttcatcacaacaaaaaattttctccagatattctggaaggcaatgtcatgtgagatttaggtcaactgactcgagtgaaacgggagaaatggagaattttggtgccattgttcagtcttctggtaaactggaacttactaaaattgttccaataaacgaatccaataccatggagattatatctgcacccactgatggatcagcttacctggagctaggtgataaacaaattttggggaaacaacatgaacctttagaaaaaaatggcatggtccgtgacttaggaaagctgcaggattgtccaaacttccaggttggtgaaagtaatcacagctcgcattcaggacatgaagagaaacacattttagctggggttcctgctgatcaagatgctgatggctgcaggcctgatgacatttgtagtgatcaagacaacttcatcgacgctcttaacaacatgggcccagaaggtgaagcagatcctgaaatagaaactgaatttgatcccagtgccaacgtggaacagattgaattgaaccgtgacagcaaggaaggtgaagatgcattgtatgcggagtccccacaagtaggtcctgcaatagactcgtcaccagggttcaacagttcatgcaatgctgaagaagcgacctgtatggacttgccaagtgactctgctaatcccgcagtgtcagccagtaatggtcctagctctgtttcacaatctggaagacaattgaatgatgttgattggatcaaagatgaagaaccttttgatgatgaggatctaatggatgtgagctcatcatctagtgtagcttctgtcaatgctgtcttacaaaccgatgaagatctctatggttgtcaacaacaccaagagaaagcttatcactatcaaagtagtgataatgcagctgttatccatagttctgataaacattcacccaagacatctagtgacttggatggtacggctgtcggcaacaacaattacactgacgaagtatattgttccatggagcaaggccaggatgttgtgctagatgatacttctatggtatcgagcaaacctaactatgttccagaagacgaagacaaactcagttttaggattgctgatgatttgtttccccacccgaccatacccaatcaagaggaaatacaggagatggagaaagaattggaaggtggatctctagatacagacgcttcacctggcatacttgcatcatggccagataagaaccatgttatgtgcttgaatgatgtagagatggacaaggacaatgttatcgttcctgaagaaattgctgctgatatggccccaacaggtttggatcctcatgacaaccatgatcatcaagatggaattgcaccagaacattcaggcatgcgtaataatctaccgtatgaatcatatgatgatgagattgctgaagatatgcactctttactaaacgatggtctatcaactccttttaataaggatgttgcagaggataatcaaatagttgtgcttgaaggaggggcctgtccagctagcctcaactcacacaaagaagattctgagcaagcacctgccatggccaggaacttatctgatgtccaagagtttccagtagtaattcaaggtgtaccttctcaagaggagacagaagctcatgcagtagagacccttgcacctgtgtcttgtgtgttcagtgctgatacagaaccagtggggattagtgtgcttccagcccctaatacttcctctctacctgacaacagtagttcatgtgtagaacaacatgcattgactgaaatggaagacattgtggagggtggcaaagttgtggttgcagaagaatcaactactagcaggtttgcagatgacgtggtacctcctgaagattttattgatgatgccatatatactgaaaaaacacagattctggctacagattcaactgaagaagcctctaggcatgatctgcaactacagcataattctcctttaagggaagggttggaaccagtagaagctactgacagaaatcttggggaagtagatgcatcaagagaatatatatctaaggaaaggatgttgcagacagacaatattcctcctctcaatgaaatagagcctacaggtgaaaaatgtagtgacagggatgaggttctttccgcaggacattttcctgtagaatctgattatcaagaggaattactagagtccagtcataatgctggagttcactctctgtgtgatttggataaggattttgcagtaagcctgaaatgtaacaccatgggggaacaaccagaggatgttgacgatcaagatttggcttgggggatgcccgatcaagattttactagtacaaacccattcatggatcctgcctacatgctgagcctaactcaaacttgtccatctcccattgtgagttgccaaccatgtttccctgaagaacaggatttcctttcagaacttctagtgcagcatgacaatatgggagcagctgctgattccctttgggagcctgcaactccacctgatgaagcgccattgccatcagaagttatgactgaagaagatttcagatccttctgccgtgagtatcatgagataaatttttcagctgccgctgaaggttgtcacagtgaaccggcctcagactctaacaatatttcaaatgcttttctggtcagtgaatcagattttccaagttctgtttctgccttgccagtgaagttaaaccaggaagcctgtgttcattctaagtttggttctcaatgtgctgagccttcatctaccatggatatacaaggcgctacatcaatgaccttttctggcaaagaagatctcacggatgagacaccaggagtagattctcatttaaaatctgatgcatctttcagtgttaacagaagttctgaactagatatgctctctgttccagtagatttacagcaggaacagctgtctggaattgattctcatagtagttctcctttgttggataaagagatgaccggtgaaggatgctgctctccttcaagtgatgttgttgaagtgaaacacgatctagaaatccacgccaatcttgctctacattcttttattaatgaaactggagacgaactggatgttgctgtacaagtggaaccagaggtaggagctcatgctgatgataaccaagatattccatgttgttcaactagcgaaaaggatgattcccttatgggcaaacctgttctagttcaggagtcagaagtttttgccttcggtgaatttgattctccaatcgttccattatcttcaattgatgacattgaagacaatcaagactctgcttcgaggacttatgttcaaacagaacaagagtcagaatgctgcacctcaggtgaacttgattctcaaaccactccatcccctttgcttgatgagaagattgacaaactggacggccctcctttgagcaatgctgccatgctggatcaggaatcagaagtttgtgttccaagtgggcttgattctcgaatcgctctatgttcttcaactgatgagaatgtacatgaattggatcatcctcctttgagcagttcagttttaatcaatcctgagtcagaagatcatgtgttgggtgacactagttccaaggttactatgtgttctttagttgaagacaagattgatgaatccgaagatcctcaaccaaaccataattttcctgaggtacggcaggaagctcttgcatcccctgaattagactttcaggttgctccatgtcccttgaatgatgataaggttggtgaaatagaagggcctccatcgtgcaatggccgggtggaatcagaaaaggaatctgattgctcaattgaatctgattcccaaagtgcgccatgttcttcaaattcaccagtactagctgacacaggagtattgacttctcctgtcatgcctaataatgaggaaatgaatcagttgtctcctggtccgccacccgctgtacaatttcaaaatgattcctacgaagatcctcaagctcaagcaccaccccctctccctcccctccagtggaggcttggtaggcctcggctagggcttctaagtagaaaaagctctatgcctgagcctgcaaggagcatagatcctgttttccaggcatcaaaccaagacatggatatcaggctaggtttgcttgatcaaccagatagatcaatagaaccagtatcctctcaagcgaccgaagaagatacgcatcagagttctttgttagacggtagtgatcaaaatgtagaagttggattgtcgaccagtgtcacagtaactggtgtggcaaggactgaacactattggccattctcagaagcttcagagaacattaagggaccggagcatatttcttcatcatttaacagaaatctggatgctggggtcacatcagcaacagctgacgaggaacatctggatgattctggggtgacacatggagcagttttatactcatcagacccgctgcttcgattacctgcagatgaacagcaggaacctcaactgtgcaccttatcttcagatactcgagaaactagtgtgcatcccagccgtatgcatccaggtgcatctgaaaatgataagtcaacagatgctgctggtggcatggaaagcacctcaacaaagggacctgattatgaaaatagtttttaccagcaacctcagcatgttgaatcgttctcaaagacttcagattatggagagcatattacaaatgcatcggtggagggtgtaaaacatcagtctggtacaagcgagacactttcagacccagcaaagcattctgcaccaggcacattgttgaaagatgggaatagcaaggggagtcaaattttgcaggaacaaaatgtgggtagttctcaggacaataagtcaggaggcccattgcccagctcggaatcaatggcatctgaagattatcgacatgatgaatataatttggagagagaaaatagacacccgcctagcaacccaggcccactagtggcatggcctggtgataaaaataacttcttcagtggccttgatgaagctagctttgcgcatgctgagcaaccacctgtgatgggatggactgttgggcctcagatgattcatcctaagtatggtatatcagcagaagagagccaatttgagccaaatatcaccgacaatcatttaatcaagaagcctatttcaattaaaaacatcccaaggaatccactggtcgatgctgttgctgctcatgatagaagctcgatgcgaaagatttcagagcttgcaccatcggctgacaagccgaagcccaccgagagaaatctgttgctagagcagataagaaacaagaccttcaacctgaaaccggtggctccttctcagccaacagccatgagatcccctgctagagctaatactagaaacttgaaggttgctgcaatcatagaaaaggcaaatgccatccgacaggcggtgggaagtgatgatgaagacgcagatagttggagtgacgcctagacgcccatctgttcccctctcggtgttcatcaaggacatcgtggacaggttggggttgcacagccatgtcattttttggttagcaatggtagtcttgtgtatagtatatgctcataatcttctttctttctttcttttcattcttctcttattctttcggccga

SEQ ID NO: 361 - DNA, 3882 bp, Setaria italica
gccactaggtctagggttcctccggccatggaggacgacgagtacgaggaggggatggagatgggctacggcgggcaccaccagcaccgcggcggccacgcggggtacgcggaggaggaggaggaggtggggtacggcggcggggacggggacgagatggaagaggacggggacgccgagcagcgggacgaggaggagatcacccaggaggacgcctgggccgtcatctccgcctacttcgaggagaagggcctcgtgcgccagcagctcgactcattcgacgagttcatccagaacaccatgcaggagatcgtcgacgagtccgccgacatcgagatccgccccgagtcgcagcacaaccccggccgccaggccgagttcgccgagactctgcacaagatcagctttggtcaaatctatctcagcaagccaatgatgacagaagctgatggagagacagctactttatttccaaaatcggcaaggctcaggaacttgacatactcggcaccactgtacgttgatgtatcatacagagtaatgaagaaaggacatgactgtgaggaagttacagaaacttcagattacccgaaagtgttcattgggaaggttccaatcatgttgcgttctagttactgcacactatatcaacaatctgagaaggaccttaccgaactcggggagtgcccttatgaccaaggcggttatttcattatcaatggaagcgaaaaggttcttattgcccaggagaagatgagcaccaaccatgtttatgtctttaagaagaggcaaccaaacaaattttcatatgtggctgaagtccgttccatggctgagaaccagaacagaccagccagcagcatgtttgtaaggatgctttcgcgagcaggagcaaaagggggttcatctggtcaatatatccgtgctactctgccctatattcgtgcggacattcccattatcattgtttttcgagcattaggatttgttgctgacaaagatatactggagcacatatgttatgacttttctgatacacaaatgatggaattactacgcccatccctggaggaagcttttgtcattcaaaatcaacaggttgctctggactatattggaaagcgtggagctacagttggtgtcactcgagaaaagagaattaagtatgcaaaagaaatacttcaaaaggaaatgttgcctcatgttggtgtgggggaattttgtgaaactaagaaggcatactattttggatacattattcaccgcctactgatgtgtgctcttggtcgaagagctgaggacgaccgagatcattatggcaacaaaagactagatcttgctggtccattgcttggagggctgtttagaatgctcttcaggaagttaacaagggatgtgagatcttatgtgcaaaagtgtgtagataatggaaaagaagttaatttgcaatttgctatcaaagcaaaaactattaccagcggcttgaagtattcccttgctactgggaactgggggcaggctaaccaagctggaaccagagcgggggtttctcaggtgcttaatcgcctgacttatgcttctacgctgtcacatctccggaggctgaactctcccattgggcgtgaagggaaattggcaaagccccgccagttgcataactctcattggggaatgatgtgtcctgctgaaacaccagaaggacaagcttgcggcttggtgaaaaatcttgccttgatggtatacatcactgttggttctgctgcaaatccaattttggaatttttggaggagtggggcacagaaaattttgaggagatatcaccagccgtcattccacaagctgctaaaatttttgtcaatggttgttgggttggaattcataggaaccctgacctgctggtgaagactcttaggcgtttaagaagacagattgatgtcaacactgaagttggtgtggttcgtgatatccgtcttaaagaacttcgactctacacggattatgggcgttgcagtcgtccattgtttattgttgagaaccagaggctgctcatcaagaaggcgcatatccgagcattgcaacaaagggagactcctgatgaaggttggcatgagttggtctcaaaaggatatatagagtacatagataccgaagaagaggagactaccatgatctccatgactataaatgaccttataaatgcaagacacaacccagaggaggcgtattctgagacctacacgcattgtgagatccatccttctttgattcttggtgtttgtgcatcaattattccttttcctgatcacaaccagtcacctcgtaatacatatcagtctgctatgggaaagcaagccatgggaatttatgtcaccaactaccagttaagaatggacacattggcctacgttctctactacccacaaaagcctctagttactacacgtgctatggaacatttgcacttcagacagttaccagctggcattaacgcaatcgtcgctatctcttgctactctggttataaccaagaagattcagttatcatgaatcaatcttccatagatcgtgggttcttccgatcactatttttccgctcttacagagatgaggagaagaagatggggacacttgtcaaagaggaatttggtcgcccaaatagggagaatactatgggaatgcgccatgggtcatacgataaactagatgatgatggccttgcaccacctggaacaagggtctcgggtgaagatgtcattattgggaagacatctcctattccacaagatgacgctcaagggcaagcttctagatattctaagcgcgatcatagtacttctctgcggcacagtgaaagtggtatggtagatcaggttctgttaacaacaaatgctgatggtctaagatttgtcaaggttagaatgcgatcagttcgcattccacaaattggagacaagtttagcagtaggcatggacaaaaaggaactgttgggatgacttacacacaagaggacatgccatggacgattgaaggcatcacacctgatattattgtgaatccacatgctattccatcccgtatgactattggacagctgattgagtgtattatgggtaaagttgcagctcacatggggaaggaaggagatgcgactccattcactgatgttactgtggataacatcagcaaagctcttcataaatgtggttatcaaatgcgtggatttgagaccatgtacaatggtcacactggaaggaaactgacagctatgatttttctgggtcccacatattaccaaagactcaagcacatggtggacgacaagatacattctagaggtcgtggtcctgttcagatactcacccgacagccagcagaggggcgttcgcgtgacggtggtctccgctttggagaaatggaaagggattgtatgatcgcccatggagcagctttcttcctgaaggaaaggctgtttgaccagagtgatgcatacagagtccatgtatgcgagaaatgtggtctcatcgcaatcgccaacctaaagaaaaactcatttgagtgtaggggctgcaagaacaaaactgacattgtccaagtacacataccctatgcttgtaagcttctgttccaggagctcatggcgatggccattgctcctagaatgctcacccatgatatgaagacagggaaggatcagaaaaaacgctgaaccagtatcccatgggatgcttagctggccctcttccttctagggttcatacgacgtgatcttttatcagctagtaccatgttgagaaacttctttgtgaccacttcttttttaatttggacttcggttcttcacgaatgatgtctccatgggtatcatgcccgtctctgttct

SEQ ID NO: 362 - DNA, 2425 bp, Setaria italica
aaaggatcccctcccatctaaagctttctagcgatcgtcttcctggcgttcctcttccgattcgcctcctccgtttgcggcggataggatttggattttcggatcgaccgacgaatccatccatggcgcggaccaactgggaggccgataagatgctcgacgtctacatctacgactacctggtcaagcgcaaccttcaggccaccgccaaggccttcatcgccgagggcaaggtcgccaccgaccccgtcgccatcgacgcccccggcggcttcctctttgagtggtggtccatcttctgggacatcttccactcctccaccgcaaaaccagcctcctcctccgcctccggtcctccccttcacgatatcaacaagtcgagggagcaccagatgaggctccagctactgcaccaacacaacgccgcccaactccacaccagaggacctgacgtctccgccgtcctcgcttccaaaatgatggaggaccgcatcaggaaccccaacccggccgactctgacgcatcacagcatctcctagacgcaaataggatcgcacttctcaagtcaccacctaaccaaactgggccaccccctatgcagcagcagcagattcacccaagaaaccagcaacttgacatcaagcccgatgttgctatgccacagagaacagtgccagcggaccattcttcattatatgcatcagggatgatgcacccaaaacctccattactcgccactggactaaatcaagctggaggaagtgtgccgctcaaaggctggcctctaacggtcacaggtatcgaccaactccggtccaattttggtgcgcagaagcagttggtgccatcttcaaaccagttccaacttttgtcaccacaacaacagttgattgctcaggcacaaacaccgaatgaccttactagaatgagttctccagcaccatctgcttcaccgaatgttcgatcagatgatccggattatttgatgaagttgaagatggcccagatgcagcagccctcaggctaccggcctatggaattgcaacagccgcaacaacagaacactagaaagcggaagccaacttcttctggagcagctaatagtactggcacaggaaatactgttgggccttctcctccatcaactccatccactcatactccaggtggtggggtaccagtgactagcaatgctaatattttacagaagagttcaatgatttgcggcacggatggaaccagtggacttgcctcgtcctcaaatcagatggatactttggatagttttgttgattttgatgaaaatgttgattcattcttgtcgaatgatgacggagacggaagagacatgtttgcagcattgaaaaaagggtcttcagagcacaattcagagtccttaaagggtctctccttgagtgaggtaggtaacaaaacaagcaacaacaaggttgtttgctgtcacttctctacagatggaaagttattagctagtgctggccatgagaagaaggtcttcctctggaatatggataattttaagatggataccaaaatagaagaccacacaaactttatcacagacataaggttcaaaactaattccactcagttggctacatcatcttctgatggaactgttcgactttggaatgctgctgatgaaagtggcactttacaaacttttcatgggcatacctctcatgtaacgtcagtagattttcacccaagattgacagaggttctttgctcttgtgatgacaatggagaaattcgcttctggaaagttggtcaaactacatggacccatgttttaagggcgaagcagggtggtaccggaagagtcaggtttcagccgcgaagtgggcagctcctagctgtggcaggtggaagcatggtgaacatttttgatgttgaaaagcaggcaaacttaccctctccagcaaagggtcacaacagtgaggtaaactgtgtgtgctgggatgaaagtggtgaatatctggcttctgtaagtcaagacactgtgaaagtgtggtcagtatcgtcgggagcgtgcattcatgagctaagatctcatgggaaccaatatcagtcatgcgtgttccacccgagatacccaaaagtgttgattgttggtggttatcagacgctggagctatggagcttatcggataaccagaggaacccaatccaggcgcacgaggggctggtagctgctctggcacactccccgatcacggggatgattgcctctgccagtcatgacagatacgtgaagctctggaagtagctagaaactaaaggtgatggatggattgattgattgattatacactcactagtcgtctatctagtcctcctaataattataaaatgtacttatgatgatcagtttacttgtgttacatagcgcctgttgaattcttt

SEQ ID NO: 363 - DNA, 1813 bp, Setaria italica
gcgctccgcctatttaaggcgcgcgggctgagaaccagcgataatgctcttcgccaggaggcccctctccgccgcactccacctcgcgcccctctcgccccccttgctcctcttcttcgcgtccgcgtcgtcctcgtgctcgcccgccgccgcgtcggcctccggcggcaccagaggttgcagtgctgtaaggatggacagcggtgcagtggagacaacgtcaactggggcagtatggtcaacaccttcggcagaaccaagaagcgtttctatcgggaaggcgatattctgcaataggtcactcaacatgaggaacatcacagcagtgggatttgatatggactacactcttgcacagtacaagcctgagaccttcgaggcccttgcttactatggtacaattgagaagcttgtgaaggatctgcactaccctgaagagctgttgacttgggagtttgattggaaatacatggtcagagggctagttcttgacaagaagagaggaaatatcttgaagatggatcggcacaagtatgtaaaagttgcataccatggttttagggaactgtcgaaagaagaaaaagttgctgcttatgggagtacattgataagagattcatttgatgaacctgattatgccctgatagatacgcttttctcattgggtgaagcttatctatttgctcagcttgttgattttatggacaataatcctggaaaagtacctgccggcacagactacccgcttatgtataaagatgtgaggtctgcagttgacttgtgtcatcgtgatggaactttaaagcggatggttgcgaaggaacctggcaggtacatcaatgaggacttggcaattgtaccaatgcttgaaatgataaaaaaatctggacgctcaacattcttagtgacaaatagtttgtgggactacaccgatgttgtcatgaactacctttgtggagcatacacttcagatgcaggatctggtctcaaccacaagtggcttcaatattttgatattgtaataactggcagttcgaagccaagtttcttccacgatgataaccgtgcgggcctctttgaagttgagcctgattctggaaaacttctaaatgctgatattcagattggaagcccaagatcaagtcatcagcatgcaacaccagttcacaaagtttaccagggaggcaatgtcggtcatcttcacagattactttctattgcttctagttcacagattctctatgttggtgatcacatatatggagatattctgcgcagcaagaaagttctgggctggcggactatgctggtgattccagaactggagcatgaggtgaagcttctttcagaatcgaagtcgacacggaaggagcttagacatcttagaatggaacgtgattcaattgaagacagaatccatcatcttgaatggtctctcaaatttgatgatatcacggaaaatcagaaggaaaagttgttctctgaacatgttgatctgctgcaacagcgagagcatgttcgccgccttcatcaagaggctcagaggcaacatcatcagaagtttcataaggtgtggggacagctcatgaagactggttaccaaaattcccgatttgctcatcaggtcgagagatttgcatgcctgtacagcagccaggttacaaacttcggtttgtattcccccaacaagtactatcgtccgagcgaagattacatgccccatgagttcgatgtgcttgggctgtaggagcaatccctgccgatgctcagagctccccgttgtaactgaaccagagcaggataggaggaattc

SEQ ID NO: 364 - DNA, 1369 bp, Setaria italica
aaaggatccccggctctcacctcaaatcccagccacggtgatgacgacgaccatgatgaggctgaggcagcacctggcctcctcccctatttatacctccgccatcgccaggatcggcaacagcagagccccccaccgcctactccccgtcgcaccaccgcaaaagcaccgcccgacaacgcgagtcatgtcgtcgtcttcctccgcttcggatgccgctgccgccgccgtgccgttcgagaagcccagggccgtggtcaagaagctcctcgccgagtcgcagcccgaggggcagggcgccaccgtccggaggagcatcggcaggcatgagctcaggaacctggaccccttcctcatgctcgacgagttctcagtctccaagcccgccgggttccccgaccatccccacagaggattcgagaccgtcacctacatgctcgagggagccttcacccaccaggactttgcgggccacaagggcaccatcagggcaggggatgtccagtggatgactgccggccggggcatcgtgcactcggagatgccggcgggggacggggtgcagaagggcctgcagctctggatcaacctctcctccaaggacaagatgatcgagccccggtaccaggagctccagagcaaggacatcagccgcgccgagaaggacggcgtcgaggtccggatcatcgccggcgaggccttcggcgtgcgctccccggtctacacgcgcaccccgaccatgtacatggacttcaccatgcgcccgggctcccagctccaccagcccgtcccggagggctggaacgccttcgtctacatcattgacggcgagggcgtcttcggtcgggagaagtcggcacccgtgtcggcgcaccactgcattgtcctgggcgacggcgacgggatcagcgtctggaacaagtccggcgcgccgctgcggttcgcgctggtggccgggcagccgctgggcgagccggtggtgcagcacgggccgttcgtcatgaactcccgcgccgagatccagcaggccatggaggactactactacggcaagaacgggttcgagagggccagccagtggagctcctccgcctgatcatcgatcacccgcttctgaattctgatgcatgcattttcttgagaaattgacatggaaaaaaaggaaattgctgtcctgcatacctggatgggaaaagactaaagagtagtagaccattagtagatactctgatcttgattatgatttttaaatttttttaatgattgtattgtagaagcatgtgcttgtcatttgtatggtgatttgtaataagcaggatggcaaattccactgttcatcatagtcaaggtacgcaatccagatatcttt

SEQ ID NO: 365 - DNA, 857 bp, Setaria italica
caaccatgcagcgaaagaacttccgcaagcggagcttcgagccggacgccgacgaccgctccgacgacgaggacacccgccgcgtcgtcctggaggagatcaagtacatgcagaagctccgggagaggaagctgggcatccccgccgaccccgccgccgcctccaccaacgggtcagccgcccgcggactggtgggtggagggggagcggctatcggcgaggccgagaaggaggacctcgtcctccaggacaccttcgcgcaggagactgccgtcaccatcgaggaccccaacatgctgaggtatgtggagaccgagctggcgaagaagaggggtaagacagttgatgtgggacacaaggaagagatggaccatgtggacgagctctacaccgtgccagaccacctcaaggtgaagaagaagaactcggaggagagctcgacacagtggactacgggcattgctgaagttcagctgcctattgagtacaaattaagaaacattgaagaaactgaggcagctaaaaagatgctgcaagagaaaagacttgcggctaaaccaaaatcagattcaaatattccatcaagttacagtgctgattatttccatcgtggcaaagaatatgatgagaaattgcggagagagaatcctgggctgtacaaagataaagattctcggcctaatgaaagtgcaggaggtaaagcaacagatactaaaaatacagctggtgccggtgcaggacggagagaggctgctagtgatgatatcatgcttgagcgattccgcaggcgtgaaaaaattcgtgtcatgcgaaggtagccagagctgtcagattgctaccgttgcctttgaagatca

SEQ ID NO: 366 - DNA, 1296 bp, Setaria italica
catggccattccttctctactgccttagacagcagctggaggaagataacatcttctccacacaccagaatagatatagcctcttcttcctcctcgttttcttcgttcttccttttcttcgtttctttcttcttcttgatctctaaagccgccatcgatcaatcctagcatccttgctgtttttcttccccaaggatcttgctagcttcctcttgcagatttcactcaaaactaatacaagttctttcaacttttaaccttctcagcagttctccttttaacttcctttgcccttcagcaatcccaacgaaaacccgtctttcctgagcaaaatagcgcagagagacctaaaaacctttcctcctagatcaacaagatggaaaacgttctcctggatcgatcgtctggaagctttgagttcccgaagaggtccctcggccgcagccggcgggggctcgccgcgaggccggcggcgccgggcggggcgtacagctccttcccgacgcaccagccgccatacagtggcgcgtggacctccgctccagcgcttccgtacgcgaggcctccgatatactcgtcgccatctctgcctctcctaccgtccaaccaaccgccgctgctgccgctcccacccaccgctaccaagtacgctactttcccctgcctaccggcggcagctccgcctccatcaccaccgccggcgccacgcgcggcgggcaggggtagcgcaggggtaaccaccgcggttccagcagcagcagctccagcacctgcgcggcgcgagagggacaggaggaggaggccggcaaggccgccgccgacgccgtcgacggcggaggcgcccagggcgcagaagaagaagccactggagcgggccacgcctctgccgccggcgccggtggtgacggaggcgctggacgacctcgagcgggaggtggccaggaacttcgtccaggacctgctgcacgcactggcaccgccaccgagcagcctgccgctgcccaggttctccctcgtcgcgaaagcgtcccctgccacgagccccagggtggtggcgccggccgcgccgtcctgcaacgtggaggccgccgccgccgacggcatccacggcctcctccgcctgtaggagaaggcttcgctctccgccgtgtttggtattctataatatttccctccaatattatttttttggttgggaaaattaaatgcgtactataaaggtagaaaaatattgggagaaaagatgtgatgctcgagccatggtcggtcgagttgtccgtagtgtgactgtgatgg

SEQ ID NO: 367 - DNA, 758 bp, Setaria italica
ggaccatggaggagtacggagggggagacctcctgaccgaggcgatgggctccgcggcgcggttggtggtagtagaggactgcgtggaggcgccgggggccttcgtcctccacctcctcctcaagcgcgcgctcgccggcggcggggcggctgccttcctcgccctcgcgcagcctttcacccattacgaccgaatcctgcgcaagatgggatgtaacctttccctgcataggaggaacgagaggcttcatttctttgaattgcaagcattcccaggtggagctagggatggcgccattgctgatagctttgttcgactgtacagtgaaattcaaagagtggcggaggcaaccaggagtggagaaaatgcaggccaattcaccatcgtgatagacgatgtttcactgttggaagttgcggcccatggttccatagacaatgtgctggacttcttgcattattgtgtgactcttacatctgagatgaattgctcgctggtgatcctcgtccacgaggatatatatgcaggcgaggagaacaatggtcttcttttacatttgcgccacattgcagatcttgtggttaaagcagcacctttgagcacaggcttggctgctgatgttcatggacagctttcggtggtcaacaagggtacattcagcgagcaaagggcaaaagcgcagaaggtttggaatttccattttaaagtgaaggaaaatggtgcggacttcttttatccagggagcagacattagtag

SEQ ID NO: 368 - DNA, 1215 bp, Zea mays
aaagcggtagaaaggtgtgatgttttagtcctttttggttgaagcggagcttgagtctttgagaagccatttgggcgtaattcttctttcgttgattggggtcggccttgtgtgcaggttacgcagatgtttctttttagagttattgcatctcctcagttgtagtttatctcggttgtgtatccacgagtgctgtgtacaccaattcctgtagaaaagatgggtgaacatgttttcattgttcaagaatgttgttatatgtttttaaatcatgtaagacatgttttagttttaccatggggtctcgagaacaatattgtttatttcctcattctgttttgaagccgtcggaattatgcttgtaatcattgctgaagtttttgtgaacatatattttttttcaatcgattttgctcgagccagtatcttttattgcaacaccatgaactcccatggtgctggttcgcattcacggcttttggacctcaactatccccctgctgaaggggctggtgagggggcttcacgtttcagcagtatccctgtctctcatagagagggttcaagcagcatgcctgtacaacacatccaggcttcgagtagtacaccaccggctactggtgagcctcgcattggtatgcgtagttgccccatcgatgtggaagccatcgatgatgatgccgttatctattcttcaagaccactgcctcgagcaagacagcagttgaccacgacagaaagtattactatcataatagatgatgattccgaaacaaacctagaaacagcaggcgatgctcttgacgagcatgtgaacttactgctatctctgggcatagaacgctcgcatgagcctacaagtgcaaccaacaccttccctggaataagcatggtggacacaccaaaagtaaacaccttcaagtggatccaggtgcctcctgaacctgtgaaggaggttccgaaggaaccgaagctcagctgcccgatctgtatgaacgagataaccgaagcggcgtcgaccgtatgcggtcacattttctgccagccgtgcatcaaggctgccattaaggcccagaagaagtgccctacctgccggaggaagctcactccaagacagcaacaccgggtgtacctcccatcgccttagtagcccagtgcagagtcattttgctacaagttctgccgtgccgggggctgtatgttggaggcaactgg

SEQ ID NO: 369 - DNA, 682 bp, Zea mays
cctctgtcctgtcccactagactagctgcagctagcgcctcttcccctcgccgccgccccctatccgagagcgacgagcatggcgcactccctcgccgcctccttctcgccggccgctgcgcggcgccaggtgacaaatgtgatttcaagctggagctcggtttccttccagagccacaggatgacttctgtatccatccgttcaagaccaagttctcttcggttcaagatttgttgttcggctaagaaggagacagtcgacaaggtctgtagtatagtgaaggagcagctggctcttcccgatgggactgctatcactggcgaatcaaaattcgccgaacttggtgctgattcactggatacggttgagattgtcatgggccttgaggaggcgttcaacataaccgtcgacgaaacaagcgcacaggacattgcgacggtgcaggacgctgcagacctcatcgagaagctcatgctggaggcgcctccaaaggtcgtctagatcgatccatcagccttgcgatcggcgacttggcgtttttatgttaaattgttcatgttacctaatttgttctttattgatggttcaagatgagatttttgtatggatgttgctgaggtataaattagatgctccaaaggctgcatggagcagatgaagacgatgtattccacttcccat

SEQ ID NO: 370 - DNA, 641 bp, Zea mays
aaaggatccacctcttgtccagtgccccaaatgctggcgaccacctgcagccggccgccgtgcccgtgcgcgcggtcgcggcggctccccgcggcgaccttcggcggcaccagtagcgcgaagcgaagggcgccgaggagagcggcggcggcggtgcggtgcgggctgctgcccgtggacccgtgggcgccgacgatggactcccagagcgtggcgtcgcagctcttcgccgtctcgctcttcccctacctgggattcctctacttcatgaccaggtccaagaccgcgcccgggctcacgctcttcggtttctacttcctcctcgtcttcgtcggcgccaccatacctgctgggatttacgcaaaagttcattatggtacctcactgtccaacgttgactggctgcacgggggcgctgaatcgctgctgactctcaccaacctgtttatcgttttggggctgaggggagccctgaggaagctggaggaagagggcacagacgagagcgtttctgaagcttctcaagaaaaaagttctgtctagatgggttcatcatcagtacccctgaaggtgcactcagtaactaggagtgcgctgtttttcttcttctgcagctcaactagctcgtagtggaattcttt

SEQ ID NO: 371 - DNA, 3059 bp, Zea mays
gagggatgacgtggttccgcgccgcatcgggtgccgcccgcctcgccctccgccgcagcctcgccacccgcacgccgccagccgccgccacccgatgcggccgctgcttccactccaccgctatgcgtccccgctccgccgcccccgtgccccgggccgtcccgctctcgcgcctctctgacagcttcctcgacggtaccagcagcgtctacctcgaggagctccagcggacctgggaggctgacccttcctccgtcgacgagtcatgggacaacttcttccgcaacttcgtcgcccaggcctctccttccgccggcgtctccggccagaccatccaggagagcatgcagctcctcctcctcgtcagggcctaccaagtcaacggccacatgatggccaagctcgaccccctgggcctcgacgacagagccgtccccgaagatctccgcctcggcctctacggcttcacagaggccgacctcgatagggagttcttcctcggcgtctggaggatgtccggttttctctccgagaaccgccccgtgctcacactccgtgagatcctcaacaagctccagcaggcatactgtggacccatcggctacgagtacatgcacatccctgatagagacaagtgcaactggctcagggaaaagatcgagactgccaagcccaaggaatataacaaggaccgccgccttgtcatgcttgacaggcttatctggagcacccagtttgagaatttcctagccaccaagtgggccaccgccaagaggtttggccttgagggtggtgagacgctcatccctggcatgaaggagatgttcgatagggctgctgacctcggtgttgagaacattgtcatcggtatgccgcataggggaaggctcaatgtccttggtaatgtcgttcgcaagccactgtctcagatattcagcgagttcactggcggcacaaggcctgttgaaggcgaagatggtctctacaccggaactggtgatgtcaagtaccacctgggtacctcctatgatcgcccaactcgaggcggcaacaggatccatttgtccttggttgccaatcccagccatctggaagccgttgatcctgttgtcattggcaagacgcgtgctaagcagttctactccaatgatgctgacaggacaaagaacatgggtattctgatccacggagatggcagctttgctggccagggtgtggtctatgagacactccatctaagtgccctcccaaactacactactggtggaaccattcatattgttgtcaataaccaagttgcctttacgactgatccaagagctggcaggtcctcccagtactgcacagatgttgccaaagccctgaatgctcctatattccatgtaaatggcgacgatttagaggctgttgtttgtgtttgtgagcttgcagcggagtggcgccagactttccactccgatgtggtggttgatctgatttgctaccgccgtttcgggcataacgaaattgatgaaccttccttcacacagccaaaaatgtatcaggtcattaagaaccatcccagctcattgaagctttatgagcagaaactgctaggaacgggtgaagtcatgaaagaagatgtccagaggatccatgacaaggtgaaccgaatcttgaacgaagagtttgctaagagcaaagactacgttcccaacaagagggattggctctcagcttactggactggctttaagtcaccagagcaaatatcacgtgttcgcaacactggggtgaagcctgaaatactgaaacgtgtaggtcaggcaattactacactgcctgaaaacttcaaaccacacagagcagtgaagaagatttttgagctgcgtgcagctatgatagagagtggtcaaggaattgattgggctgttgctgaagccctggcctttgcaacacttatagtggaaggcaatcatgttaggctaagtggacaggatgtggaaagaggaactttcagccatcggcatgcagttctgcatgatcaggaaactggagcaaagtactgtccacttgaccatgttgcaatggatcaaaatgaggagctatttactgttagcaacagttcactttcagagtttgctgttcttgggtttgaattgggttactccatggagaaccctaattcattggtactttgggaagcacaatttggcgattttgccaatggtgcacaagtgatgttcgaccaatttttgagcagcggcgaggcaaaatggttgcggcaaaccggccttgttgttctgttgcctcatggttatgatggccaaggtcctgagcattctagtgcccgcttggagcgcttccttcagatgagtgatgataatccttttgtcatacctgagatggaaccaacacttcgcaagcagatacaagagtgtaactggcaagttgtgaatgtgacaactcctgcaaattattttcatctgttgcgtcggcagatacatagggagttccggaagccgctgattgtaacagctcctaagaacctgcttaggcacaaggattgcaagtcaaatctttcagagtttgatgatgttgaaggccatctaggattcgataagcagggaacacgtttcaagcgactgataaaggaccgtaatgatcacaagcaagtcgaggagggtgtcaaccgtcttatcttatgttctgggaaagtttactatgaacttgacgaagagcgtaagaagtcggagcgtggcgatgttgcaatttgcagagttgagcaactttgcccgttcccctatgaccttatccaaagagagctgaagagatacccaaatgcggagattgtgtggtgccaggaggagcccatgaacatgggtgcatacagctatatctctcctcgtctgtttactgcgatgaaggctcttgggcggggttcgtttgaagacatcaagtatgttggcagagcaccttcagctgctacagcaacaggcttcctgtcggttcatgcgcaggagcagtcagagctagtgaagaaggcactgcaggcagagccgatcaaattcctctgatga

SEQ ID NO: 372 - DNA, 641 bp, Zea mays
cggagatgtcggcggggctggtgaccgacgaggccaccgtggggcggctgtaccggatccggcgcacggtgatgcagatgctgcgtgaccgtggctacctggtggtggaccacgagctcgccaccagccgccgcgacttcctccgcaagttcggcgagtccttccaccgcgaggacctcctcatcaacaagtacaagaagaacgacccatccgaccagatatatgtcttcttccccaacgatgacaaggtagggatgaagcacatcaagaagtacgtcgaaatgatgacgcacgagaacgtctccagagctgtgctggttctccagcagaacctaactccgtttgcgaagtcgtttctcatagagctggagccgaagatccatctggaaattttccaggaggccgagatgcttataaacatcaaggaacatgtccttgttcctgagcatcaggtgctcacaaacgaggagaagaagacgcttctggagcggtacaccttgaaggaaactcagcttccaagaatacagatcacggatcctattgctaggtactacggcctgaggcgaggccaggtcgtgaagatcatcaggcccagcgagacggcgggcagatacgttacataccggtacgttgtatgatga

SEQ ID NO: 373 - DNA, 836 bp, Zea mays
agaaaatggtcgcggcggcggcggaggtgtcgacggcggcgacggctagcagtagccccccggcggaggagggggagcggcgggacgagagcgagagcgacggggagatggcggggctggcggccgtgctggacttcgacatgctgtgcgcgtccgtggcgctgtcggcggagaggaggaaggccggcgcggcgctggcgggcgcggccggcgactgcggcggtggaggcggaggggtgcagaggatgtgggagggcgacgtcgtgctggattgcctagacgaccggcgaatcgcgctcgagacgtcctgctgcccatgctaccggtttggtaagaacatgcggagagccaatctcggatcttgcttccttcagggaatggtttactgcattctgttggctgctgtcctaatcagcctaattgccttttctgtaacaaggcatcatatatatttatatatgggaatcggctctgtcctcttgatagccatctatactggttatttccggagaagaatcaggaagcaattcaacattcggggtactgagagcagtctggacgattgtgttctccatctcatatgtccttgctgtacgctgtgccaggaggctagaactttggagatgaataatgtccagtgtggtgtctggcatggccgaggtgataccatttgtttagggagcaacggtgcaggaaacaaggctttcgctgccctgaacaaggcctctctcgtgcctgtaaagtccccggggctgtgtggcatggatagatcgtcaagcgcagccgacgagcagcagccgcttgtcccaccggaccaactggagcaggtttagtag

SEQ ID NO: 374 - DNA, 1277 bp, Zea mays
gggcgatgggggcgaagcgcgcggtgctggtgggcatcaattaccagggcaccaaagcggagctcaagggctgccacaacgacgtcgctcgcatgcgccggtgcctcgtcgaccgcttcggattcgacgagtccggcatccgcgtcctcatagatgacggctccgcgccgcagcccacgggggccaacatccggcgggaactcgcgcgcctcgtcggggacgcgcggcccggggacctcctcttcttccactacagcgggcacggcatacggctgcccgccgagaccgggaaggacgacgacaccggctacgacgagtgcatcgtgccctgcgacatgaaccttatcacagaccaagatttcacggagcttgcgcaaaaagtccccagtggctgtctctttaccatagtttctgattcgtgccacagtggagggctacttgacaagaccaaggagcagattgggcacagcaccaagcagaagcagaagcagacccagacccagacccagagccgggaacttgaggaacggtctccttctggcaccagcttccgggaattcctcaaaggtactgttcgggaagcgtttgagtctcaaggaattcacctgccccaccgtagccgtagccaccagcaagggagcggtcacggcgacgacggtgaccaagagtcgcgctacatcaacacagccgatgcccacgtcaaaaaccggtcgctacctctctcgacattgatcgagatgctgaaggagaagactgggaaggacgacattgatgtagggtcaatccggctaacgctttttaacctcttcaaagacgatgccagcccgaagataaagaagttcatgaaggtcatgctgaacaagttacagcaggggcagcacggaggcattgtgggcttcatgggcgctctggcacaggaggtcctgaaagccaagctcgatggcaaggaagaagaagagttcgacccggcaatgaaacagcacgtgcacagcgatcaagaggtgtacgccgggacgacggcaagggtgccgagcaacggtgtcctgatcagtgggtgccagaccgaccagacgtctgccgacgcgaccacgccgaagggggtgtcctacggtgcgctcagcaatgccatccaggccatcctcgcggagcgtgggacggtaacgaacaaggagctcgtgctgaaagcgcgcaagatgctgtcgaaacagggctacacccaacagcctgggctctactgcagcgatgagaatgccagtgcggcttttatatgctgatga

SEQ ID NO: 375 - DNA, 1347 bp, Zea mays
aaaggatccactcggcagatttcactgactctcaccggcggtctttgtgcctccaccggccgccgccatgccgtacctcgtccgcgagcggctctacttcggcggcatcaaagacgccattgccgccctcacggagtcttcctccacgccggacttcacccacgtcctctccgtggtcagctccgcctccatctccttcatcaccgattgccgcccgggcctcgagatccccaccgaggaggtcctccgcgtagtcgccggcgaggagggcgcggcaccgactgccgcggttcccccggggacgctgatgcgggtggtggagcgcgccgggcacgggctgcgggtcacgcgcatggccgtgccgctgcgggacaccgaggaggcggacctgctcgaccgcctcgagccctgccttgagttcatcgatgagggcaggaaggtcgggaatgtcctcgtccattgctttgctggggtgtcgaggagcgcttccatcattgttgcttatcttatgagagcagaacagaaatctcttgaagaagcattagaagctctgaaggagatttctgagtcggcgtgcccaaacgatggttttcttgaccagctgaaattatttgaagaaatgggcttcaaagttgatacttcaagtcctttgtacaagagattccgcttgaaattattaggccaatcctacatatctggggagaaaataagcagctatatgtttgaagatgaccctggcctttctctagagtctggctcttgtcaagattcttcaaaggttgagcaacgtaaaacagcttaccgctgcaggaaatgcaggagagttattgctgtagagggcaatgttataagtcatgttcctggtgagggtgaatcttgctttgattggaaccgaagaaagagtggtcatccatacaacaacaaagaacatggttgctcatctttgtttgtcgaacctctgaaatggatgactccagtagaagacggcgctttggagggaaagctatcatgcatccactgtggagctcggttgggatacttcaactggtcaggaatacagtgcaactgtggtagctgggttactcctgccttccaaattgttaagagcaaagttgatatcagcaccatctagacctgtgagcaaacgactggcaagtttgagggacgaggagcgcgacagcagtgacgcctgacggtttaatgttttgtgtaccatatgaacgctacgtatacaggtgaagcaatagcgtattttatgtttttccattgccgatcagaagctgtgtgtgacaaataccgtataaaatttcgcatttgctgatgtaacaagtagccgtggaattcttt

SEQ ID NO: 376 - DNA, 434 bp, Zea mays
acagccgacaaggcagggggagaggggaaatggcatcgttgtcccgcaccgctgctgccgctgtcgtggccctgaggtcggcggtccgctccgcgccccttaccggccgcgtcctcggagcgccactaccttcctttgcctcgccttccgctacccgctccgcccggatcctccgcaggtcggcggccgcggcgtcggcggggctggaaacgctaatgccgctgcacagtgcggtggctgccgcgcggcttaggtcctgcatcgccgtcgactcctcctgctggtgctcgctctcacaaggtttaaacaagcgcatctgaccatggctaggagctgagcagaagagaagatatgctttgcctttatgacagcgaggcgagctgcacatgaagaaacaaaagaatcttaggaattacaaacaagggctgtactag

SEQ ID NO: 377 - DNA, 1324 bp, Zea mays
aaagaattcattctcgaggctccttctcttgtagttcgtcgtccttgcgcagcagatcgagaggctgaggggagaggggtccatggagctgggaaagcccctttcggcgcacagatgtagctacaccgctacctacacccactgttccataggcttctcccctcgggtcgtccgtaccagctggatccgcgcggcggctgagggcggcgacggcggggcagaccggcgacggagaggtgccagcttcgccgccgatgggcccagggtcgtcgaggtcgccgctgccccggtggctactagcggaggcgccgccggagcagccgggagcgcggggttcggagcacgggacgcggagctcgccatgtgggacaagctcggggcggtcgtcaggctcagctatggcattgggatctacggggccatggcactcgccgggagattcatatgccaaatggccgggatagactgcacggggggcttccatccgtctctcacggcactcgtcgagggtcttggctatgcagctccaccaatcatggctctgctcttcatcctcgatgatgaagttgtcaagtattcgcctcacgcgcgtgccatccgtgatgtggaggatgaggagcttcgcagcttcttctgtggcatgtcaccatggcagttcatcctcatcgtggctgctagctcaattggcgaggagctgttctaccgcgccgccattcagggagcattggccgatattttcctgagaagcacggagctaatgaaggatgctcgagggattgcatcactgagtggtatcgttcctcctctggttccattcgctcagacgttcgcggcagtcatcactgcagccctcacaggaacactctactacgtcgccacaactccgaaagaccctacgtatgtggtgacaccagcgatgcgttcgcgcacagggcgtgagaacctcaagaaactatttgcagcttggtacgagaggaggcaaatgaggaagatatactcgccgcttctggaaggaatcttggctttctaccttggcttcgaatggatccagacggacaatatcctggcacctatgatcacccacggcatatactccaccgttgttcttggccatgggctctggaagatccacgaccaccggagaaggctacggcagcggattcagaaggtcaggagtgaagggagtagctctgcagacgacacattgtaactgcagcatgtagatcggcgtggtctactgctggatagctagctgctgattgcacgcgcgtactgggtgatcgatcgatctaccgatcagtcagaagaccagaggaggcctttt

SEQ ID NO: 378 - DNA, 1865 bp, Zea mays
ccgccatggctgcggcggcggccgccacctcgctcctcatacgccacaaccgcaacccccacctcctcctcctccgcgccgcgatctcctcctcccgcgcactgtcccagcagccggagctgtctcctgacccgaccaccggcgcccccgaccccgccggcgccgccccactccccccaaaccccagcacggggagccccttatacagccagaactggcgcaaccccgccgcagccaacccgccctcttcgcttctgcccaccgtcgccgccggcagctccttcggagcgcagcaccgcatggccgccttctacgataagcccgacgccgcggggctcaaggaaacgtttgccaagtatatggcggagcagcggtgggaggacatgaagcttctgttcgaccactgggtgcgctccctcgacgccgccacggggaagcccaaccaccccgacgtcgacctattcaatcactacctccgcgccaacctcatgacgggtgccgtaccgcacgagatgctcgatctcgccgatcacatgcgcgagttcgagctcgagcccaacagtgcatcgtacaacctcgtgctcaagagcatggtcgccgataaggagtcctacggcgccgagaagctcattgaacggatgctgcaaacaggaacagttccagatgaagaatcctacaatttggttgtaggcctgcttattagacagaaccttgttgactcatctctgaagtatttggatctgatgcttaaatcgggctacacgccatcactaactgttttcactgattatatccaagcatgtgtcagatctgggaggttggacacgttgacatcaattatacagaaatgcaagacagctgataagatcaaagttttgtgtccacaatgggcctggtgcattgacatatcagaagctgcatttgaagctaacaatagcaaattagctctttttgctctggaatttcttgcaagatggattgttcgtggtgagaatgttaaacctcctgttcagctgtcagttaatgaaggtcttgtaatatcagctctgagtgctgctggcagaacttttagtactgacctcttgaatgctgcttggtcgctactacggaagtccctgcgccagaaaagggcacccaccccagagacatatcttgccaagatctatgctcattcatcaattggccagcttcaaagggcttttggtacattgcatgaatttgaaaatgcctatgggaactccaaggacgttgatttagagctcttctcaccatttacgtccttgcatcctcttgttgttgcttgctgcaaagatggctttagcacattggatttggtgtatgttcagttggagaatctgagtcatgcagatccaccttacaaatctgttgcggctctcaactgtgttatattagggtgtgcaaacatttgggacattaatcgagcttatgaaacttttgtggctattaaggaaaaatttgaactcagtcctgacatccattcatacaatgcccttctgtgtgcatttgggaagttgaaacagacaggagaagcatgtaatgtgttccagcatgtattaactcttggtgttaagccaaatgcaacaacatactcccggcttgtcgatgcccatcttgcaaacaaagatccaaaagctgctcttgccataattgatgagatggttgatgctggcttcactccttccaaggataccctcaggaaggttcgaagacggtgctctcgtgagtcagactttgacagtgacgagaaagtccaatccctggctaagcagttcaactaccgaatgggtggtgagaatcgaagagagatgctttatagcatagaatacaatcctgtgtactgatga

SEQ ID NO: 379 - DNA, 935 bp, Zea mays
aaaggatcctgagccgaacggaaagaaccaaaaaataaccagacaatgagcttaacgcttctccagggctactcctccgctgaggacgacgacgatcccgccgccggcgccggcgctggcaccgagctgagcgagtctggtgattcgtcagccgaggaagccggatcggacgaagacgaggagtccgctcctccaaagccgccccccaagctccgccgccgaccaaaccctaaggggggagatgccggcggcagcgacgggggctccttgctgccctccgcgctggaggccttcgctgatgtctcgggaccaccagattttttgaggcacagggttgccgagccagaggaagggacggaggccctcggtgtactcgatcgccgtgggaaagaggggagcaaacagccgcctccaggtgctgttgtggtggcaaaaccacagatagttgctatccgcgagcgagttaccacaactggagccaaccccccaggttcagtgacagctggttctattgatggaaaaagagtaataggtgctgcaaatcctgggccagaagacgcagctgatcttctaaggatgtgtctacaatgtggtgtaccaaagacctattcacatggaaagggtatggtgtgccctcagtgtggtggtagaccgatgcagacaaaagagcccgaaaagaagaagggttccactgtcaaagacaaggagaaggtcaagaggatgagggggcaatcgtcacatgcatcatggaagagtgaaaccgagatggctcttcggcaacaattcgactgataactagttagggtgcccaatatttagatggagtactgggtaaactgtacgctgcgaaaaccttttttagctctgtgtaatgtaccatatgatgtcctttgtgcctcacactaggttccagaaagccagaaccagaattcttt

SEQ ID NO: 380 - DNA, 899 bp, Zea mays
aaaggatccaaagaaaagagcagcggagcggagcatgctcttcctccggtgccagcctcgcgtcccgtccgcgtccgcgtccgcgccgccttttcgtccccgcgtccgcgtcgcggctccactgggcgtgcgcgtcaccggcgggaggcgagggcaggcggtggtcgcgatggcgtccgccgacgctcgcttggcggggattgcctcctccatccgcgtcatccccgactttcccaagccagggatcatgttccaggacatcacgacactgctgctcgaccccaaggcgttccgtgacaccatcgacctcttcgttgagcggtacaaggaccaagggatcaccgtagttgctggtgtggaagctagagggttcatttttggtcctcctatcgctctagccatcggtgctaaatttgtacctttgaggaagccgaagaagttgccaggcgaggtgatctccgaagaatattctctggaatacggaactgacaagatagagatgcatgttggagctgtacaggccaacgatcgggctcttgtagtcgatgatcttattgccaccggtggaacactctgtgcagctgtcaaacttattgaacgtgttggagcaaaggttgttgagtgtgcttgcgtcattgaattggcagaactgaagggccgagacaaacttggggacagggcagtttttgttcttgtggaagcagatgcttgagcggaacttgggacttctcttctcagagagttagagttagcgctgttgatgctacctctctggaaacaacaaagtttcccatgttggctatattctggctgacacgtaataaagtttcattccaaattgtgatcccctgaatgatttgtcaatgtagacatgattgctggtccttgtagaattcttt

SEQ ID NO: 381 - DNA, 1154 bp, Zea mays
aaaggatcccatttcgtcgaacgccagcggcgagtcgagctcgagccccagccaccgcagccatggtcctcacgaaaccctacctctccaactcgctccttccagtcccatccccgccgccgtcgagccctactctcagctccaaccatgcaagccccgttgccgcccctacttgccgtcgcagccgcctccgcatctccgccacatccacggctgcgccggctccttcgtcggctgccgctgccaccgcgtcgctgagtcgagtggacgtgctctcggaggcgctcccttttattcagcgattcaaaggcaagacggtggtggtcaagtacggcggtgcggcgatgaagtccccggagctgcaggcgtccgtgatccgcgatctcgtgctgctctcctgcgtcggcctccgccccgtgctcgttcacggcggcggtccggagattaattcctggctgctgcgcgtcggcgtcgagccgcagttccgcgacggcctccgtgtcacggacgcgctcaccatggaggtcgtcgagatggtgctagtcgggaaggtcaacaagaacctcgtctccctcatcaacattgcgggaggcaccgccattggtctgtgcggcaaggacgcgcgccttatcaccgctcgcccgtctccaaacgcagcggcgctgggattcgtcggcgaggtttcgcgcgtggacgccaccgtcctccatcccatcatcgacgcgggccatatcccggttatcgccaccgttgccgccgacgagactgggcaagcctataacatcaatgctgatacagcggctggcgagattgccgctgccgtgggcgccgagaagctgctgttgctcacggatgtgtctggcattttggcggaccgtaatgaccctgggagcctggtgaaggtgatcgacattgctggggtgcggaagatggtggctgacgggaaggtagctggtgggatgatacccaaggtggagtgctgtgttcacgccctggcacaaggtgtacacaccgcaagtatcattgatgggcgtgttccacactctcttctgcttgagattctcacagacgagggcacaggcaccatgatcactggctgagctgcttcatgccttcatgaagaggactgagaagcgaagcgtttggaattcttt

SEQ ID NO: 382 - DNA, 1741 bp, Zea mays
caattcgagagcggttccggcggcgtgggcggcgccgtgcctgagatcggagccccgtggcgcggtgctggcaactggcggcgcgatgtgggcggtccacgggagggagtccacggccgctgcgcttcgcctgctgctgatcgcgatcgcctgcggcctcgtcttcgcgctcctccacctccccctcccggatgaccgtgcgcgaaccgccgaccccggtgggcagcgcggcgctgctgggggcggcggggcccgcctgtcggtgcagcaggggagggttcgagaggccagaaggctgagtgtcgtcaccgaagagacagatgggcaaactgacgaaacggcggcggaagaagatgaaaggatatctaaatctcccccagacaccaaagagaagatctggatgatgcaagatcagctaattttggccaaggcgtacttgcatttcgcttctccccaaggtagtgtacatttagttcgagagctgaaattgaagataaaagagatcgaaagggcaataagccactcaagtggaggtacccatgtacctgggagtgtgttgcaaaaaataaaggcgatggagctgaccctttcaaaggctcagaggacctacccgcattgctctcagatgacgtcaaagctacgtgcaatgatgcataatagtgaagaattggtcagagcacaccaaagtgaatcttcattccttgagcaggttgctgtgaggacattacccaaaggccatcactgcctagcaatgcagcttaccgcagaatacttttcgttagatcccactaaacgtgaattccctaaaagagacaacattcagttgggtggttattatcattatgcgatgttctctgacaatgtgcttgcaagtgctgtggttgtcaactctacaattgctgcatcaaaggatcctggaaggatattattacatattgtaactgacgcgttgaattatcctgcaatgatgatgtggtttctgacaaacccaccaactccatcagtaatccaaatccagagcctagatgatttgaaatggttgcctggtgatttcagttccagattcaagctgaagggggttcgggatccgagatacacttctgcactcaaccacttgcgtttttatttgccagaagtgtttccatctttgagcaaggttctactcttggaccatgatgtggtagtacagaatgacttgtctggattatgggacctagatatgaagggtaaggtaaccggtgctgtcgacacatgcacctcaagtgaaggtttccgccaattggatagccttattgatttttccaatccaagcgtcttcaacgaacttgacccaaaggcttgtgcatttgcatttgggatgaacatatttgacctgaacgaatggcgcaaacagggtttgagtacaacctatcatagatggtttcaactgggcaaaagtgagaagttgtggaaggcaggaagcctgccactgggtcaggtcgtcttctacaaccggacgctgcctctggaccaccggtggcatgttctagggctcggtcatgactccagcatcggaagagatgaactcgagagtgcctctgtcatccactacagtgggaaactcaaaccctggttggagatttctatcccaaagtacagaggctactggaacaggtaccttaactacgataacccgcacttgcagcagtgcaacattcacggatagaggcgatggcgggtgaggtgattcgcaaggtagaac

SEQ ID NO: 383 - DNA, 1414 bp, Zea mays
aaaggatcccacaaagctcctctagcacctctgtgtggccgacttgtccccggtatcaccaagtctgcaggcctccccagtcgtcgccggcgagggaacgcgccgcccgtgacgccgcgggttgttggcgccggcgttgaggccacaagcgcgccagcatcaggacctcacaggtgattcaatcctgaaggcatcaactatgttcaattttcaagaaatgtcttgctgttttacgtgtgcgacgggcatggaacgaaataatgaaaacgaaggaggaagcaaggtgaggattttttcctacagtgagatgaggaaagctacgcatgattttagtggagcaaacaagattggcgagggcggtttcggctccgttttcagggggaagcttaaagatggaacgatcgtcgcggtgaaagtcctttctgctaattcaaggcagggtgttcgagagttcgtaaccgaacttacagcaatttcagatatcgtgcatgaaaacctaattacattggttggttgctgtgccgaagggtcccagaggattcttgtgtacaattatctcgagaacaatagtctttcatatacacttctaggttcgggccggagcaacattcggttcaactggagagcccgtgtcaagattgctgtaggcgttgctcgtgggcttgcttatcttcacgatggaattcggccccctataattcatcgagatataaaggcgagcaacattctccttgacaaggacctcaccccaaagatctctgatttcgggctggcaaggctcctccccccaaacgcaactcatgtgagcactagggttgcaggaacaataggatacctggctcctgaatacgctgtgagggggcaagtgacgaagaaatcggatatctatagtttcggcgttttgctactggaaattgttgctggtagatgtaactacaacagtagattgcctcagggagaccagtttctgcttgagaagacatgggcatactacgtgcagggaaagctagagaaggtcatagacgccgaagcaggggaggacctgaacgtcgaggaggcatgccgtttcttgaaggttggcctactatgcgcccaagacgcgatgaagctgcgtccgaacatggccagcgtcgtcctgatgctgataggagagaagggaatctccgtggacaggatcaccaagccagccgtgatcggtgacccgtacctcgaccggaggccaagcaacgcagactctaccacgatgaagtccttcgccacgaccgaagctttaacgtcatcagaggcaaacacggagtggtctctgtgatggggggaaaaaacgtcatcatcgatggagatttgtttttgtggatgctgcagttgccaaacaaataccgcatcgcttctgttgattatgttttagggtaccttt

SEQ ID NO: 384 - DNA, 1254 bp, Zea mays
aaaggatccagtgctctgctttctgcattcccccccgccgccactccgtcgggcttgatgagcctctgctccaagctcttcgcgttgctccgcaagtcccgcgccctcgccaccagcaccgccgccgcagccgccgcgacaacctccgcgacggcgtcggccaacgggatggaggaggctgtcgccgcggcgggcccgctgcgcacgcgcgtctgcatcatcggcagcggcccagccgcgcacacggcggccgtctacgccgcgcgcgccgagctcaagcccgtcctcttcgagggctggctcgccaacgacatcgccgcgggtggacagctcaccaccaccaccgacgtcgagaacttcccgggcttccccgacggcatcctcggcgccgacctcatggatcgctgccgcgcgcagtcgctcaggttcgggaccaagatcctcaccgagaccgtcaccaccgtggacttctccgcccgccccttccgtgtcgcctccgacgacaccgttgtgcacgccgactccgtcgtcgtcgccacgggcgccgtcgcgcgcaggctgcacttcgccggctccgacgccttctggaaccggggcatctccgcctgcgccgtctgcgacggggctgcgcctatcttccggaacaagcccatcgccgtcgtcggaggcggggactccgccatggaggaggctaacttcctcaccaagtacggctcgcaagtttacatcatccaccgccgcagcgacttccgggcgtccaagatcatgcaggcgcgcacgctctccaaccccaagatcaaggtcgtctggaactccgaggtcgtcgaggcctacggcggtgcggatggcggcccgctagccggcgtcaaggtcaaggacgtcgtcaccggcgaggtctctgatctccaggtggccgggctcttctttgccatcggtcacgagccggcgacaaaatttcttggagggcagctcgagctcgactctgatgggtatgtggtgaccaagcccggttccacgcacaccagtgtgcagggggtctttgcagctggggatgtccaggacaagaagtaccgccaggccattactgcagctggatcaggttgcatggctgctctggatgcagagcactacctgcaggaggttggagcacaggaagggaagaccgattgactatgtctgggccaagctgctcttgggccaaggaaaacttctccgaaagccgctctctagtggtgtaaacagcacgaattcttt

SEQ ID NO: 385 - DNA, 569 bp, Zea mays
cgtccatggaccccaccggcgtcgacggcgattccgcggcggcgagggggagcggaggcggaggcggaggggggacaggggccggccggtgggcggttggcgcggtgtgtggggggctggtctactaccactgcgcggtacggcgagccagcgcggtgtcccttgcagcagacgtgctcctcgtcctcctctgctcgctctccatcctcggcctcctcttccgccacctccacatctcggtgcctgtggatcctcttgaatggcagatctctcaggagatggcaaatagcatagttgcatctttagccaatacagtaggagctgctgagtctgtattaagggtggctgcaactggacatgacaagaagctgtttttcaaggtggtttctacattgtattttctagcagctttgggaagggtggtgtcaggcgctgccgttgcgtatgctgccctatgcatcttctgcctctacatgtttgcacaaagcaccgatctgtttgatcagctcccttcttgggtccctgtgggtagggattctttgggcggtactcaggataccgcgtgatga

SEQ ID NO: 386 - DNA, 1514 bp, Zea mays
caggcatggccgcctcctccctgctccggtcgttcacccgccgcagctgcgcgggcccgagcgctttcgcttaccgccaccaccaacgacagcaaccttggtctcccttctccaccagcgccgctgcggtcacgcaggacgaagcggcgaagaggttccctggactagggccgacggcgaagggggagaaggccagggtggtggtgttggggacagggtgggcggggtctcggctaatgaaggacctcgatacacaaggctacgacgtggtctgcgtcgccccgcgcaaccacatggtgttcacgccgctgctcgcctccacctgcgtcggcacgctcgagttccgatccgtcgctgagccggtcgcgcgcatccagcccgccgtgtccaagtcgccgggctcctacttcctcctcgcccgttgcaccggcgtcgaccccgacggccacacgattgattgcgaaacagttacagatggtgagaaagattccttggagccatggaaattcaaggttgcttatgacaagttggtttttgcctgtggagctgaggcatcaacttttgggatacatggtgttaccgaccatgcaatctttcttcgcgaagttcatcatgctcaagagattcggagacggctcctccttaatctgatgttgtctgatctccctggaatttcagaagaagaaaagtgcagattattgcactgtgttgttgttggaggtggtccaacaggggtggaatttagtggtgaacttagtgattttattatacgagatgtcaaacaacgttattcacatgtgaaggattatattcatgtgaccctgattgaggcaaatgagatattgtcatcattcgatgttcggctcaggcaatatgctacaaagcaactaattaagtcaggtgttaggcttgtgcaaggaattgttaaggatgtgcagcccaacaaaataattcttgacaatggagaggaagttccttatggtttactggtatggtccaccggagttggtgcttcaccattcgttaagtcattgccatttcctaagtcacctggtggaaggatcggtgtcaatgagtggttacgtgtcccttctgttcatgatgtttatgccattggtgactgcagtggatttctcgagagcaccggcaaggaagttctccctgctttagctcaggttgctgaacgacaaggcaagtacctggcaagcctgctcaaccatgtcatgaaagctggaggagggcatgcaaactctgagactgaagcagatctgggtcgtccaccctttgtgtacaagcatctaggcagcatggcaactgttggaagatacaaagctctagtcgatctgaggcaaagcaaggagtcaagagggatatctcttgcaggatttgtgagctggttcatctggcgctcggcatatttaactcgtgttgttagctggaggaataggttctatgtggctatcaattggctgaccactctcttatttggccgggacataagcagaatctagtag

SEQ ID NO: 387 - DNA, 1847 bp, Zea mays
cgtagcgaaggatgtcggaggccgtcgccgcaggcgagtcgcccgtcgagctgctgctccgcgcggcggcgatggtgcccgcagagcgctacgcgctggccgccatcatcgtcgtgtccgtctttctgtaccgcttcctcgagctccatgttatcggcgacatcctccgcggcttccggggcggccgcgtcgagctcaccttccaccccgcctcggagatctaccaccgcgtcgcgtccaagtgccgcttgctccacggcaggtatctggcgacaccatggctggcgagcccgcatttgcagacattgttcctgggcatttacgggacgccgccttcattcacatacaagagacagttgtacactgttcgtgatggtggaaccattgctttggattggctgttcgcatctgatttggaagttgcagatggattcatttcgaaagacgcttcaacaccccttgtagttgtggttcctggattaactagcgattctgctgctgcttatgtaaaacacttggtttactccatggcaagcaaaggatggaatgttgttgtaagcaaccacagaggtcttggtggtgtgtccattacttcagattgcttctacaatggtggttggacagaagatgtccgagaggtcattacacacctgcatcacagatatccgaaaaccacactgttttgcattggtacaagcataggtgccaatattgtggtcaagtatcttggagaagaaggcgagaatactcctatagcgggtgcagtatctatttgttctccatgggatctgttgataggtgacagatttatttcccgcaagcttgtacagcgtatttacgacaaagcacttgcaattggtctgaagggctatgcaaaattacatcaacctgtcttggcccgacttgcaaattgggaaggtattaaaaagtcacgatctatccgagagtttgaccaccatgctacttgtgttgtctcaagatatgagacagtggatacctactatcgccggtgcagtagtgctagttacgtcggaaatgtgtcagttcccttgctttgtatcaatgctttggatgatcctctttgcacaagggaggctattccttgggatgaatgcagggccaataagaacattgttttagcaactactccaaatggtggtcatcttgcattctttcaaggactaactgcgcggagactatggtgggttggagctacttctgagttcctttctgctcttcatgacagctcctacatgcataggcagaaggcaaatgatcatgttttgctctcgtctttggaatcctccattgataagagtccgtatgttaatctcatggaagatggaatggtagctgcggtaacaaaagatggccctagcaatgacgggtcacctttgaaccatgcagctgatgaacaattaagtaacgaggcgggcggtggacaacagaatgtggtatctgcattgaaccataatgaaaactccattggagtgggaaacgacagccctgcagagccagtaaaacagcaaggtgatgacatccacagcaataagcttcatgagataattgctcctgtcaagagatctatgagccaactgactcgataccaagggaggtcagtctggttgcttgcctacattgcttttgtaacatcctggccgctgcttggctccctagctttcatcaccttccggaaaaagtccaggaatccgttgcgagctaaatgaatcatacttatattatgttattacaattacatcatgcaacatcctctgagctacgaaggccatttttccccgggtcgtcacagctcctgtgtacagtatcatcaccgatcatcagcatag

SEQ ID NO: 388 - DNA, 1437 bp, Zea mays
aaagaattcttaaggttaagcacctcccaaacacgcctatgagggccctcgtccggatccacctgcccacggccatctccaccggatccttcctccacacctcctcaaccgccgcctccaagaccctagtaccgaaccccaacctcgtcccgctccggctcgtccgccacttcccggccatggccgccaccgccgcagacgagttcgtgaagggccgcgtcttccccaacggcgtcgccgtcatcacgctcgaccgacccaaggccctcaacgccatgaacctcgaaatggatgttagatacaaggcacttcttgatgaatgggaaacaaatccaagtgtcaagtgtattcttgtggaaagcagctcttctcgtgccttctcagcagggatggatattaagggggttgccgtggaaatacaaaaagacaaaaaaacaccacttgtgcaaaaggtattcacagtagagtactctttaatttgtaagatacatgagtatgcaaaaccttatatatgcttgatggatggagtgacaatgggatttggaattgggctatcagggcatggccgctaccgcattattacagagagaacactcctagccatgcctgaaaatggtattggcctgttcccagatgttggctttgcttacattggtgcaaaagcaccaggagggggtgcagttggagtttaccttgggattactggaaaaaggatatcatcacctgctgatgctatgttcataggccttggtactcactatgtaccttctgcaaatttgggttcactcaaggagtccctgctgagtgctaacttcaccaatgatcctcatagagacgttgagtcagttctgacaggatacaagaaagaaccagagtctgaaccacaactaaaaaagcttttgccatatatcatttcttctttcagtcctgataaatcagtggctgaatctgtggaagagctaaagaaatgtagccgaagtggtgatgctgcagtggcagaatgggccaatgaagctttagcaggaattgagaaaggcgctccattttctctttgtttaacacagaagcatttctctcaagttgcatcagcatatgggactagtgaacactatttatctaagctggctggtgttatgaaattggaatatcgcattgccttgaggtcgtcgattagaaacgattttgttgaaggtgtgcgtgctgttttagttgacaaggaccagaatccgaagtggaatccagccactctggaagaagtaaacatggccgaggtcgaatcagttttcgagccattaggggccgaggctgagttgagtgtgtgaaatatggcctgccacactcagttttcttatttgtgctgcaataataatgtatacaaaacagaaatgcgatgcccacagaaacaataaatgctgtgtcttcatgaacgagctcttt

SEQ ID NO: 389 - DNA, 2167 bp, Zea mays
gcccagagaagatcccaaccccgcccgtccgccgcggactcccgggcccgccgcctcgtccgttttccgaatcggccgcgcggggtaccgcggcgccgggggccgcccggagctccgtccgagtccgttgccgggagccagccagggcgcaacgcgagcgcaatggcggaggtggggagccgggtgcgcgggttcctgcggaaccggtggctggtgttcgtggcggcgatgtggatgcagtcatgcgccggcgtcggctacctcttcggcagcctctcgccggtgatcaaggcctcgctcggctacaaccagcgccaggtcgccgggctcggcgtcgccaaggacctcggcgatagcgtcggcttcctcgccggcacgctctgcgccgtgctcccgctctgggccgcgctcctcgtcggcgccgcgcagaacctcgtcggctacggctgggtctggctcgccgtcacgcgccgcgtccccgtgcccccgctctgggcgatgtgcattctaatcttcattggtaacaatggggagacatacttcaacactgctgcacttgtctcgtgtgttcaaaacttccccaagagccgtggaccaattgttggcatcctcaaaggattcgctggattaagtggtgcaattctaacgcagatttatgcaattgtacactctcctgatgatgctgcactgattttcatggttgcagttggcccaacaatggttgttatagctttaatgttcattgtaagacctgttggaggccacagacaagtgcgaccttctgatggcacaagtttcacatttgtatacagtgtctgcttgctgttagcctcttatcttatgggcgtcatgttattggaagaccttgtcgacttaagccagtcagtgactgtcgtgttgaccgtgattctaatcatgtttctattagttccaatagtcattccagttctactcagcttcttttcggatgatgatgagactttgtatgcactattgttgccatcacctcggaaagaagaagcaagtgcatcaacatcttctgaggagcaacatgaggttatactcagcgaggtggaggatgaaaaaccaaaggatgttgatttacttccagcctcagagaggcaaagaaggatagcagaattgcagacaaggttatttcaggcagcagctgttggtgctgtcagggttaagaggaggaaaggtccacggagaggagaggatttcacactgatgcaagcgctcatcaaggctgatttctggcttctatttttctcccttctgctgggctctggatctggtctcactgtgattgataatcttgggcaaatgagccagtcattgggttacgaggaaacccatatatttgtgtcaatgataagcatctggaactttcttggacgtattggtggagggtatttctcagagattattgtcaaagattacgcatatccaagggcgatcgcattagcgatagctcaagtcctgatggcgatcgggcacttcaacttcgcgatggcttggcccgggacaatgtacatcggcacgctgctcgtcggagtaggctacggcgcgcactgggccatcgtgccagccgcggcctcggagctgttcggggtgaagaacttcggagcgctgtacaacttcctcacggtcgcgaacccagcaggctccctggtgttctcgggggtcatcgcgagtggcatctacgacagtgaagcagcgaagcaggctcagcagcgccacaactccacgtcgctggcgatgagtggcagagtggctggcatggtctctggagccgctccgtcgttgaagtgcgagggcgccgtctgcttcttcctctcatcgctgatcatgtccgggttctgcatcatcgcgtttggcttgagcttgattctggtctaccgcacaaagatcgtgtacacaagtctatacgggaaaccgcgtacttgaaggatcaaccctcaagggacacagggttatcaaagcatacttcaattttgaatttattagtctggtacccccatgcctgtacaggtacagtgtcggtcttcccgttgttgtgcacaggttctcaagcagcatttcaacttttcaagtatgtggctgcaaatgggagcttcagtatagtgaagcatgtgagagtagaaagtccgtctgtggcgaattc

SEQ ID NO: 390 - DNA, 1229 bp, Zea mays
taacgatgttgagacagagctctagtagaaatcagagatccagaggtctgaagctgaagaaagctcttcagattagtctcttgcttctggtttctgtttggttgctctaccaagttaagcattcttacgagaagaaggcggcgtacagcgaaggtgaagtgaatgatttgcataaagatgacaagggccagggagaggcagtcagattgggcaggaaggatgtgcctccaaagatggaggctgattcttcaacactggatgagcgggttgaggatgaagagaacgatgaagtggagcaagaaatgaagcatgatgagaacgatgaggatcccatcgatgagcaagacctggagaaggacgaggatcttcccgagcctggcgagcattcttctgaaaaggatgaagatgtgggtgtgtttgaggacgaagagcggaaggagcggtcacaggaggatcaagagaagagcttccatggtgacgatgtgtctagtgctgttactcatgatcctcaatcgtccgagcaagatgagctgttccatcatgcccaagacacggtcctattcgtggatgatgcttcaactgcagtgcccaatgaaaaccatgtggctggaaacgacgaggaggaagtgcagagggctagggaaaggagtttcagaggcgatgatgtgtcaagctccgtggatcatgacgccaaggtggcaaagcctctcccagaggaacaactgaacagcatggataagatatttgaaggcaccacaaacttgtctaacggaatttcgtttcgagctcctggaataaatggatcatatgccggcatggacaatgtggctacagtaccaactaattcaccttcacagaaaaacgcaggcactcctagcaatgacatagaaagcaagacccacccatctccggcaaatttgaccggaccagagcaaagtaattcgactttgaaagatcacccagatcaacaagtgaattcaacagcagtgctgggcaaccaagtacagcctttgactaaccagacgccgtggcccgagttggattctccaaatggcaccttggctctggtaacagatgtccaaaagtccacatctggagctggagatgatggcagcagcactgtggacaagaggacggacggtagagatggtcccaaagaagacgtggatgtgtccacgaaaataatgaacagggcaatcagtgaggatgaagtcgttccagagtgatga

SEQ ID NO: 391 - DNA, 793 bp, Zea mays
aaagaattcgtcgaaaccacagccacacaggcagccggtgctgggcctcggcactcggcagccatggttcgccttgcgaagttctatctcgtctgctacaactccctccaatcgctcggatggttcgtcgccctcctccgcctcgtgccctgcctcgtccctcccttccctgtccactccgcgtacgtggtcgccggcgacctcatctgtttcctgcagacatgtgcgatccttgaaacggtccacgctgccatcggattggtgccgaccgcgccacttcttgctttcttgcaatggggagggaggatccacttcatcctggctgttgtccggcaaattcgcgaggttcagagcagtccatctgtgttcataacatttatagcttggagcatatctgaggtcatccgttactctcactatgctctgagtaccttaaaagtttgtccagcatggctgacttatctcaggtacactgcttttatcccgctgtatccaatcggggttggtccaggagaaatgtggacaatgtaccaagccctcccatttgtgaagaagagggacctttactcaggtttcttcgagaagttctccatgagctaccgttcctttctagtgggtgtgcttgtgctctacccgttcctgtggctgaagctgtaccagcacgtgttcaagcagcgcaagtccaagctggggaaggggagcaggaagaaacgggcctgagaaaatctggctctgctcagctcagctcagctcagctgccacttgttgctgtcatgtgaaatagaggcctttt

SEQ ID NO: 392 - DNA, 444 bp, Zea mays
aaagaattccgaatggtcgaacagtagtttgctcgctattatccatggcgacttctacggctgctgccactgcactgctccgccccaggccggcagttccagccaagttggcgcagaggaggtgcctccatgcggttgctgggtggacgacgatgaggaggaggggagctgcaggggtcgtgcgagctttcttcaaccctctcggggatgagcgcatcctccgagaagccatcaaggagccagtagcattcatgggtggtgtgtttgctggcctcttgaggcttgacctgaatgaggatcctctcaaggaatggataagtcggacagtggaggcttctggaatagctgaggaaaacagctctgaagaatcaagtgaggcagatcaaaatgatgcacctcagcaaattgagattgagtgaggtgcattgtctacctaggcctttt

SEQ ID NO: 393 - DNA, 863 bp, Zea mays
gacacgctacggcctctcggcggggcccggcaacagaccgggcagcagcacggcagccatggcgtcgagttcgaccctggatttggcgatgggccccggcgccctcctcccccgcagcgcggtcccgtacgcctccttcgctccaggaaggggaaggagcgcgagcggaacgaggagcaggaatctggcgctctccgcttcctcctccaacggtgcagcagtgccatccctgacaacagattcggagaagaagggcccagtgataatggaaattccactggaccaaatccggaggccactgatgcgaacgcgggccaatgatccagtcaaggtgcaagaactcatggacagtatccgtgtcatcggcctccaagtacctattgatgtgttggaggtcgatggggtctattatggcttctctggatgccaccgctacgaggctcaccagcgccttggtctcccaaccatccgctgcaaagttcgccgtgggacaaaggaaacactgaggcaccatatgcgatgagttatattttattcagttacaaagtgatctgtgtatctagagctaaaacagaagcttccatggtcttttcgtcgtctcgtctgcaattctccatacctgtaaatgttgtccaaacagagtggtgaatagtacttctgtacccagcagcatcagaaaatgttaattttgcctacaacactcttttcgatcagtggatggatgagtaccacccgctcagtagatcattccatttctacgagatttttgtaaaaaaagaaaaatgcagcagcagtcggcacgctgtgtcatttagatcatctagaaaaccagaaaaaacgagtcatgtaacttgtttggctcg

SEQ ID NO: 394 - DNA, 820 bp, Zea mays
aaagggatcccagcctcatcctatccaagaacgcagaaccgagacccacgaactcgcagcaggccagcagccatggccgcccccgcaacgagctccctgctgagcacgctgctgcagctaccgctcgctccgttctcggggaagagctcgccgccgtccgtggtgcacgtggcgcgccgggcgccgacggcggtggtggcggccaaggggttcaatgtgcagatcctggtggacgagaacgagggggaggagtccatctttcgcaggttccggcgggaggtgatgcgcgccggcgtgctgcaggagatcaagcgccgccggaggtacgagagcaagacagacgagaagaagcgcaaggcgcgcgaggccggacgccgcaaccgtcgcaggcgtatgatggacgagccgaggttcccagaagaagacgccgacgcgacctccaaggctcgggacgaggacaacgacaactgggaggtcgacggcatcctgtgaaacaaaaggaacgcatgcagtccacagttcaatttcacagcgtccagatgatgcacagcacagacccgtcaaattcgagttctttttgaggcccccccgtaagacgcaatccaaaccgtatatttgcgttttggccgcgttcgtttccacttcagtgtccaatggttacagctgcaattgcacaactaacgttcgcaaatgtagcgtcctccgatcccttctcgttccctgagctcttcttgtgtccatggtgtttgaaaccctactcttgtgtctgttccaacatctatcctttgtgtagcttgcgctcatgaaagttgaattcttt

SEQ ID NO: 395 - DNA, 4535 bp, Zea mays
atcacatggagagcgcgatggagaaggtgtgggagtcggggcggcggatgagccggagcatcgggcggggcatgggcatggaggcgtggggcgtcgacgacgccttcgtgccgcagcacggctcccggtcccggggcggcggcggcggcggcggcgacgacgacgaggaggcgctgcgctgggcggccatcgagcgcctgcccacctacagccgcgtgcgcaccgccatcctgtccaccgagaacgccgccgtggttgacgacgacgacgacaagacgcggcggccgccgccgccgcagcagcagcacttcaaggaggtggacgtgaggaagctcggcgtcggcgagcgccaggagttcatcgagcgcgtcttccgcgtcgccgaggaggacaaccagcggttcctccagaagctccgcaaccgcatcgacagggtgggcatcgagctgccgacggtggaggtgcggttcgagcggctgacggtggaggccaggtgccacgtgggcagccgcgcgctgccgacgctgctgaacacggcgcgcaacgtcgcggaggcggcgctgggcctgtgcggcgtgcggctggggggccggcaggccaggctgaccatcctcagggacgtgtccggcgccgtccgcccgtccaggatgacgctgctgcttggcccgccgtcgtccgggaagaccacgctgctgctggccctcgcgggcaagctggacccggcgctggtcgtcgccggcggcggcgaggtctcctacaacgggttccgcctcggcgagttcgtgccgcagaagacggcggcgtacatcagccagacggacgtgcacgtcggcgagatgacggtcaaggagacgctcgacttctccgcccggtgccagggcgtcggcaccaaatacgatcttatgacggagctggccaggagggagaagggggccggcatccggccggagcctgaagtcgacctcttcatgaaggcgacttcaatggaaggagtggagaacagcctccagacggattacactctcaggatactggggctggacatctgcgccgacaccatcgtcggcgaccagatgcagcgggggatctctggcggccagaagaagcgcgtcaccacaggggagatgatcgttggcccgaccaaggtgctgttcatggacgagatatcaactgggctggacagctccacgacgttccagatcgtcaaatgtctccagcagattgtgcacctgggcgaggccaccatcctcatgtccctcctccagccagcccccgagaccttcgacctgttcgatgacatcatcctgctgtcggaaggccagatcgtttaccagggacctcgtgaatacgtcctcgagttcttcgactcctgcgggttctgctgccccgagcgcaagggcactgcggacttccttcaggaggtaacatcaaggaaggaccaggagcagtactgggcggacaagcagatgccttacagatacgtttcggtgccagaatttgcgcagcggtttaaacggttccatgtcgggctccagcttgagaaccacctctcgctgccgtttgacaagagcaggtgccatcaggctgccctcgtattctcgaagcactcggtgtcgacaaccgaactcctcaaggcatcctttgacaaggagtggctcctcatcaagcgcaattcatttgtgtacatcttcaagaccatacagcttatcattgtagccctcatcgcgtcaacggtgtttctgagaactcacatgcatacgacgaatctagatgatggctttgtttacattggagcactgctctttactctgattgtgaatatgttcaatggttttgctgagctttccttgaccataacaaggttgccggttttctacaagcaccgggacctgctcttctatcctgcttgggtcttcacagtaccgaacgtcattctcagaatcccattctccattattgaatctatagtatgggttcttgtgacatattacaccatagggtttgctccagatgctgacaggtttttcaagcacttgctgctcgtgttcttgatccagcaaatggcaggtgggcttttcagagcaacagctggactttgcaggtccatgatcattgctcaaactggtggagcactatttcttcttatcttctttgttcttggaggctttgtcctgcctaaagttttcattcctaactggtggatctggggctactggatctcacccttgatgtatggatacaatgctctagctgttaatgaattctatgcccctcggtggatgaataagtttgtcctggaccaaaatggtgttcccaaaagactggggatagctatgcttgaaggtgccaacatctttgttgacaaaaactggtactggattggagcagcagggctcttgggtttcaccatcttcttcaatgtccttttcacactgtcgcttatgtacctgaaccctctcggcaagccacaagctgttatatcagaagaaactgcaaaggaagcggaaggcaacgggcattcaaaaggggcaataagaaatggaagcacaaaaccaaaggacggtagtcataacaaggaaatgaaggagatgaggttgagtgcacgtttgagcaactgttcatcaaatggggtttcacgactcatgtccattggcagcaatgaagctgctccaacaagaggaatggttcttccattcaaccctcttgctatgtcttttgataatgtgaactactatgttgacatgcctgcggaaatgaaacatcaaggagtgcaggatgacagactccaattgttgcgtgaggttacaggatcattcaggcctggagtgctgacagcacttatgggtgtcagtggagctggaaagactactcttatggatgttttggctggaagaaagactggggggtatattgaaggagacatcagaattgcaggctatcccaagaaccaagcaacattcgcaaggatttctggatactgcgagcaaaatgatatacattctcctcaggtcacagtaagggagtctttgatatactctgcctttttgcgccttcctggaaaaattggagatcaagaaataactgatgacataaagatgcaatttgtggatgaagttatggaactagtggagctcgacaatctgagggatgccttagttgggctaccaggaatcacagggctttcgacagagcaaagaaaaaggttgacaatagccgtggagctcgttgccaatccatcaatcatatttatggatgaaccaacatcagggcttgatgcaagagctgcagcaattgtcatgagaactgtgcggaacacagttgacactggacggacagttgtttgcacaatccatcagccaagcatcgacatctttgaatcttttgatgagttgctattgttgaaaagaggaggccaggtgatctactctgggaaattgggtcgcaactcccagaaaatggtggagtattttgaggcaattcctggagtgcctaaaataaaagataagtacaatcctgcaacgtggatgctcgaggtcagttcagttgcaactgaagtgcgactaaagatggattttgctaagtactatgaaacatcagatctgtataagcaaaacaaggtactggtgaaccagctgagtcaaccagagccaggaacatcagatctttatttccctacagagtactcgcaatccacaataggacagttcaaagcctgtctctggaagcaatggctgacttattggcgcagcccggattacaaccttgttagatattccttcactctgttagttgccttgcttctcggctccattttctggaggataggcaccaacatggaagatgcaaccactctcggtatggttattggagcaatgtacactgctgttatgtttatcggcatcaacaattgttcaactgtgcagccagttgtttcaattgaaagaacggtcttctacagagagagggctgctgggatgtactctgctatgccatatgccattgctcaggttgttatagagataccatatgtatttgtgcaaacaacgtactacaccctcattgtatacgccatgatgagcttccaatggacagctgtcaagttcttctggttcttcttcatttcctacttctccttcctctacttcacctactatggcatgatggctgtctcaatctccccaaaccatgaggttgcatccatcttcgcagcagctttcttttctctcttcaatctcttctcaggcttcttcattccgagaccgagaattcctggatggtggatctggtactactggatttgcccactggcatggacagtgtatgggctcatcgtgacacaatacggagacctggaagacctcatctcagtccctggagaaagtgagcagacgataagctactatgtaacacatcattttggataccacagggattttctgccggtcattgcgccggttctggtactctttgcagtattcttcgcgttcttgtacgcagtctgcatcaagaaactgaacttccagcaacgataataa

SEQ ID NO: 396 - DNA, 1182 bp, Zea mays
aaaggatccgttcactggataattcgctcgctccgctcgatgcccgcttgtttgcggtgaagcctccggcgaacagccgtagcggaaacgccgcccgagatgtctgctccctccgccccaccccgcacggtgatctgtgtgggcgacgtccacggctacatcacgaagctggagagcctctggtccaacctccaggccgcactccccgccgacgccttcgccaccgcgctggtcatcttcctcggcgactacaacgaccgcggcccgcacacccgcagggtcctcgacttcctcctcgcgctcccgacgcgctaccccgcgcagcgccacgtcttcctctgcggcaaccacgacctcgccttcgcggcgttcgtcggggcgctgccgccgccgcccgacggctccccgttctcggccacctgggacgagtacatccacaacgaggagcacgaggggtggttccgcgggccgggattcgagggcatgcacgtgcaggggaggcggtggggcggggtcatcaaggagaggtggaaccccaagaagggcctcccgtacaagggctccatctacgacgcgcagcccaccttcgaatcctatggcgtcgcccatggttcctctgatcttgcaaaggctgtgccagaggagcacaagaggtttctgcatgatttggtttggatacatgaagaggaaaatgtgccagttgatatggatggaggacaaatcatctgcaatctgattgctgtccatgctggcctagagaggaccatagatttgaatgagcaacttagagttttaagaactagagacacaagggtgccaaaggttcaaatgcttagtgggaggcaagatgtttgggacacacccaagggtctggccggcaagcagactattattgtaagtggccaccacgggaagctccacatcgacggcctccgatttataatcgacgaaggtggtggttatgaagacaaacctattgctgcgatagtttttccttcaaagacattgatcagaagtaccgaggaagcgggaaccacatcagagaggtgatctagagttctagacatcgtcaggagcagtgaacacggaggcacagttttttctctcttgaagttactgcttgtagtcatgtactcatgtcaaacgacaataggaataacgtccaaaggctaggaattcttt

SEQ ID NO: 397 - DNA, 357 bp, Zea mays
aaaggatcctgaaacagagccggtgaacgcagcccagtcagtgagtcccccgatcccgactccggcgatctccccaaccccatggccgccgccggcgaggcccccagcacgctcctccgcttcctctacttcgtcggcgccggagtaatctgcaccaaggccatcaacacctatcgcgactacgagcacaagaaggagtccaccgccgccctcgccgccgccgaatcggcgttggctgctgccgcggcggccgagcccgctcctgcaaccgccgccgcgaagccctgattgtggacgagggcctgtcttcggcggttagggttctcggaatgttgctctccatagtaggaattcttt

SEQ ID NO: 398 - DNA, 860 bp, Zea mays
ggatccgatcttcttccagctcgctcgctcgctcgatcgatcgatcgctcggcgcgcgccagtagataaatttatatatctctacacgtcatggggcctcagcaaggccggcggtcgaacggcggcgcggcggcgcggagcaagcaggaggaggaggggggcgcgaaggtggtgcggtaccgcgagtgccagcgcaaccacgcggcgtccctgggcgggcacgccgtggacgggtgccgcgagttcatggcggcgggcgcggacggcacggcggcggcgctcgcgtgcgccgcctgcgggtgccaccgcagcttccacaggcgcgaggtggagcagcagcccgccgccgactgctgcgactgctcctccaccacctccggcgcctgaagtgaactcatatatatatctacgatgaatcgccggcggctggccacgccgcttgagtgagctgctagctagcaggtgggtggatgggtgcatgcatggggtgggaccgacgatcatgggggcagggcagggcattcatcaaacggtgtgatttggccggtgtagtcgatcgtaggtgcattatattcatcaaccattaccatatatggaccggtggttttattttatttttttttacttcctcctctgcagctctctgctctctctctttttcttctttctctcctctccatttgttcttggatatggttttcagtgaagaattctgtacgttgtgcgcgcgatgcatgtgacataatcgtccgtatatatgtatacatactcctatatatatatggtgcttgtacgtgcctgtgctgctaggctgctagctgtgtgtgtgcgtgtgtataaagtccagcggtaggcctttt

SEQ ID NO: 399 - DNA, 1165 bp, Zea mays
aaaggatccgatcagaccatttgtaccgacccccgagaggcgaccaggcagtccggaagcgcgtccgtccgttggtgctgctggtgccttgtggtcgagcgatgtcgaacgccgccgacgtggaggcgggcgcccaggcgagggcggcgccggcgacgacggggatcaagccgcccccggggcggtacaacaacatgaccagcaacgggccgtacacgccaccgtcgccgttctactacgaccccgcggcggcgcacgggcggcaccactggtcgtggctggtgccgctggtggtcatcgccaacgtgctcatgttcgtgctggtcatgttctacaacaactgcccgcgcagcggcggggactgcgtcggccgcggcttcctcaggcgcttctcctttcagccgctcaaggagaaccccctcctcggccccacggcagccacgctgcagagatacggagccctcgactggtacaaggtcgtgcacgggaaccaggcctggcggctggagtcgtgcacctggctgcacgccggcctcatccacctgctcgccaacatgatcagcctcatcttcatcggcgtccgcctggagcagcagtttggattctggaaggtgggcctggtgtacctcgtctctggcttcggagggagcgtgctctccgtcttcttcatcaggaagggcgtctccgtgggcgcctccggcgcgctcttcggcctcctgggagcgatgctgtcggagctcatcaccaactggtccatctacaccaacagatttgcagccatgctgaacctgatcatcatcgccgccatcaacctggcgctcgggatactcccgcacgttgacaacttcgcgcacatcggcgggttcgccacaggcttcctcctcggcttcgtgctgctgatccagccccagttcgggtggctggagcagcccttcggtgccaagaccaagtccaagtacaaggcatatcagatcatcctcctgcttgctgccctcgtcttgctggctgcagggttcgctgttggattggtaatggtgttcagaggagagaacggcaacgatcactgtagctggtgccactacctgacctgcgtgccgacgtcaagctggaagtgtgacaattgaactgatcagagattagtgacgggttagcatgcgaattcttt

SEQ ID NO: 400 - DNA, 342 bp, Zea mays
aaaggatccgttagctctggctctcctgctatagatatgagatgcaagaggcggccaaggctcggcatggggtggcttcgctccgtgctctccccgctcaggaagctctggtgccgcgtcaacgcggtgcagcgcaagaagagagggatctacatcctgtacgacgacgtcaagtcgtgccaatgcgaggacgtgcacgtgctgtgggcgatcctcgttgagtcccacggcctgccgacgccgacgccgacgccgcctctgctgagcctgaagcgatgaggggcggcgggtgctccgccgctgcaccccctgaataagcgaacggtccattaggaattcttt

SEQ ID NO: 401 - DNA, 703 bp, Zea mays
aaaggatcctaacgcaatcgctcgctcgctcgctcgatatttagccgtggagaggggccgagggagggagcctgctccgctctgcagcacgaacatgatgaagccatcgtgtgtactgcttgtttccagccttcttgtagccactcttgcagctgcttcttcgtcctctcctccgtattccgtcggcaagcacccagggtggctgctggttctaggtcgcaaaggcagagaactcggccagtcgtcagggtaccattaccagcatcagagcaagcagcccgagctgcagggagtggctatggaggtaaagaaacccgaggaggaggcgacggcgaggcggacggctgatcagagcggggacgccgaggcagggctgatctacagcgcagactacagcagcgtggccatgcatgctgcctctccgccgacggcgaagcccaagcacaggcaccccaccagaccataggaagctgtccttatgtagccaatcgtatgctgcccgtttcgtgtgtttgttatcgctggattgtacgagcagaagcacccctgccgtctctgtaaaatataggccctcctgatgtgctgcttctttccttctgtagctcttgctctctgtccctgccattgctgatgagtgctatggcgttatgttgatccaaacacacaaaatgggatggcaacacaattgtacgtcgaattcttt

SEQ ID NO: 402 - DNA, 1134 bp, Zea mays
cagcccatggcagggacggacgtcgcaggctccgcacgcggctccgatgccgcgctcggcaagacgggcgaaccacccgccgcggcgcgctctggcgcagccaagaaggtgactctcgctctgctagcctccttctcggcgctgctgtacagccagattcagccgccgccgtctaagatccccggcacgccgggcgggcctccggtcacggcgcccagaacaaggctcaaggacggccggcacttggcgtacctggaatccggcgtcccaaaggagaaggccaagtacaagatcatattcgttcacggcttcgactgctgtagatacgacgtgctgaatgtctcccaggggctgttggaagagctgggaatttacctgctgtcctttgaccggcccgggtacgccgagagcgacgcccacccggcccggacagagaagagcgtcgcccttgacatcgcggagctggcggacaatctccagctcggccccaagttccatctcatcggcttctccatgggcggcgagatcatgtggagctgcctcaagtacatcccgcacaggctcgccggcgtggcgattcttgccccggtgggcaactactggtggtccggcttcccgccggacgtgttcaaggaggcgtggcgcgtgcagtttccgcaagaccagcgcgcggtctgggtcgctcaccacctgccgtggctgacgcactggtggaacacccagaagctgttccgcggatccagcgtcaaggacggcgaccctgccatgctatccaaggaggacaggcttgtagctgacaagttcgagaagcgaacctatgagaagcaggtcagacagcagggagagcacgactcgctccaccgcgacatgatggtcggtttcgggaagtgggactggagcccgctggagatggagaacccgttcgccggcggccaagacgaggtgaaggtgtacctgtggcacggcgtcgaggacctctacgtgccggttcaactgtcgcggtacatcagcgagaggctcccatgggtcatctaccatgagctcccgacggccggccacctcttcccggtcgccgacggcatgcccgacgctatcgtcaggtcgcttctgctcggagatgagtgatgagaattc

SEQ ID NO: 403 - DNA, 1270 bp, Zea mays
aaaggatcccttctagaacccaccaccttccatccttccttcctttcctctctctctctctctcctcgcgcccacggtgcccgccagccagatccgcgcgttcaccggcgccatggccgccgagcatgccaccgccgcggtgggtgagccgcctcccgccacgtcgcagccggcggagggcgtgacggcggcggcgggccagaggtccgtgcccacgccgttcctcagcaagacgtaccagctggtggacgacccggcggtggacgacatcatctcgtggaacgacgacgggtctgccttcatcgtgtggcgcccggcggagttcgcgcgcgatctgttgcccaagtacttcaagcacaacaacttctccagcttcgtgcgccagctcaacacctacgggttcaggaagatcgtgccggacaggtgggagttcgcgaacgactgcttccgccgaggggagaagcggctgctctgcgacatacaccgccggaaggtgtcgccggccacgggggcggtcacggtggccgccgccgccgctgcggccatcccgatggcgctgcccgtgggctctccggtgtactccggcgaggagcaggtgctgtcaagctcgtccccggagcccccgtcgctgcagcagcacccgccggcgccgtccgggtcgggctccggcggggtggtctcgggcgacgtgggcgaggagaacgagcggttgcggcgggagaacgcgcggctggcgcgcgagctcggacagatgaagaagctctgcaacaacatcctcctcctcatgtccaagtacgccgccactcagcagccggacgccgccaaggaggcggccgccgggaactgcaccggcgagtcgtcggatgccgccgcggcgcctccgctcccttcgatcctggagctcctaccctcgtgccgcgccgaccccgcgcccgctgcagccggaacggatcacgaggatgacgaaaaggcgggcgctaggctgttcggcgtctccatcgggcggaaacgaatgcgggacgagagcgaccaccacgccggcgtctgcgcagcggaggtgaaagccgagccggtggacgcgcgtcccgaccagcagcggcagcgcaacgccacggagccgcagtcgtggcccatttaccggcccaggcctgtgtaccacccgctccgggcctgcaacggctcgggcagcgctgggagcgaccacgacgggtccaacgactcgaggtgacgggagcaatcgtcgatctgccctcagtaaattgaattcttt

SEQ ID NO: 404 - DNA, 1800 bp, Zea mays
tagcacgccagatcaccagcgatccgcacgtcgcagcagagcaaagatatcgcggggagcaagagtagtcaacgcacgaatggtgggcacggtgtcgctagcggcgggctacggctccgatggcgtgtaccgctcgccgcgcctggtggctgccatcgcctccgacccgggcctctccgtcacggacctcgtccttcgccgcgccgcggcgtgcccctccgcacccgcgctcgtggacgccgcgacgggccgcgccctcaccttcggggccctccgatccgcggtgctcgtcgcggccgccgcgctctcctcccgcgcgggcgtccgccgcggcgacgccgtgctgctcctcgcgcccaactgcgtgctctacccggtctgctttctcgccgtcaccgcgctcggcgccgtcgcgaccacggctaacccgctctacaccccgcgggagatcgccaagcaggccgccgacgcccgcgccaggctcgtcgtcaccgtctccgatctcctgcccaagatctccggtctccgcctccctatcgtcctcctcgacggcgacggcgcccccgtgccttcgggctgccccagcagtaacgtcactctctactcggacctcgtcgccggggtgcaggaggcggagtaccgccacacgccgatcgggcagggcgacacagcggcgctgttctactcgtcgggcacgactggggagagcaagggcgtcgtgctcacgcaccgcaacttcatcgcggcagcgacgatggtgacgtcggaccaggacgagctgggggaaggccacaacgtgttcctctgcttcctgcccatgttccacatcttcggcatgtccgtgatcaccctcggccagctgcagcgcggcaacgccgtcgtcgtgatggcccggttcgacgtcgacgccgtgctggccgccatcgagcggcaccgcgtcacgtacctcttctgcgccccgccggcgatgatcgcgctcgccaagcacagcaggggcggcaggtacgacctcagctcgctcagatgcatcggctctggcgccgcgccgctcggcaaggacgtcatggtggctatggctgacaggttccccggtgtcgacattatccagggttatggtatgactgaaacctgcgggataatatccctggagtacgtacagaagggttgtgcccgtcagtttggttcgactggagcacttgtcacaggagttgaagcaaagatcgttaatgcaaagacaatgaagcatcttcctccgagccaactaggagaaatctgtgttcgaggaccgaacataatggaaggctatttcaacaatgtgcaagcgactgagtctacaatcaagaatggatggttgcataccggtgatcttggatacttcgatgaaagaggccagcttcatgttgtcgatagacttaaagaactgattaagtacaaaggcttccagattgctcctgctgagcttgaaggactgcttttgtctcatccagaaatccttgatgccgctgttatcccgtatcctgatgctgaagcaggggaagttcctatcgcctacgttgtactatcaccgaagagttcactggccgaagctgatgtccagaaatttatcgagaaacaggtcgcgcactacaagaggctgaggaaggtaacgttcgtgggcagcgtaccgaaatctgctgcggggaagattttgaggagagagctcatcgcccaagtcagactgtccaagctgtagcagatttaatctcgatttcactgcagcccttgtcgtctgggttctgctggacacagaagtgcagaatc

SEQ ID NO: 405 - DNA, 404 bp, Zea mays
gcgggatgaggccggcgtcggacgcgcaccagtcgcggctgctctacgagctctgcgcgctcctgctgaccgtcctccgggcgtcgcctgacgacggggcggtggcgcggccgctgctgccgcgacatgtgacgcccgccggggtggcgtccatgctgctgggggcgtccatggcgctgatgctctgcggctcggtcaccttcatgctcggcttcttcctcatgccctgggttgtcgggctcggtttcctcttcctcttcgtcggcttcatcaccaacctctccgggatctggagggacatcatcctctggccctccgtcgcgtgctccgcatcggactcacccaaggaggcaccctccccatggcatatgttttccaagccttcatccatgtcgacgtgatga

SEQ ID NO: 406 - DNA, 1564 bp, Zea mays
gcctatatatgcagcgtgatgggggcatgtccctccggcctgggccgttactagcttagctcatatacgtacgtacgcaggctgcaagtgatcgagaggagcaatataatggctggttcttccatggacactgaagctgcaggcaaggagctcaagcagggcagcggcggcggcggcggctacaccatgccggctactgctcatgcggtggacacagactcgtggcagcaggtggggctgctcctggtgatcggcttcaactgcgcctacgtgctcagcttctccaacctcatgatggtgcccctgggctgggcgtggggcgtcgcctgcctgctgctcgtcggcgccgccgcgtggtacgccaactggctcctcgccggcctccacttcgtcgacggccagaggttcatccgctacagggacctcatgggcttcatattcgggaggaacatgtactacatcacctggttcctgcagttcgcaactctacttctgtgcaacatgggcttcattttgctaggagcaagagcgctcaaggcaatcaacacggagtttacccacaccccagccaggctgcagtggttcatcacggccacgggaatcgtctacttcgccttcgcctacttcgtgccgacgatttctgccatgaggaactggctcgccacgtcggcggcgctgacgttagcttacgacgtcgctctgctggctatcttgatcagagatgggaaatcgaacaagcagaaggactatgacgtccatgccggatcccaagccgagaaggtgttcaacgcgttgggcgccgtcgctgccatcctcgtctgcaacacgtccgggctgctcccggagatacagtcgacggtgcgggagccggcggtgcgcggcatgaggcgggcgctgctgctgcagtacaccgccggcgccgcggggtactacggcatcagcgtggcggggtactgggcgtacgggtcagcggtgtcggagtacctccccaacgagctcggcggcccgaggtgggccgccgtcctcatcaacgccaccgccttcctgcagagcattgtgtcccaacacctgtttacggtgccgatccacgaggcgatggacacgcggctgcagcggctggacgaaggcatgttctcccgctacaacctcacgcgccgcgtctgcgcgcgggggctcgtcttcggcttcaacgtcttcgtcaccgcgctgttcccgttcatgggggatttcgtcaacctcgtcggctccttagcgctcgtcccgctcaccttcacgttccccagcatggccgtcctcaagatcaaaggcaagagctgtgggagatgtaacagactttggcattggggcatcatagttctgtcctcggctctctgcgttgctaccaccgccgccgccgttcgtttgatcttcaacaatgctaggatctaccacttcttcgccgacatgtagcgagcgagtagtagtgggattgacatgtgtatcgtcaccatgaggtgatagtatggccacttcgttctcaattttttgtttgcttcaagagtggaagggtacggtggtcacttag

SEQ ID NO: 407 - DNA, 4518 bp, Zea mays
cggattcttcctgctgagtcctaggaactcacgcgcacgagcgtggtcaggagggagaggcttacgcggacgcggcggcgctggttttgatgaggaaagctggagcaaaagagggatcaattggatccaagggtgcgattgatgtgaatagtttatctgtttccacagaaatagcaggaaggccatctgatttaatgatcaaatcttgtacttgcactggaaggttatcatcttcttcagctcataatcttacagacacatatatttcaatgacctgcaaaagctgtactggtgaatcaacagaagacagaggtgggccatcgtgtagcggcaagcttaacaatatgggtttggagctcccaaggcctatagatcttgaggttaaatggatgactgtaaaaaaaaggcaaagggacaccaggagagcaagggcttcctttggcgaagacacaagcagggatggaattggatctttctgtttatctggctgtgctacaaatcaagagatggcgcaagacgctccagtctctgaatctgagaagtttggagtatccattcttggtagacgctttagtgatcccatggaaaatgttcctataaaaaagagaagatttcatatggatttttctccatcacctccattcactccattgctagtggatccatatgaaaagataccgggaagctcttctaaagctgtcagatcatatgagaaacattataagcttaagacgcaacaaattgagtataaggtgggaaacaaaggtcgttttggtgacgatgatttttctggtattgatatactagcttctgctgcctgtgaaagtgagatgagtggtggaatattagatggggagtgctcaacgttagctcacctcccagaagaaaggaaactggagaatactactggtagcagcaaattgagtctattacataacatggaggatacgttaaatattcctggtacttcacattgcatatatgatatgcctcttgggtcttctagatctgctccagatatgaagtccttatttgttgccacaccaactatcttagaaaatcttggtgaatcggcatctgctcccaaggttaattgttcattatattctgcactgaacaatgcaaacgaaatagagattgtttctgatgctaagtctacaagtgttgcaattgcaaacagttcagacaatccagaaaaaactataggatgtttacaggatacagttgtgcaaaccaaccatgccaatgcgactaatgccaagtctacaagtgttgcaattgcaaacagttcagacaatccagaaaaaactataggatgttcacaggatacagttgtgcaaaccaaccatgccaatgcgactcgtgattctaggctgcactgggatcttaatgttgccatggaggcatggggcactgattgcggtgctgttgaggatcctttagttgctactgtaagtgatcatgataatgccagaaatgacatgaacaaaccagggacatctcatcattttgagtcaagagatggtagtgtagttgatcactctgttgacactcatatggatgatgcactgaaacacgtgtctgctaatacaaaggatacatgtgattctcctgctgacagtccgtctcacccttcgcgcaacttgcagctattggaatctggatatgtagggagtgatgcccttgctgaaacaatggatttgcctgaccagaagaatagcaggttcgcttcagctatggattcacatattagatctgatccagaaccagctcttatcatggagcattttgcttcagcttcacatgtggagaaaatcaatggttcgcatcccgaacctgttcaatgtgatggtttgtctaatatgtcttctgtgaatgtccatattggaagtaattcactccaaacaagtgaattggacaccacattaaagcctttggctagcatattagtttctgaggaaagcaaaaaccttccaacagtaggcacttcccataaaaaggttactgactttggctggagtgataataagcttgaagaagcttctgaacaaagcatatctgaatctaagaaccaggagcttttggatgttgattcagaaactagtaagaagggtgaacatgacactggtatattttatgccaacgaaagaacaaaatatgcagaaaatctcattcatccagaggacaaccatggatcttctaattgtgatatggctcatgtacatgaagaaaatggtgctgttgcaatgattaattctaaagactctttaattacttgtgccaacagtagcactgtagagacatattacatttcagatgcagctcctcaggttcctgttcccagttcagaatgccacaaactggaatgttttactgatgcgggcagcactgtggattcaaaatctgcagcgcacagctaccagaatggttgcgaaaatgagcttgggaaggtcatatcaaatgttcgttcagatcaatgctatgaaactgacacatcacatattagcaaaaatctagctggggttgaaaaagtttatgtcgaggaggacgattctcaatatgaggatggggaacttagagaatctggtgattgttattgggtggatgatggttatgaagatgttaaacatgccaactggcattatcaggtatcagattacaagaatgaagaagctactcctggcctcacgtctctccatactgattctgttgcaaataatgtggttattcctgttgctaatgacaatggaccacaatctagaaaggaggacattgctgtttcacctgtgtcatctaagtgttcatggttaacaaactgcttagatggtggatctatagctgatggaaagtctcaaagtattcatttgagaggtgatactaacatgtatgggtcaaacccaagccgtgtagcagttagatctgctacaacagtaagccagtctgaaaggtgcaacgatgccctaggtgatatgttaaatatcagaatgaagaacacaggttgggatatgatgcctgaagatcaaaagcactctcaacatgatgcaagggatgtgactgattcgtctaatcggtgtgttttgagctcagatgcggctagagacgatgattcactgcaaaaaaagggactatcgaatagagatcttcaaggagtggaacggcaaaaatcatttgacagaccccagaggaatgaattgagcagatctgacgatggttatggctcaggctcaaaatctggaagggcaatggactctcatggatcgcatgacatgtatggcacatcccgtcatgttcagacaagcgctcgggtggagtgggtggaaagttcaaaacgtcctcgttctactcggcacaaatcacctgaatattataattatggcacatcaggtccaaggaatgctgcagaagctgctgtggcaaagatgcagagcagtggctttgttgttgcacgtgatggcactttagtaagagctgttgatgctgcaaatgctggtcagatgcccagaaggatgcgaaatcctttaagtagctcatgccacctgatttctggatggggttccccagttgacagggatgaagcctgtgggatgtccagaggccccgtgcatgctaggaaagcatctccagagcgtcactttggtgcaaatagtaaccggtccagtcgatatggttctgaaatggagaaaaatcatactactgatgcaaatttgagttctgtccattgctcgctgtccagtagacaacgaggcaccccgacatctagagcatcacttaacctttcccgtgctcacagcagatctccttctgggtccaggtctcgatccccacatgattgggcacctaggaacagaggcaagatcatggcaaatggaggttcaactttatggaagcatagtagatctccacctaatcacatgactaaaggtgaaattggtagaatggcttcacctcggagacaacctggatatgatgatcgagctatgtgttacagtccactatcaagaaacaacacttactccaagaatgcttcgacatgggttgatggaaggaatggttcagcagtggatatttctgatgatcataataaaaggtattcaaggagaagctcacctctgagaattacctcacggaatgacagatttgatgtcatggactcccaaggacgaccaaggtctggagaattctaccgtccgacacaaggaagacttctttatggttacgatagggaaaataagcatggcagaaatggtgaagatggaagggaatgcactgatagatatgcgaataattctgtcaagcgatatgaccggagtggtgcagtaaagcaatttagaaatgatactggtgataaatttcggactcgtatttctgctcccagatcgccagatctccaaaggggggtgagtcctcggagatttgacagaagctttgagaggtagctgactagctggctgtgaatttgccttatagaactaaaatggaaaataaagacctgtctggatgattgagccaggaaatgtt

SEQ ID NO: 408 - DNA, 887 bp, Zea mays
acaagaagccgggagagatgccgctggccacaactgctccgacgccggcgccgccctgtcctccgccgagtccagcagcggcaccagtccggacgcagctcctctcctccgtcgcgaagctcgcgctcacggccgcgctcgtgtgcggctctggcggtcccgctgccgtcgtcgtcgttccggccgccgctcaggccgtcccgttcgtccgtcctcctcctcctcccctgcaaggaaggcccttcgcctcctccactccttacgcgcagtcccagaagctgcagcttggcctcgacaagctcggaaagatcaggccatgcccgtccaccaacccggggtgcgtgtccaccaacccgctgggatcctccggctccttcgcctcgccactgctcatcccggaatcatccgcaggggagaagaccgtcgcctcgctgcggcaagccatcgagaagacgcagcgtaatgtggagtttaaggtcgacgaagacactccatatggacactacatcgaggcggagatggacggcggcgtcggccgggacgtgatggagttcctggtgaagaaagacgccggcgtggtggcgtaccggtgcatggccaccaaggtcaccttcgtctaccccttcaccaccgctgtcggcgactccaagggccagaagcagaggatcgcggccatctcgcaggagctcggatggtacgccccggacatccagtcctccatggactccgtcgacgacgtcaattacgttccgtgaagaattaagaccgtattacgaatcgtcacttcatcgatacgatcgggagcagagctaggggcggatctggttgattttgatgccgatggttcttacgatatgaggcgtgtccgtcttcagctctttatatag

SEQ ID NO: 409 - DNA, 1327 bp, Zea mays
tctgtaaaccacagtccacagccaccaagatcgccgcgctctctccaacatctcctgaccaaagcgaatccagcatcaacggggtccaggaggcagcatggctgacgaccagcagccaccggcgcaacggtactggttcccgtactggaccgcgcctgctcctcggccggtcgcccgcccgcagctgtcgaggcgggaaactcgcccggcaccgtcacctcctgcaacagcgtcgccgtcgcggcggccgtcgcatccgcaacaggcggcgacgccggcatccagaggcgctggcggtggtgtccctgatccacctgcccagccgcagcccacgcggctgtccagcaggccatcgccgtcgccttcccgcgctcagccactgtcgcccattagagagcccaacgcttcaccggcaccggttgccaaagagcacaagcagccttctcctcttcatcataccgagcatggtgttcctaagcaaaaagacatcaccgttccgcaagagaaaaccatccatgaaccgcttgtagcatccaagacacaaacaaagaccccagagaaagaaaaagacaaggaaaagggaaaggagaaggagaaggaaggcagccagctgcacaaggaaaaagataaggagaagaaagacaaggagaaggaaaaggaaaaagataaagagaaggaggatcataaagataagaaagacaaggatcacaaagagaagaaagaaaagaataaagagaaggaaggcagccagctacacaaggagctcaaggcgggtgtcgccgacatggtgcacacgctcagctcttcggcaccgtcatccgggggcggccacgagcgtgctggctctgcggcggcaggaacaacaatcatcacgctggccggcgagaacaagggcacgtccatgaaggtagacagcagcgccgtagcctacggcacggcggacgcggcgggcagcaaggagcgccgcggccacaagctcgacggcagcgtcatcgtgagcgggaaggagcaagctggggccggcaaagggctgacagctttcgtcaacagcaacgtgcaggtcatcaacaactcgctgctgctgcagagctcctgccacggcggcgacctgggggtgcacctcaagctgtccaccaaggccaagaagaaggacggcaaggaagccgggggcaatagtggctctgctgctgcgccaaaaaaatgatcaaccttcatccatatcgctggcgcgctgcatgcatggctatcgagcaatgactaataattatttgttaagtatcaatcaaaacagagagttggacggacctggttagcgtcgtcgattatt

SEQ ID NO: 410 - DNA, 1945 bp, Zea mays
aaagaattccagccgtggcgagatggacctgatgctgccggtgacggtgaaggaggagtggccgccggaagaggaggaggaggaggacgtggacgcggacgcggacgctccgcggccgatggaggggctgcacgaggtcgggccaccgccgttcctgaccaagacgttcgacctggtggccgacccggccaccgacgaggtcatctcctggggccgcgccggcaacagtttcgtggtctgggatccccacgtgttcgccgccgtgctgctccccaggttctttaagcacaacaacttctccagctttgtccgccagctgaacacctatgtgagtgccccaagtactctgcttgctcagttgctgtcgtgtgattttttgtttctggttggctttgtgctcgcgcgctctggttttgcagttcatctcgcctcttgcattgtggagtacagtagcatgagctatcagtcgacaagtctgtctctattattattacttaccgaaagaacaagtctgtatatatatataagcattttgtgtgattcacaatgacttggagctgatacaatcgttgaacgcgtattgcttttctttggcggcctagcaaatacaatggcaaaatgggcaaatgttttgaatggttcagaagcagaacgacaatgggggagattgcagaaccagcatctccatgacaagatgttaaattcctctgacatgctctttgttcgccttgttactgtgtagctagatggaccaggacaagggatgaacgaagctactacagcctacgagaaagaaacaaactgcttgtttgtcctaaagataaagaagactcactcctttgatcaccactcaccaccaagcaatatactgctagtgtataccactgcccgtgcctgtaaattcggtcgcaaaacttatgtgaaacctaaagttttacataaatttgccatcttgtcttgttaattggctcagcgtcggcatttgtcgattcttagtgtgtgatggcttctggaaatgcagcttactgaacgctgcgcgtgttcatcgctttgcgacgtgcagggcttcagaaagatcgacccggacagctgggagttcgcgaacgaaggattcctgaggggccagaggcatcttctccggctgatcaagcgtcgaaggccggcgccaccgccgccgtacctccaggcgtcgcagtcgcaggggtcgtgcctggaggtgggccggttcggagggctggacggagagatggagcggctgaggcgtgacaagagcatcctgctggcggaggtggtgaagctgcggcaggagcagcagagcacgcgggcgggcatgcgggccatggaggagcggctgcggcacgcggagcacaagcaggtgcagatgatggggttcctggcgcgggcggtgcagagcccagacttgttccagctgctggcacagcagcaagcccggcggagggagctggagggcgcggcgctgctctccgccgcctcccggaagcggaggcggcccatcggcgccgcgccggccaacggcggcttgcagcagcaggaggaggagcagcagcagggcgacgacgacgaccccaccgccacgcgggcgctgttcgcggagctggacgagcgagggaccacgtcggagctggagaacctggcgctcaacatccaggggctcggcaagcgcaggcaggacgggagcgagaagcagggtggccgcgcgcggagccagcagcagggcgggttcgagacggcggagctcaccgacgacttttgggaggagctgctgaacgaagggatgaagggcggtgcggaggctgagacgctgccgccggagaggagacgaccggcttggtacgtcgacgcgctggcgcagaagttgagctccatgagcaataacaccacggcgaagtagagatgatcgcgttaattaatcctaaggcctttt

SEQ ID NO: 411 - DNA, 915 bp, Zea mays
ctgactggtgcgcgtttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaagtggtggttcagcgcattgatgagaggttatctgcccttggcaattgcatagcctgcaatgaccatgttgcacttacgcaccctgaccttgacaaggagactgaggagttcattgcagatgtgcttggggtcgaggtgtttaggcagactattgctggaaatatccttgtggggagttactgcgccttctctaacaggggtggtttggttcatccccatacatccgttgaagaccttgacgagctctccacgctcctccaagttcctcttgtcgcaggaactgtgaacagaggaagcgaggtcattgctgcaggcatgacagtgaacgactggactgccttttgtggctcggacacgacagccaccgagctctcagtcatcgaaagcgtcttcaagctgagagaagggcagcccactgcgattgtggaggacatgaggaagtctctgatagacagttacgtgtaactggggggccagcagatgtgggtcagagtttgcctttgctaaaagatgtattgcaagctatagtcgaattatcagtagcacaacataaccctctgatatgttcgtggtttatccgtggtttctga

SEQ ID NO: 412 - DNA, 1691 bp, Zea mays
ccccgatggacccagcggggccgcgcgtggccacggatcccgccggatcgggtgccgcaccgccgcgcgaggaattggacaggagaggaggggcgtgcagcggcgccgcagcggcggaggggagcgcgtcgcggctcgcgggcgctggactgggagatccgagggctggaattctggaatcttcaggtcaagcagaagcatatttgcacacatgtaccatggatgtttctcagttgactgctgaaggtgtcacccagtgtggagctagagtgtctttattaccccagattggggcacttcagtcagaaactccttgtctgaccttgggccgtgattccagtgcagaatcaatggagaagctgcatggcagtgagtccttgccatgctgtaaagagaacatcggaacagttcgccaacctaagcctgatccagaacatgttgacaataggatgagtgttgcacgtcttgggttggaccttaacacagtagatagttctgatgcagcagagcttaaccctttcttcccttacaagaagctgggacagtcgaaagtcagtgatccatcggaatgtggcagcactactgctgctacagcagaaagtgagtcacacaggaaatggagagaaatgaagcggaatggctttctttcttcgtctcatggaaatgcagtggtgcctaggccacgtggtcggcccccgaaaaggaaaaaagatgatgaattcaaaaggagcacttccacacagcatggccaggctaacaagtctgttaaggttgctgctcctagtggcctattatctgggctaaaccctggaatcattaaccatgtgagaaatagcaagcaagtttactccataataaaggctatggtacactctgagaggcttgagaatgagaagcagcctgcatttactagtcaaacaggtggaagagggagagaagccagtgagggaattcaggatgagaaatatggtgctggtttcaagaagtgccatatgttgatgaaagacaataatgcggtgtttcaccaagcactgcctaccacatcacagttccttgcacaggacggcgataggctcaaactgcaactctcatcagcagtcactatgtcttcagacagggcctgcagtacatcagctgatgatccagcaactaatcatgattacatgactgtactgtcagtaaaagcggcctctgttgcttctcagtggttggaattactgcatcaggacatcaggggacgccttgctgctttaaagcgcagcaggaagagagtcagaaatgctcttcatacagaattgccttacctaatctcgacagaattttcatctaaccaagagaatgaatcatccattgcaaatacgtgtgatgctggatgtactgaaaaagcagtttcagaagcgcatgtggcacgatggaggtctctgtttgtccagatggaccgagcacttcaggaggaagggaaacagctggagaaccggttgaagcaagtgcaagaaatgcaatcgaattgtgataaaggcctcaaacacatgagctgtgaagctcctctgctaggacctattcctgagctatggaagctgaagaacccagatatttctgagagtgagtgggcggtgcaagctgccgccgcatcaatctactcgacctgcaacatggccatgagaacggagaacgtgccttgcttctgatga

SEQ ID NO: 413 - DNA, 2002 bp, Zea mays
cttcctcgcattcgcatcgcctcgattccacccacccacctccgtccgcctccgagcaccaccaaaccctagatctcgcaccggcggcagccatgtccaagccatggggcagcgtcggcgccggcgcgtgggcgctggacgccgagcgcgccgaggaggaagagcgcgagcaggccctgacctttccggcgcccgagccgcccttgcccgcgggcggcgccgccagcttcccgagcctccgggaggccgccgccgcgggcggcgggggcaagtcgaagaagaagaacaagggtaccacgctgtcgctgtccgagttcaccacctacggcgcggccgcggcccagcggcgcgcggcgcccgtcgagcccaagggcctgacccacgatgagatgctgctgttgcccacggggccccgggagcgctcggccgaggagctggaccgctcccgcgggttccgctcctacggcggcggcagcggcttcggcggccccgggggagagcgccgcggcggcttcgacgacgaggaccgccgcgggccgggaagaagctcggatcttgatatgccctcccgcgctgacgaggctgacgactggggcgccaccaagaagtttaccccggctcccacggactctggccgccgcgataggttcggcggcccttcccctctcggccgtgctgatgatattgacgactggtcgcgcggcaagaagccgctcccggcgcgctaccccagcctcgggtctggaggtggcttccgcgactctccagccttccgcgactcaccagctgcttctgattctgaccgttgggtccgtggcgccacccctttgccacacaacggcgagggggcgggggagaggccgcgcatcgtcctgaatcctcctaaacgtgatccgttagttgcctctaccccacctgctgaggtggcccgcaaccgaccaagcccgttcggggctgcaaggccccgggaggatgtgctggcggagaagggggtggactggaggaagtttgagaatgagattgagcacaagaccagccgtcctaccagttcgcactccagcaggccgaatagcgctcattcctcccgccctgggagccctgggtcgcaggtttcggcagttgggagtgaaggagcaccgagggcacggccaaaggttaacccatttggtgaggccaagccaagagaagtggtgctgcaggagaaagggaaggattggaggaagattgatattgagcttgagcatcgtgctataaataggccagagtctgatgaagaaagaaatttgaaagaagaaatcaaccttctgaaggtggatcttaaggaaatcgagagaaacatgagtaatggttctgaccagacatcggtagatgcaaaaggtttgtctgagaagatatctcagttggaaagccagcttgagcagctttcaagggagttggatgacaagattcgatttgggcaaagaccacgttcgggtgcgggcagggttacagcacttgcaccaactagtttaggggaggaaccacatgctacagtggtggacagaccgcgctctcgtggtggtatggagccaccaccaaggcaggaagaaagatggggatttcaaggaagcagagaaaggggctcttttggtgcaagcagaaattcggacaggccaatggcaaggcagagatggtgaaactgggacaacaagcatctcttagggatatttccggttcccagtccctttttttgttctgaaaagatgggcaaaataagtcgttacttatttgtttgtcgtgtttgcttggtctagaagattgttgaggatggagataactccacatgaagttattggtttgtcaactctatgccgtaggatgttttgcatttccctttttgccatctaccatgtcaaaacgatatcttagcaacctccgatactaactgttatgcttactggattccagttcagcatatgtcactagttgattatttgtgcactgcttagtggaaaccttggat

SEQ ID NO: 414 - DNA, 3550 bp, Zea mays
gaggaggcgagatcttggagtggggcgaagcggagatgtcgttgccgtcgaacaaccggaggacgtgctcccggagcagctctgcgcggtccaagcacagcgcgcgggtggtggcacagacgcccgtggacgcgcagctgcacgccgagttcgagggctcccagcgccacttcgactactcctcgtcggtgggcgccgccaaccgcccgtcggcaagcaccagcaccgtctccacctacctccagaacatgcagcggggccgctacatccagcccttcggctgcctgctcgccgtccacccggacaccttcgcgctgctcgcctacagcgagaacgcgcccgagatgctcgacctcacgccacacgccgtccccaccatcgaccagcgggatgcgctcggcatcggcgtcgatgtgcgcacgctcttccgctcgcagagctccgtcgcgcttcacaaggccgccgccttcggggaggtcaacctactcaaccccatcctcgtgcacgccaggacgtcggggaagcccttctacgccatattgcaccggatcgacgtcggccttgtcatcgaccttgagccggtcaatccagccgacgtgccagtcaccgccgcgggcgcgctcaagtcgtacaagctcgctgccaaggccatctccaggctgcagtcgctgcccagcgggaacctgtcgttgctgtgcgatgtgcttgtccgtgaggtgagcgaactcacgggctatgaccgggtcatggcctacaagttctatgaggatgagcatggcgaggtcatttccgaatgcaggaggtccgatctggagccgtatcttggactgcactacccagccaccgacatcccgcaggcgtccaggttcctgtttatgaagaacaaagtgcggatgatatgtgattgctgtgccactccagtgaaggtcattcaggatgatagcctagcacaacctctcagcctctgtggttccacactcagggcttcccatggttgccatgcacagtacatggcaaacatgggttctgttgcatcacttgcgatgtcagtcactataaacgaggatgaggaggaagatggggataccgggagtgaccaacaaccgaaaggcaggaagctgtgggggcttgtcgtctgccatcatacaagcccgaggttcgtccctttcccactaaggtatgcttgtgagtttctcttgcaagtatttggcatacagctcaacaaggaggtggaattggctgctcaggcaaaggagaggcacatcctcagaacgcaaacccttctttgtgatatgctcctgcgggatgctcctgttgggatatttactcggtcacctaatgtgatggatctagtaaagtgcgatggagctgcattgtattaccagaaccagcttttggtgcttggatcaacaccctctgagtcagagataaagagcattgcaacatggctgcaggataatcatgatggttcaactgggctgagtactgacagcttagtggaagcgggttatcctggtgctgttgcacttcgtgaagttgtgtgtggcatggcggccataaagatctcttccaaagattttatcttctggttccgatcgcacacaacaaaggagatcaagtggggtggggctaagcatgaaccggttgatgcagatgacgatggcaggaggatgcatccacgatcttcattcaaggccttcttggaggtggttaaatggagaagtgttccctgggaagatgttgaaatggatgctatccattctttgcagttaatattacgtggctccctgccagatgaagatgccaacagaaacaatgtaaggtccattgtaaaagctccatctgatgatatgaagaagatacaggggctacttgaactgagaacagttacaaatgagatggtccgcttaattgagacagcaactgcccctgtcttggctgtcgacattgccggtaacataaatggatggaacaataaagctgcagaactaacaggtttacctgtaatggaagccatagggaggcccctgatagatcttgttgttactgattctatagaagtggttaagcagattttggactcagctttacaaggaattgaagagcaaaatatggaaatcaagcttaaaacattccatgaacatgaatgcaatggtccagtaatcttgaaggttaactcctgctgtagtcgggacctttcagagaaagtcattggagtttgctttgtagcacaagatttgaccaggcagaagatgattatggataagtatactaggatacaaggagactatgttgccatagtaaagaaccccagtgagctcatccctcccatatttatgatcaatgatcttggttcctgcttagagtggaataaagctatgcagaagattaccggtataaagagggaagatgcgataaacaaattgttaattggggaggtcttcacgcttcatgattatggctgtagggtgaaagatcatgcaactctaacgaaacttagcatactgatgaatgcagtgatttctggtcaggatcctgagaagctcttttttggtttcttcgacacagatgggaagtatattgaatccttgctgacagtgaacaagaggacagatgctgagggtaagatcactggtgctctttgctttctgcatgtggccagtccagagcttcagcatgctctccaggtgcagaaaatgtcggaacaagctgcgacaaacagctttaaggaattaacttacattcgtcaagaattaaggaacccactcaatggtatgcaatttacttgtaacttattgaagccttctgaattgacagaggaacagcggcaacttctttcatctaatgttctctgtcaggaccagctgaaaaagattttacatgacactgatcttgaaagcattgaacagtgctatatggagatgaacacagtagagttcaaccttgagcaagctctgaatacggttctgatgcaaggcattcctttgggcaaggaaaaacagatttcaattgaacgtaattggcctgtggaagtatcatgcatgtacctttatggggacaatttaaggcttcagcagatcctagcagactatctagcatgcgcccttcaattcacacaaactgctgaaggacctatcgtgctccaggtcatgtctaagaaggaaaacattggatctggcatgcagattgctcatttggagttcaggattgtccatccagctccaggcgttccagaggccctgatacaggagatgttccagcacaacccaggggtgtccagggagggcctcggcctgtacataagccagaagctggtgaaaacgatgagcggcacggtacagtaccttcgagaagccgacacctcgtcgttcatcatcctgatggagttcccggtcgcccagctcagcagcaagcggtccaagccttcgacgagtaaattctgaccctcatgctgctggaactgcagcgagtgttctgccgtgtcgaagtctcggttgtagctagccaagtggctgctactgaaacatcggttggtcggttctggtatcta

SEQ ID NO: 415 - DNA, 1794 bp, Zea mays
gagtcctccacctccctctccgccgcgtcgctcgcgcttgacgcgcgccgagagccgaatcggagccacgaggcagccgccccgggcggatcgatcctagggccagggcatgggcggaggggacgccgacgccggcggcgagcccgcggacgcgcaggccacgctccacatccggtgcaccaacgcctccaagttcaccgtgcgggccgacctgggcgccaccgtcggggcgtttaaggcgatcgtcgccgacagctgcgacgtgccggcgccgcagcagcggctgatctacaagggccggatcttgaaggacgagcaaaccctagccagctacggtgtggagacagaccatacaatccacatggtacgtggtgctgtgccatcaccaacatctactgcacctgcagccaaccaagaacctaccactgctgctcctgccagttccccggcaacaggattgggtggtttgttgcaaagtctgggtactacaggcgctgctgctaacagtgaggggttgggtttgtttggatctgccccccctggattagaccaaatgcaacaacagctagctgaaaatccgaacttgatgagggaaatgatgaatatgccactcatgcagaatttgatgaacaatcctgaactcatacgcagtataataatgaacaatcctcaaatgcgcgagctcattgatcgcaatccggatcttgctcatgtcctcaatgatccaagcattatgcgccagacttttgaagcagttcggaatcctgaactcatgagggagatgatgcggaacacagacagagccatgagcaacattgagtcttctccagaaggattcaacatgctccgtcgcatgtatgaaactgtccaagagccttttctgaatgcaacaacaatgggtagcgagggtgatcgaaattcgaatccattttctgctcttctaggaaatcaggggtctaaccaagcaagagactcagctgcaaatggaacaactagagcttcagaccccacatcagggtctccagctccaaatactaatccacttccgaatccttggggctcaaatgctggctctgcccaaggagcagcaaggtcctctcctgctagcaatgttaggagtactacagcaagtggcctaggagggttgggttcagcagatttgggaagtacacatggtgccagtggtggtggctctgatgctaccttgttgactcaagttttgcaaaacccaactatgatgcagatgatgcagaacattatgtctaatcctcagtccatgaatcagctgcttaatatgaatccaaatgtacgtaacatgatggaatccaatactcaaatgagagaaatgattcagaatccagaatttcttcgccagttaacatctcctgaaacattgcagcaattaatttcattccagcagtctttgatgtcacaacttggccaacaacaagctggacaggagcggacacaatcaggctctggtgcaggcaatgtcaacctcaacaccttgatgaacatgttcagcgggcttggtgctggtggtggcctaggtgttccaaatgctcctaatgtgccgccagaagaactgtacgccacacaattagctcagctccaagaaatgggtttctttgacacacaagagaacatccgagccttggccgctaccgctggaaatgttcatgctgcagtggagcgacttcttggaaatatgggctaatagaatatgatgatcataactgtactcagatattgtgatttttagttggcattgtgagatcatgtctggctgaattc

SEQ ID NO: 416 - DNA, 3554 bp, Zea mays
cggtttctgcttgtccttgtccgccggcggcgctgcggggaggagaggagccgggtacaacctgaggcggtccgcacggtcgatggtggcggcgcaggtgacgccggcgccactgctgcggcgccacggctcggcgcccccgtggctgtcgtcgtcgccgcccttcctccttcgccgccgcgcctcgtcgcccttctccctgcaccgccgcgcctcgccgccactggcgatttccgggtgcaggaggcaggactattcccattgctcagatatggctgttcgaggaagcagtgctttcaagctacgtttctatcccaacttagaagtacaaaatattgcacaagaatgggttaaagagagccggaggctgttctatctaagaactgccaacaatgtcacaaataacatctataagggaaacactcctctatggactggaatggtacaaaatgaactctctgaagattgcaggggtttgaactacacttatttgaataatttgagggaacgcgtatcgtccaaatcaattgtaaatagacatggtaataaccgagaactgatcgggcatagtacgataaatcagcatgtgaaatcagtgccagctccagtacgtgttgttaatgatagtgtcaagtgtttcagcatgcctagagcctctaaggtggagattccttggcctgcctattcaccagcggaggatcctttgcttgataaatctaatacagaggtaattttggagcttgaggataaagttcatgatggtgatgacaaaaagaaaaaaactgttgtaaaaaaggtggtttcacctttcccaactaaagcggccttctctgaggaatctttgaaagcacgggaggcacttgctagcatctacgacaaagttttggtagttgacgatatcgagtcagctaggaacattgttaaactgctcactacaaagtacaagagctttattcatgcatgtgacacagaggtagcaaatattaatgccaaagaagagacaccagttggtcatggagaagtaatatgctttagcatctattcagcaaattctgatgtacaggcagctgattttggaaatggcaaaacttgcatttgggttgatgttctagatggtggaaggggtgtcctgatggagtttgctcctttctttgaagattcatcgatcaagaaggtttggcataactatagttttgatagccatgtcattgagaattatggaatcaaaattgctgggtttcatgctgatacaatgcatcttgcacgcctttgggattcatcaaggaaaattgatggtggatattcacttgaaggacttacaaatgaccgtagagtcatggatactgttccagaggatttacctaagcctggaaagacatcaatgaaaaccatctttggcaggaaaaatattagaaaagatggatctgaagggaaagttgtatctgttgagccagtcaagaagttacaaagggaagacagagagttatggatttgttattcttctctagattccatgagcacattgagactttatgacagcttaaaaagcaagcttacaacaaggagatggatcttggatggttgtcctaggggcaccatgtatgatttctatgaacagtactggcgtccttttggtgccctacttgtgaaaatggagacagagggaatgcttgttgaccgtggttacctttcagagatagaaaaggctgctattgctgaacggaaacttgctgcagataagtttcggaaatgggcatctaaatattgtcctgatgccaagtacatgaatgtgaatagcgatattcaaattcgccaacttctctttggtggcattgaaaatagacacaaatctggtgaaacttggccacatagtaaaacttttaaagtgctaaatgaagaaagtgttgctacagagggtaagaagacgtcaaagtatcgtacaatcaaactttgcagtattgttgaagatctgaaaatcgatatgttcaccccgagtggctggccaacagtcagcggggatgcattgagaagtttggctggtaaaatacctacagaatatatttacacaatagatgatattcaagatgatgatgaatataccagtggttcagaaaacccagatgggaattcctcttatggaacagcatatgaagcatttggtggaggaaagaatggaaaagaagcatgccatgcaattgcagctttatgtgaaatatgttctattgattctttgatatccaatttcattcttccgttgcagggagatcacatatcatgtgcagaggggcgcattcactgttcattgaatatcaatactgagacagggcgcttgtcagcaagaacaccaaatctacagaaccaacctgcccttgagaaggataggtataggattcgccaagcttttgttgcagccccgggaaattctcttatcgttgcagattatggtcagctggagcttaggattttagctcaccttactaattgtaaaagcatgctgcatgctttcaaggcgggtggtgatttccattctaggacagccatgaatatgtatcagcatatccgtgatgctgtccaagaaaagaaagttcttcttgagtggcaccctcaacctggtcaagagaaacctccagtgccgctattgaaggatgcttttggcgctgagaggaggaaagctaaaatgcttaatttttccattgcttatggaaagacagctgttgggctatcccgggactggaaggtttctgttaaagaggcaagagatacactgaagctctggtacagggatagaaaagaagtgttagcttggcaaaaaagtcagaagaagcttgcaagcgagaagggtgaagtctacactttgcttgggcggtcgcgccattttccttacctgactcagtatggtcctggccaacgaggtcatattgagcgtgctgctataaatgcaccagtgcagggaagtgcagcagatgttgctatgtgtgccatgcttgagatcgaaaggaatgtccgccttaaggagcttggttggaggctcttattgcaggtgcatgatgaagtgatactggaagggccttcagagtctgctgaggtggccaaggctatagtggtggagtgtatgtccaaacctttctacggaaccaacatcttgaacgtcgacctggctgtcgacgccaagtgtgcaaagagctggtatgctgccaaatagactgaggagacgctgtcacctgccacaaggttgatgacaccagtgcaatcgagaccccactgttcggataaaaaatggtggacccgtcgtcatgcagactgcggttccaggaccttgagtttgttgtggtggtaacccaggccctgacaagacaacacgcccatttcttggctgcagcagaacagcggaagacacggaggactctgctgccagcacctggagttgcgcggtgccaaagcataccagacagaattcgagatggcttggatctcgagtgaactagcgcggtgccaaagcatgctgttttgttcataatctcacttgttcagcgtgctggtgcgttaggttagtt

SEQ ID NO: 417 - DNA, 975 bp, Zea mays
gactccaacccaatccaatggctctccgcccctgttgtctcacctcacgcgctctctgccctgatctgccgccaggcgccagaacgacgcgctgctccgcaccgcgtcgggtagaatggtagatggaccatggacgatatcgcttgggagcggggaaggaacgcagacgactcttcccgtgccgtgctgacgccaccacgcggccccggtctcctctcgccctcctctccgtctggatctggtcctatcccctccgccgccgtccttgccctcccggcctcagccacgagccagagcgccgggctcctggcctcgtctcgcctcgccggcgacatggacggaggcggggagacgctgctggtgcggaggagcaagggcaagaagagaccgcagccggcggcgcccgcggaggagggctccggcagcgggggcaggttccgcgcgatctggcgggactaccacgacctgctgcaggagactgaggcaaagaggaagaggctggcaagcacgaagcggagaagcctcgccttgcttgctgaagtcaagttcttgagaaggaagtaccagtcctttctgaggggtggctcgcagcagacacattacaggttgaagaagcaggctcggtacatgccttctccattgggaagcaataaggctgcagcgttagccgatcatggtgcaggggaccgaagtgccttctaccagcaaaaactcaaaacttgacttgaatcaagactctgttctggcaagtgatggagttcatgaatcgacataaactgtacaagagaagtgtttttatggcaattaaaagggttttcttgtctgcagaatgatgtggagaatgattgcctggggcaacagtgccatccataagtcgaaaagtttgatcaggtctcaaattatcagtttgtaggataaagggccctcagttgatttggccaagaaataagctgcttctctgatagctggctttgc

SEQ ID NO: 418 - DNA, 2084 bp, Oryza sativa
ctctcctcgcctagggtttcacgccctccgatcccgcggcggcggcgaagcttccactcgcctcggcggcggcgccggccagggacatgggaatggaggttgttggaactgaggctgcaccagcagaggttaaagtaactgatggagaagtgaaccttttccaagagaatgaaagtaaagcaactgccaaggaacgtgaggaggcggttctttttggttcagataacagcacagctacagcaaatggagccgcaaatggcgctgatttggcacccccaaaggatgcagaggaggactggcctgaagctaggaaaacacatagcttcttctttgtcaagatccgcttacttgaggaccctaagctgaaaatgaagattgatcaggcagaaaaggacttccagaagaagattcaagctcgttctcaaatttttgaggctataaaagccaagaagaatgagcgcttcggtattatctcagagctgaagccattggctgctgagaacaagcaatacaacgaagccgtaagtgagaagttgaaggcgatagaacctcttagaaaccgtttaggaaagttccgcgatgaaaacaatgctatccgggcacagggtgcaggcatatgttcttcaattgaagagcttgagaaatcgatcaagagattgaacgaccgcatatctcatgagagcatacccttggatgaggagaagcggttgatcaaacagattagagagcttgaaaagaccagaccgaaagtcatctccacttctgctaaccgagctcaaatccaagatacagtggtcgaaagagacgccatacaggatcaggttaaaatcatcggggagggcattgatggagtaaagaaggagcgacaagcagtcaggtctaaaattaaggtcctggaggatgagctaaaggctattgacatggagatgggttcgcttcaagaagatttaactgctgccaatgccagaaaggacaaggcacatgaatcattggtccaattgagacatgcacgagatgcctataacgcatcattccatcaaaaccgccaacttctgagcaaagctagggatcttgcttctaggagtgagcttgcacaagtgcaagagctctacaagacacaggttgacaaattcgtggcagaatggtgcaacagcaaggccttcagagaggactacgagaaaaggatcctctcctccctcaacagtcgacagcttagccgagatggccggatgaggaatcctgatgagaaacccatatttattgaaacagaggcagcagcaccacctgtagaacaagagcctatccaatcaaaaatgcctgcaaaacaagccaaggaagcgcctgctccccaagcagaggtttctcccaaagatgagtcccgcgtgaaagcaatagctaagccatctaaggctaaatcctctctggatgctgatgatgactatgaggccgagtctcccaaggagaagccaaagcctaaagaggttgatgtagctaagttgaaagagatcaagagacaggaggagatggagaagaatagacttgccctggaaaggaagaagaagctggccgagaagcaagcagcgaaggcagcagcccgtgcacaaaaggaggcagagaagaaactcaagagagaggagatgagggccaggaggagggctggggcagctgacaccgaggcgtccactgaatcggacaacaggtctgatggagcagcggaggcacaagcagaggacgactccgctcctgcttctgctccggtgatgagagaacagagggagagtgtccggtacagcagaaacgtcgtgaccaagagcaaggccccgctgccgaaggcgatcctgaggaggaagaaagcccagtcgtactggtcctgggctggccctgctgctgcagtggccgccgcgctcgtcgccctgcttgccgtgctaggctactaccagtactacctcccagcgagcgctagcaactgatggaaggaaagcaggcagcccccccttgagaattgcttacttgaacaattttgcaggtgagaaacagagtgcgtggtctgctgagacgtggactgaaagactggagatgaattc

SEQ ID NO: 419 - DNA, 1241 bp, Oryza sativa
taaaaatgttgaggcagagctctagtaggaatcacaggtccaaaggtctgaagctgaagaaggctcttcagataaccctcttggttctggtttctgtttggttgatataccaagtcaagcattcatacgagaagaaggcatatcatgaaaatgagcccaatgacctgcataaagatgatgatcaaaaccagggtgagatcagattaggcaggaaggacctgcctactaagctggaggctgactcatcaacgctggatgaacggattgaggatgaagagaatgaagagatggagcaagaaatgaagcacgatgagaatgatgaagaccccattgatgaacctgacctggacaaagatgatgatcttcctgagcctggcgagcactctgctgataaggatgaaagatctgaggatgtgggtgtgtttgaggatgaagagcggaaggagcggtctcaggaggatcaagagaagacctttcatggggataatgtatcaagtgctgtcagtcatgaccctccgtcagcagagcaagatgagctgcttcgtcatgcccaagacaaaatattatatgtggatgatgcttcgacagcagtgcctcatgacaaccaggaagctgaacgcagggaggaggaagctcgcaaagctagggagatgactttcagaggcgatgatgtgtcaagttccgtagatcatgatgcccaagtgacaaaacctctcccagaggagcaattgaagagcatggatagcatatttgaaggcaccacaaatttatcaaacggaataacatttcgaggcccaggagtgaatgaatcaactgctgctagggagcttggggctattccagctgatgcatcttcccatccaaacactagcactgtttcagaaagcaatactgatacagctccggtaaatttggatggcaaccatactggatcagatcaagctaattcgacctctttgaaaggtcaacaagagcagcaagcaaattcaacggatgtgttgaacaaccagataaaactcttcattgacctcacatcagctgctgagttgaattatcgaccaaatgggaccctggcttcggcttcaactgatgctgaaaatgccacttctgtagatagaggccatgatggtaataccggaaccaataaggctgaggaaggagatacaggcaaagacttagatttatcgacaaaaatcatgaacaaggccattagtgaagatgaagttgttcttgaatgatga

SEQ ID NO: 420 - DNA, 272 bp, Oryza sativa
ctgcgatggcatctagaggcgccgtgttggtcgccgtggccgcggcggtggccgtgatgttcgcgtcggtggcgtcggcgcaggtggacgggggcgtgccaccggcgccggcgccggtcacgggcgcggccgcggggggcgcggcgtcggcggcgctggccgtggcgtgctctgccgtgctgtccatcctcgtcgcgggtgggatcatgcactaggcaggcgcgcgaggtggtgatggatggaattggttcgttgatgatctccgattttag

SEQ ID NO: 421 - DNA, 887 bp, Oryza sativa
tgagttgcacaggaaagtcttgggcttttgcgctcagctccaccaccttcacctgttcctcgggccatggctgctctcgtcatctcgaagcagcgcagtcaccagcagcagtcatccgatcgccggaggaagccatcgtcgcacttcgcgtcaccccagtccatgcgtggcttcaatgctgtcaactgccgagccttccactccagcgtcagcattggcatcctgccatccccgcctccacccccagcgcgcacctactcctccccggagccgaagacgcccaagtcgcagccacaccacgggaagaagcggagcagggcaatatctataagcccttcaacgtctccgccatcccggcctgagctctgggctggccccgctttctcaaactctccgcctcccagctcgctgccgatacccaagttctcactccaccagaagcgcagtgtttcactcgagttgccacctgctggccgatcagatgatgtggtggtgcctttgcatgctaagtcagcgccttcgtcgccaaccgcaggctcaggtgtcagcttctttagtgatagtgatactgctatcgcgactgagaatctgaggagaatcctccacctgaaaatcgctgatcactgaatggatgatgggcaggtccttgtacataggctatctgcaaactaaccttggtagtgtgtatagagtaaccgagaatggccatctttcacctggatggtggttctgcatagttcatcaacaggaggtacttcaggcaggcaaagcacctcaagtatgcatggcagcgtgaaactgcggtgaatgacttggtggtgagactgttggttgtctggatgagagcacagcagtttctgggtagcctttgtagcttgtggtcacct

SEQ ID NO: 422 - DNA, 515 bp, Oryza sativa
caccaccattaacgcttaaaccacccaccaccaccaccaccgagcaagcaaacaccaaaggcaggcagggcaagaggcgaccgaatccgaaggagccaatggcgaaatccctactggcggcgtccgcgctgctgctggcgctgctcctggcggtggccgggggagcggcggcggcgggggaggtgccgctcgcctgggagctcggggtcggcggcggcggcggcggcggcgaggaggacagcttcgggttctcctccgaggatgcggcggccgacggcgccgcggtggtgaggcgggtgctgcaggggcaggggtacatcagctacggcgcgctgcggcgcgacaccacgccgtgctccgtccgcggcgcctcctactacaactgccgccctggcggccaggccaacccctactcccgcggctgctccgccatcacccgctgccgcggctaacccacctccgccaccacccgctgctctgctcaaaccgggattattcaaagttcgtttgcctag

SEQ ID NO: 423 - DNA, 638 bp, Oryza sativa
gaaggatgatgatgatgatgatgtcagcagcatcatcccccagctgcctcctcctcctcccccgcccgaccaaaccaacaccaccgctgctcccctccacctcctcctgccgccggccgcctcgctgccggatcagatcccttaggccggagaacccggcgccgcccgccgcaggagtagcgagagcggtcgcctcctcgtcgtctcccatggagatggaggcggcgcagacccaggcgtgcggtggcggggaggggcagcaggaggccatgaggctgctgttcgtggagatgggcgtcgggtacgaccagcacgggcaggacgtcaccgccgccgccgtgcgcgcctgcagggacgccatcacctccaactccatcccggccttccgcagcggatccattcctggggtgaacacggagcagatgaagctgcagatcaagctcggggtgccgaggccaacgcagcacttgctggacgttgagagagtcaaggccgtcttcccctatggtaaaattatcagctttgaggttgtggacggtgggatgatctgttcaagtggcgtatgcctagaagcaatgggagataaaaacgatgattgctatatagtgaacgcagcagtttatgttggttactaataa

SEQ ID NO: 424 - DNA, 1295 bp, Oryza sativa
acgccatggacgccgcctcccgccccgccgtcgtcatcgacaacggcaccgggtacacgaagatggggttcgccgggaacgtggagccctgcttcatcacccccaccgtcgtcgccgtcaacgacaccttcgccggccagaccagggccaacaccaccaaggggaactggatggcgcagcacagcgccggcgtcatggccgatctcgacttcttcatcggggaggacgccctggcccgctcccgctccagcaacacctacaacctcagctatccaattcacaatggccaggttgagaattgggacaccatggagaggttctggcagcagtgcattttcaattacctgcggtgtgatccggaggatcactattttctgctcaccgagagccccctgactcctcccgagacccgcgagtacaccggggagatcatgtttgagactttcaatgtgcctggtctgtacatagcgtgccagccggttcttgccctcgcagcaggatacaccaccacaaagtgtgaaatgacaggtgttgtagtcgatgtgggtgatggggctacccacattgttcctgttgctgatggttatgttataggaagcagcatcagatcaattccaattacaggcaaggatgttacccagtttattcagcaactcttaaaggaaagaggtgagcacattccaccagaagaatcttttgatgtggcaaggagagtgaaagaaatgtactgctatacatgttcagatattgtgaaggaatttaataagcatgacagagagcccaataagtacataaagcactggagtggcatcaaaccaaaaactggtgccaaatacacctgcgacattggatatgaacgcttcctagggcctgagattttcttccaccctgagatttacaacaatgacttcaccactcctttgcatgtagttattgacaagtgcatccaatcatccccaattgacacaagaagggctctttataagaatattgtcttgtccgggggatcaactatgtttaaggatttccacaggaggctgcagcgggacctaaaaaagatagtggatgcacgagtccttgcatctaatgctcgacttggtggagatgcaaaggcccaacctatagaagtaaatgtagttagccatcctattcaaagatatgctgtctggtttggtggttctgtgcttgcctctaccgctgaattctacgaggcttgccacacaaaagcagagtatgaagagtatggcgcaagcatctgccggacgaatcctgttttcaaagggatgtactaataa

SEQ ID NO: 425 - DNA, 482 bp, Sorghum bicolor
cgatacgatgaggccactccttgtttcgcttgctctgattttcgtggttgccggtgtggcgcatggcgccggggagtgcgggagagcctccgctgacagggtggcgctgaggctggcgccatgcgtctcggccgccgacgacccgcagtcgacgccgaccagcagctgctgctccgccgtgcacgccatcgggcagagccccagctgcctgtgcgccgtcatgctgtccggcaccgccagggctgctgggatcaagccggaggtcgccattaccatccccaagcgctgcaacatggccgatcgccccgtcggctacaagtgcggagattacacgctgccctgactacatcgtcagcaagccggccgtgtgcagtgttatgacgggctgatgaacgagccacgcaaggcgttgtgttggaaaagtcgaatccgctagaataaataagtacgtggacgatgggctcttgctgtgtcactactgg

SEQ ID NO: 426 - DNA, 467 bp, Sorghum bicolor
ccaccatgtcgctgatcgccggtgaggacttccagcatatcctgcgtctgctgaacactaacgtggatgggaagcagaagatcatgttcgccatgacctccatcaagggtgtggggcgccgcttctccaacatcgtctgcaagaaggccgacatcgacatgaacaagagggccggcgagctgactcctgaagagctggagcggctgatgacggtcgtggccaaccccaggcagttcaaggtgccggactggttcctcaacaggaagaaggactacaaggacggcaggttctcgcaggtcgtctccaacgccctcgacatgaagctcagggacgaccttgagaggctcaagaagatcaggaaccaccgtggtctgcgtcactactggggcctccgtgtccgtggccagcacactaagactactggcaggcgtggaaagactgttggtgtctccaagaagcgataataa

SEQ ID NO: 427 - DNA, 629 bp, Sorghum bicolor
cggcgatgggatcgagcgaggcggagaagccgctgcgtcggatcgcggcgtcgttcgaggagctcgccgccgtcgccaagcagcagcccccggcgtccatggacgcgggggccttttcgcgcgcctgctccaacgtctccgtcctcttcggctgcctcggcatcgccttcaagttcgcggagatggactacgtcgccaaggttgatgatttggtggaggcgtccaagtcaattttgacattgccttctatggttgagctagacattcagactgacactgtcaggaaaccagggagccatacaaggaatctgcttagagtaaagcgtgggattgatatggttaaagtcctctttgagcaaattcttgtcacagagggcaactccttaagggatgcggcatcagtagcttatgctcaggtttttgctcctcaccatggatgggcaataaggaaagcagttgctgctggaatgtacgcccttccctcaaagtcccagctgttgaagaaattgaatgaagatgaggaatcagcgaaggttcaaatgcagaactttgtcaggtcatcagctccagtaatctgctatgttgatgaccttttcacctcaaggaatttgggcatagattggtgatga

SEQ ID NO: 428 - DNA, 705 bp, Sorghum bicolor
tacaactcctccatcccaattcccattcccaggcgcagcgcgacaagaagaagatcaagcagcagcagcaaaagctagcggcaaggcaaggagatcaagagaaatggcaacggcggcggggagcatccagcagggccacggcgcccggttcgcggcggcgtgcgacgtgctgagccggtacgtgaaagcggcagcggcagcgacgacgccgacgccggtggagcagccgcggccgttgccaggcacggtagtaggggtggtactccctctgatgcccggcgcggacctgtccacgcaagcagaggagctggccgaggcggcggatcaagcggggccggcgccgagagcgcagcagctgatgaccatctcgtacggcgggcgtgtggtggtgctcgacgacgtccccgcggacacggccgccgagctgctccggctcgcggccgccgccgccgcgccgcgggtgctgcgagcgccggatgatctgcccatggcgaggaaggcgtcgctccggcacttcatggagaagcgcaagggccgggtcgccaagcgcgcttcgccctacagccgtccgggtgatgctggagccgccgcggcgtcgtcgttcccggaccatctcgccctctcgctctgagacaatactagtacatacagtacagtttgtactacccctatactctagtaggtgtttgttgattgtacaggccg

SEQ ID NO: 429 - DNA, 1320 bp, Sorghum bicolor
gagaagaagaagcccatccaccaggcaccagcacaagggacaaacgatccggagcggagttcagtccagtctcggtctaggtccatgggtgcgggaaaaggaggagacggcggcggcggtggcggcgaggcggccgcggcggcgcctgaggccgcgcagcccgtcgtgctgaagatggaactgcattgcgccggctgcgcgcacaaggtcaagaaggctattaagcgcgttcctggtgtcgagtcgatcgtgacggacgtcgcggcgaacagggtcgtcgtggcggggacggcagacgccggcgcgctcaaggcgcggctcgaggcgaagaccagcaagcccgtggaagtcgtctccgccggcggcgcccccaagaaacctgctgccgccgcggagcacgccggcgccggcgagaagaagggggacaagggcgtgagccccaaggaggaggagaaagagaaggacaaggagaagaagcaacaggcctcggaggagaagaaacccaagcaggagacggtgctgctcaagatccgcctccactgcgacggctgcgccgaccgcatcaggcgacgcatctacaagatcaaaggcgtgaaggatgtggtgctggacggcaatgccaaggacgaggtgaaggtcatgggcaccatggacatccccaacatgctctcctacctcaaggagaagctcaaccgcgacgtggaggccgtggcgccgcccgccaagaaagacggcggcggcgagggcaaggacgacaagaaggacagcggcagcggcggcgacaagaacaagggcgcagccgaggccggcggcgacgacaagaaagacaaaggcaaagggatcgacgtgtcggcgggcccgtccacggcggccgccgcggcgttcatggctgcgccggcgggggcgagcacgtaccacgtggcgccgccgtacgggtacgtggcgtaccagcaggcgccaccgccgccccccgccagctactacccctacccgtactacggcaatggcgacggcatgggccacgccaacccctcctactaccaccaacaaccgcagcagcagcccgacgtcaaccagcagccgcagatggcgtacccgccgtacccgtaccgtttcgacatggcgccgccgccgcagctcttcagcgacgagaaccccaacgcctgctccgtcatgtaacggaaacggccgccggcggcggcggcggcggcggtgggtgtccctagcttggttgcgtcagcgagctcactgatccgtcgtcagctttaacttagccgtccggccgggaaaaaactcgacctgtacatatcgtcgtcgatg

SEQ ID NO: 430 - DNA, 1672 bp, Sorghum bicolor
gctcactcacattggcaccgccgcagccgtagctgccatggcagagcacggcaacagggctctgacgcggtggcggcggtgggcgctggccaacctgggctccttctccgccctcttcaccaacaccaacttcggctcggcgtggctcatcctagcgccgttggtgtcgctggtggccacctacgcgccgcggcggctgttcctgacctacttcaacctcttcctccggcgccgcgcccggcgcctgctcaacgccgtggacccctacgtcaccatcgacatctcggagcccggcggcgaggtccggtactcccggtacggccccgtctccgacagcgacaccacctacgaggaagtgaaggcgtacctgagcggcgccgcgtgctcgcaggacgcgcgcgagctccgcgccgagggcgccagggagggcaacggcctcgtcgtcagtatgcgcgacggccaggacgtcgccgacgagttccgcggcgtctcgctctggtggtcctccgtcatcgtcagggacgtccagggccagcgcaagggcgacaggcggttccagcggctcaccttccacctccgccaccgcggggtcgtcgtcgacgagtacctgccccatgtccgccgccagggccgcgagatcctcttcagcaaccgacgccggcggctctacaccaacagcaagtcacgagatccctacagctacgagtacaagtcatggagctacatcgacttcgaccacccgacgacgttcgacacgctggccatggacggggccaagaagagggacatcatggacgacctcgacacgttccggaacagcagggacttctaccggcgcgccggcaagccgtggaagcgcgggtacctgctgtacgggccgccgggcacgggcaagtccaccatggtggccgccatggccaactacctcgactacgacatctacgacgtggagctgacggtggtgcacaccaacagcgacctccgcaggctgctcatcgagacgaccagcaagtccatcatcgtcatcgaggacatcgactgcaccctcgacgtcaccggcgaccgcgccagcagcagcagcggcaggccgcggcggcgagaggcggccgacgagaagccgccgccgccgcgcgacacggtgactctgtccggcctgctcaacttcatcgacgggctgtggtcggcgtgcggcggcgagcggatcgtcgtgttcaccaccaaccacgtcgagaagctggacccggcgctgatccggcgcggcaggatggacatgcacatcgagatgtcctactgcaggttcgaggcgttccagacgctcgccaagaactacctcgacgtcgacgaccacgagctgttcggcgccgtcgaggagttcctgcgggaggaggacctcacgccggccgacgtcgccgagtgcctcatggtggccaggcgcgcgggctccggcgagccttctcgctgccttgagatatcgatcgatgagctgaagaagagagcggcggagaaggccaaggccgaggcagaggccaaggcgagagcagaggcggaggccatggcgtgggcggcggaggcagaggccagggcggcggtggaagcaaatgcggcggccgcgagggaccgtgggaattcgcggtaattttgaacacgacgaacagaaagtttggatgtgtgg

SEQ ID NO: 431 - DNA, 537 bp, Sorghum bicolor
agtccaaggatccaatccaacagatatgagcgtggagatcgtggacgggcggacggtgcagagcttcgtggaggacgagcgcgcgttcaactcgtgcgtggacgcgcggttcgcggcgctggacgcggaccgcgacggccgcctctcgtacgccgagatgaccggggagctcatggcgctgcgcgtgcgggaggcgcacttcggcgccgacgcgccggcgcccgacgccgagctcgccggcctgtacggggcgctcttcgcgcgcttcgaccgcgacggggacggcgccgtggacaggcacgagttccgcgccgagatgagggaggtcatgctcgccgtcgccagcggactcggcgtgctccccgtgcagatggtcgtcgaggaaggcagcctcctcaagagggccgtcgacagggagctgctggccaccactacccctactaccactaccctggcagcttgaccagctccatcggctccatgtcacctggccactatcatgacagggagctggccactatcacactgctagccgaa

SEQ ID NO: 432 - DNA, 1421 bp, Sorghum bicolor
ctcaccttcctcaaaccctagccctcgcgccccctcccctgcttgcccccgtcgccgccagcatgggctcagatgcggacatggaggattacgggttcgagtactcggacgaagaacctgaggagcaggacgtcgacatcgagaaccagtattacaactccaaaggtttggtcgagacagacccggagggtgcacttgctggttttgatcaagtagtcactatggagcctgaaaaagctgaatggggatttaaagctcttaaacaaactgtcaagctttactataagctggggaaatacaaagaaatgatggatgcctatagagagatgttaacatacataaaatctgctgtcacccggaactacagcgagaaatgtataaacaacataatggattttgtttctggatcagctagtcagaacttttctcttctgcaagagttctaccagacaacactgaaagcgcttgaagaagcaaaaaatgagagattatggttcaagaccaacttgaagctttgcaaaatttggtttgatatgggtgaatacggtcgcatgagcaagatattgaaggagctgcataaatcttgccaaagggaagatggttctgatgatcaaaagaaaggcacacagcttttggaagtctatgctattgaaatccaaatgtacactgaaacaaagaataataaaaagcttaaggaattgtatcaaagggctctttccatcaaatcagcgatacctcatccaagaatcatgggtataattcgtgagtgtggtgggaagatgcatatggctgagaggcagtgggctgaggctgcgactgatttctttgaagctttcaagaactacgatgaagcaggcaatcctcggagaatccaatgcctaaaatatcttgtccttgccaatatgttgatggaatctgaagtgaatccttttgatggacaagaggccaagccgtacaagaatgatcctgaaatccttgcaatgacaaacttgattgcagcgtaccagaagaatgacatcatggaatttgaaaagatcctgaagagtaatagaagaacaataatggatgatccttttatccgtaactatattgaggacttattgaagaacatcagaacccaagtgctgctcaagcttattaaaccatatactcgaatcaggataccattcatttcacaggaactcaatttcccagagaaggatgtcgagcagctgttggtatcgctcattctggacaaccgtatccaaggccacatagatcaggtcaacaagctactagagcgtggagaaaggtccaaggggatgaggaagtacagtgccatcgacaagtggaacacgcagctgaagtccatttaccaaacattgtccaacagagttggatgagacggatcgtggctgctgtatgctttgcacacctagtag

SEQ ID NO: 433 - DNA, 3794 bp, Sorghum bicolor
acatctcgatctcgccgtcgtctccccccggtggcatgctccgcttccgctagactagatccgatctatctatggatacccgccgtcgtctccccatcctcctcgccctcctgctcgccttcttctccgccgttgccgcctctgacgagatccacggttgcggcggcttcgtcgaggcgagctctggcttggccaaatcgaggaaggcgtcggattccaagctcgattactccgacatcacggttgagctctgtactgttgatggtttggttaaagaaagcacacagtgtgctcctaatggctactattttatcccagtttatgataagggttcattcatggtcagagttaaggggcccaagggatggtcatggaagcctgaaactgttcctgtcatcatcgatcacaatggctgcaatggaaatgcggatataaatttccaattcactgggtttatgatatccggtaaagtagtgggagctgttggtggtaagagctgctcaaaagggggaggacctgctggtgtgaaagttgagctgatgacagattctgatgagttgattgcatctgcttcaacatcatcatcaggagaatattcatttacaaacataattccagggcgttacagattacgtgcttctcatcctgattacaaaatcgagttgagaggctcaccagaggttgacttgcgatttggaaacgtcgtggcagatgatgtcttctttgtatctggatatgacatttatggcactgtggttgcacagggaaacccgatagtgggagtccacctatatttgtattcaaatgatgtaacggaggtcccttgtccacaaggtttcagtgatgcacccaaggaaggtgctctttgccatgcaatatctggtgctgatgggaagttcacgtttagatcactaccttgtggtagctatgagctgctgccatactacaagggggagaacaccgtctttgatatttcaccatcttcacttcctgtttctgttgagcacagtcatttgaccattccccaaaaattccaggttactggattttctgttggagggcgtgttattgatggttacggtgctggtgtggagagtgccaatgttatagttgatgggcagtcgagagccataacagatagtctcggatactacagacttgatcaggttacatccaagaagtatactataactgctgagaaggatcattataagttcaatcgtttggagaattttatgattttaccaaatttggccagtattgatgatatcagatcagttagatatgatgtatgtggtattgttcgaacagttactccgaattcaaaagcaatggttactttaacacatggaccagaaaatgtaaagccacagcggaagttagtgggtgaaaatggacagttttgctttgaggttcctgctggtgaatacgaattatctgcattacctgtagattccgaacgctcttctagtcttatgttttcaccaggatctattagcatcaatgtaaatagcccattgcttgatctcgaattctctcagtcacaagtcaatgttcatggcaaagtctcatgcaaagagcaatgcaaccagaacattcttgtctcgcttgttagattggctggcggtgtagagcaggaaaagaagacaactacattggagcaagataatgtcagttttgtgttcaagaaagtatttcctggaaaatatcgtgtagaggtgaagaattctttacccgagggctcagctaaggatgattggtgctgggaccaaagtaccttgaatatagatgttggtactgatgatgtgagagacattgtgtttgtacaaaaaggctactggattgagctagtttcaactcatgatactaaagcttatattcagcagccagattcttctagacttgatttgtcgataaagaaaggatctcaaaggatttgtgttgaaacttcagggcaacacgagattcatttaactaatccttgtatttcctttgggagctcgtctgttttgtttgatacagctaaatcaatgcctattcatatcagcgcaaagaagtatcttgtaaaaggtgaaatccatgtggacatgagctcccttcaggaaaacattgattccaaggatatggtcgtggatgtcttgaagagtgacgacagtttcatagaaaagatatccacttcacctgttattggaaaggataatcaaaatgactttactgcctttgagtactctatttgggctgaccttggggaggacttcatctttgtcccccatgattctagcactggaaggaacaaggtcctattttatccagcaagacagcagtattcagtgtctatgaatggatgccaagatactgttcctctaatcactgcaaaaactggtctataccttgaaggatcagtgctacctgcaacttctgatgttgacatcaagattgtagcagctggaaagagcaactatgcccatctgaacaaaggggatgtagcaacagagacaaagacagattctgaaggatcattttttgcaggtcctttgtatgatgacatagtatataaagttgaagcttcaaaggatggttaccatctcaagcaaactggtccatacaccttttcttgtcagaagcttggtcagatatcagtgcggatttatggtgaaaattcagagcttttaccttcagtattattatctttgagtggcgaggaagggtacagaaataactcaattagtagttctggtggaactttcacctttgacaacttatttcctggaagtttctatctccggccacttctaaaggaatataaattcaatccatcagcagtagctattgatcttaattctggagagtctagggaggctgaatttcgtgcaaccagagtggcttacagtgccatgggttctgtaacactattaactggccacccaaaggagggtgtttttgttgaagcaagatctgaatccacaggtttttatgaggaagctaccacagatgcttttggtaggtttcgtcttagaggacttgtgcctggatcaacttactctataagagtggttgccaaagataatcttcggtttgcagcagttgagcgtgcttcacccgaatatttgtcggttaatgttggtcgtgaagacataactggtattgattttgtggtttttgaacacccagaagtaacaatcttgagtggtcatgtggaaggagatggcattgatacgttacagccgcatctctctgttgagatcagatcagcagcagacccttctagagtagaatctgtacttcctgttcctctttcgtactattttgaagtgcgagatttgcccaagggcaagcatcttgttcagcttcgatctggccttccatcacatacacataggtttgaatcagagttagttgaagtagatctggaaaaggaaccccaaatccatgttggccccctcaaatataaaactgaagagcgtcatcaaaagcaggaactgaccccagcaccagtttttccgcttattgttggagtttctgtggttgcactggtgatcagtatgccaaggttaaatgacttgtaccagagcgctgtagggatgacttctctgggttcggggatggcaccaatcaaaaaggagccgcgcaagaacataattagaaagagagtgtaaacggcagattagcttagccttaggggtcgagaaatgagcactgacaaattgagcatgtcaagagtggaaatagctgctggtttacccctttttttccgaaaacgtgtgctgcacgtgcctcattaagaagagagttaa

SEQ ID NO: 434 - DNA, 1386 bp, Sorghum bicolor
agtcttggattgctagctccagccccaaatgatcatcatcagcggcagcaacttcccaacggattcgtgatcctcccgcgatgggtctcatctccaacgatgcgtggcacaaacggttcttcagcgttgcgccgcccgcggcgctggtcttcttcttcgtgctgatattcgtcgccggtgcaattgtcacgctcgatcataaggagagtctgtccatattgcagttgcaaccgaaaggagtgattgcagcagtggagatgaggcctccagccactagcgagctgaggtcttcagcgacgaccgagccgcgtgctgagccagcagaggaacccgacatctgtgagaataaatgtagacctccaggcagcgagcccttgccgaggggcatcgtgcaggacaagtccaacttcgagatggagtcgctgggtggcaatcctgaacggaaggagaacggcaacggcaggcagccaaaaagcctcctcgccatccccgtcggcatcaagcagaaggcgatcgtcgacaagctcgtctccaagtttccggaggccaagttcaccgtgatgctgttccactacgacggcgaggtggacgggtggcgagacctcgagtggtcgcgccgcgcgatccacgtcgccgtgcgcgaccagaccaagtggtggttcgccaagaggttcctgcacccggacctggtggcggagtacgactacgtcttcctctgggacgaggacatcgaggtggacagcttcgacccgctcaggtacctgcggatcgtgaggaaagaagggctggagatctcgcagccggcgctggaccggcggtcgcagatccaccaccggctcacggcgcgcgcccggagcggcgacgtccaccggcggtactacaagacgaacgggcacgacaggtgctacggcaacagcacgggaccgccgtgcacggggtgggtggagatgatggtgcccgtgttctcgcgcgcggcgtggcggtgcgcgtggcacatgatccagaacgacctcgtctacgcctggggcatggactacaagctcggctactgcgcgcagggcgaccggagccgcaacgtcggcgtcgtcgacagcgagtacgtgttccaccggggcatccccacgctcggcgacgacggcaaggcgacggtgtcggcgtcgtcgttggggagagaccggttagcggtgagacagcggtcctacaccgagctgcaggtgttcaacaggaggtggaagaaggccgtggcggaggacgggtgctggaccgacccttacccgaaatcggcggcgaccaccgcctgatcgttggacgggacgaggcaccgcagtgcagggaagtacagtagttggtagctgtcagattgaccttgcctagaagatggtagca

SEQ ID NO: 435 - DNA, 1096 bp, Sorghum bicolor
taacacgagcagccacagcctccgggcgcctgatctctcctcgtcgggcgggattcgggtcgacaggagatggaggccagcgtgggcgtccgtgcgccggcgcgcggccgtgcctgggccggcatcgagaagccgcacggcgcttactccgtcagagtcccgccggtaaggctcacggcggacaggctgcggctgcctccgccgcggaggctggtgctgggcgccgatccgtggaggaccgcgggtcctgccctccgtcccgcaaagctgagagtttcgtgctccgcgaaatcggcaggaacaggaaaagtccactattctactgacgaggctctcatactacagcaaaaggcccaggatgttctcccttacttggatggccgatgcgtttatcttgttggaatgatgggttcaggcaaaactacagttgggaagatattagccgaagtattaggttattcgttctttgacagtgataagctggtagagaaggctgttggtatctcatctgttgctgagatctttcagctccatagtgaagcattcttcagagataatgagagtgaggtcctgagggatctgtcatcaatgcatcggttggttgttgcaaccggaggtggtgcagtgatccgaccaatcaattggagttacatgaagaaagggctgactgtgtggttagacgttccactggatgcacttgcaagaagaattgctgctgtaggaaccgcatctcgaccactcttgcatcaggaatctggtgacccttatgcaaaggcttatgcgaaacttacatcactttttgagcaaagaatggactcgtatgctaatgctgatgccagagtttcacttgaacatattgcattaaaacaaggccataatgatgtcactatacttacacctagtgccatcgccattgaggcattgctaaagatggaaagttttcttaccgagaagaccatggtcagaaactgattgcttgtatgtgagcaaaaggatgctcacaacatatggcccttgtttgtttaattgtacatatacctttgcataaactctttctgcagtgttgttcaacatgaaagaggaccgtttgagtttg

SEQ ID NO: 436 - DNA, 345 bp, Sorghum bicolor
tgagaaggatcgcctacaaatcaagcaagcaaaggaataggggaaaggaagacaaggcagcccgtcatgtgctgctgcggcgacggcgacgagtgccggccgctgggctggctgctggggctgccgttcgcgctgctcgccgtcctcgtctccatcgtcggcgccatcatctggatcatcgggctgcccatctcgtgcatctgcccgtgctgcctctgcgtgacggtggtgctggaggcggcggtggagctcatcaaggcgccgctgcacgtcatgacctggttcacctccaagataccctgctagacaaagtactcggagtaccacgtctaggcttcattgttt

SEQ ID NO: 437 - DNA, 617 bp, Sorghum bicolor
gcctaggaagtcagcacagcgcagcagcgtcaggaaggaaggaagaagaagaagaataccaggacgatggaggtggagacgatgctggaggacgacgtgttcttcgccgagctcagcaagcggatatcgctgctcatcaccgacgacgacgagggcggcgcggacttcgccgccgccgcgaagttcatccccgcctccgccgccgcgacgcccctcccggggttcgcaacgtcgcgcggcgcccatgtgccatcgcagcagcagcagcagcaggattggggcgcgtcgttgctggcgccaccggcctacgcgttgtaccaccacggcgccagctacggcggggcggcggcggcgtggcagcagctgcagcagcagtgcggcagcaagggcaccggcgtcttcatcccgcggtccacgcccgggtccgcgcaccccaagaagaagggcaagaacaggggcgccgccgccgccgccgccaaggccgccgcgcgggcggcgcaggctgccggcgcgggcgcgccaaccaagaagcgcgcctgatttctacttgaggagagaaggggagaaaaaaaaaggagggcaaaaaaagcacaactactaactccaggatgcagtgc

SEQ ID NO: 438 - DNA, 2061 bp, Sorghum bicolor
gcttctgcttcagtgcttccggcagcaaagcgaaactagcgctgctaaacctcgggccatccccccgcgagcgcgacacacccaaaggccagcaggctccgtcccgttcccgttccgtgtcccgatcgctccgctgcgctccccacgatggcgtcgcacatcatcctgccgccggacgacgccgatgagaaccacaaccaccaggccgaggaggaggagcgggaggagctggggcgcgacgaagacgccgacgacgaggagcacgggcacgggcaccccccggcgctgccacccaaggcggcgctgccgttctcggccacgtgcgtgcggatctcccgcgactcgtacccgaacctccgcgcgctccgcaacgcctcctctgtcagcctcgccgacgccgcctacgtcaagatctccgagggcgactacgggtacgtcctcgacgacgtcccgcacttcaccgactacctccccgacatcccgacttaccctaatccactacaagatcatccagcctattcaactgtcaagcagtattttgtcaatgaagatgacactgtacctcaaaaggttgttgttcagaagaacagtcggcgtggtgttcacttccgtcgtgctgggcctcgtcagaggatttattttggcaccgatgaagtgaaggcctgcattgtaacttgtggaggcctgtgccctgggcttaacactgttatcagggaactggtgtgtggcttgtcacacatgtacaatgtcagcagcatttttggaatacagaatggatacaagggtttctattctagcaactaccttcccctgacaccaaagagcgtcaatgacatccacaaaaggggtggtacagttctaggaacatcacgaggtggccatgatacaaaaaagattgttgataacattcaagatcgtggaatcaatcaggtgtatatcatcggaggagatggaactcagaagggagcatatgagatcttcaaggaaatccggaaacgtggcctcaaagtttctgtcgctggagttccaaagacaatagataatgacattgcgatcatcgacaagtcctttggttttgatacggctgtggaagaggcccagcgcgccattgattcagctcacgtggaagcttgcagtgctgagaatggaataggtttagtaaaactgatgggtcgttatagtgggttcattgcgatgtacgctactcttgctagtcgagatgtggactgctgtttgattccagagtctccattttatctggacggagagggtggattgcttcaatatgtagaaaagaggctgaaagagaacaagcacatggttattgttgttgctgagggagcagggcaggatcttattgcgaaaagcatagccacatcagatcaacaagatgcatctggaaataagctgcttcttgatattggtctgtggctgactcacaagataaaggactacttcaaaagcaaaaagatggagatgacgattaaatacatagatcctacatacatgatccgtgctattccaagcaatgcatcagacaatgtctactgcacacttctagctcacagtgctatccatggcgcaatggcggggtatagcttcactgttggaatggtcaacggaagacatacctatatacctttctatcgggtgacatccacaaggaacaaggttaaagtcactgacaggatgtgggcaaggcttctgtcgtccaccaaccagccaagtttcctgagtcagaaggatatcgatgaagcgagtgaggcggataggctggcaaacaggccaccactgccaacgggtgccagctctcgcgtggcgaggtctttcgatcaatcttcgtcgtgttcttcaaatggagagatctagtgattgctggtgcaccacaactgtgtacagaaactactacaatggttctgagctcaggtgcctgggcagcttggcgacgcaatgagttttgctcttgttagttgttatgcatatgccttgcgtataggggccacacggatatgaccctgttagcacgtaataaagaaacgccattgatgaagctacgaattc

SEQ ID NO: 439 - DNA, 3445 bp, Sorghum bicolor
aaagatatcgtcccgacaggaatccaacggcgttgggcgacggcagccctacgcgcggcttcgcggagtgccggagtcgcgaggcggctcggctctacaccctctcgcgctcgctctcggcctcgcctcttccctcacacgactcgccgcgaggagtttcccccttcctccgcgcgcatccccgcgagagctcgctcgaaaacctagccgccaaatccatggctcgacgcggccacgacgacgacgacgagatcgaggaggaggaggacgaggaggaggcctacgacctggacgaggaggaagaggaggacgaggaagacgactacgaggaggaggcgaggcgcgggaaggcctcccgcagcggcggcgccggcggcggcaaggggggcggcggtgggcggaagcggtcgcgcgaagacaactttattgacgactcggccatcgaggacgacgacgaggaggatgacgacgacgacggcgggggccggccgaggaagaaaggcggcggcggggtgcgagggttcttcgacgaggaggctcaggtcgacgaggatgaggaagaagaggacgagggcgagggcgaggacgattttattaatgatgctggggccgaccttcctgatgaggatgttgttaggggctcaagacgtcattctattcctatgagggatgaagaagaggacattgatgagattgagagacaagtgcgggagagatacgcaagatccactcatattgagtatggtgaggaagcagcagaagtggaacagcaagctctgctgccctccgtgaaggatcctaaactatggatggtcaaatgtgcgattggacatgagagagagactgcaatttgtctgatgcaaaagtacatagataggggagaccttcagataaagtcagtcgtggcattggatcatctaaaaaattatatttatgttgaagctgaaaaggaggcccatgtcaaagaggcttgcaaaggtctacgaaacatttatgcttcagcaaaaataacattagtgccgataaaagaaatggcagatgtcctctctgttgagagcaaatctgtcgatctttcaagggattcttgggtccgaatgaaattgggcatatataaaggtgaccttgctaaggttgttgatgttgacaatgtacgtcaaagagtagatgtgaagctgatccctagaatagatctacaagctttggctagtaaactggaagggagggaggctgtaaagaagaaagcatttgtcccaccaccacgattcttcaatatcgatgaggcgagggagatgcatattcgtgtggaacggaggcgagataaagaatctggggagtactttgagtgggttgataatttgaagttcaaagatggtttcttgtacaaatcagtctccactaaatcaatccacacaaataatattcaaccgactttcgatgagcttgagaagtttaagaagcctggtgaagacatgaatggcgacatggctagcttgtccactctgtttgcaaacaggaaaaaagggcattttatgaagggtgatgctgtcattgttgttaaaggcgatttgaaaaatctggaggggtgggttgagaaagtagaggatgaaaccgttcacatcagaccaaaaatatctgatcttccgaaaacattagccttcaatgaaaaggagctttgcaaatatttcaagcctggtgaccatgtcaaggtgatctccggtgttcaagaaggtgctactggcatggttgttaaagtggaagggcatgtcttgataattttgtctgacacaactaaagaacatatccgtgtgtttgctgatcatgtcgtcgaaagctctgaaattaccacaggaatcaccagaattggtgattatgaactgcatgatcttgtccttttagacaacttgtcatttggagtaattataagggtggaagctgaagcatttcaggttctgaaaggagtgccagatagacctgaagttgtgctcgtgaaattaagagaaataaaaagcaaaattgataggcgctcatcagctaaagatcgttctaataatattatctctgcaaaggatgtcgtaagggttattgaaggagcatgcaaggggaagcaaggacctgtggaacacatacacaaggggatactgtttatctatgacaggcatcaccttgaacatgcaggctttatttgtgcaaaagcgcaatcttgccttcttgttggtggatccgctggtggccgtcgaggaaatggtatggacacagctgatgcacggcttggtgctttgagatcttcagcaagcattctgcaatctccaggaaggctgcccccaagaggacctaatatgaattatggtggaaggtttggaggcggccgtggtggtagaggacatgatgccttggtgggtaaatgtatcaaaattaaatctggcccttataagggataccgtggccgtgttaaagaggtgactggtgcactcgtacgtgtagagcttgattcattgatgaagattgtcacagttaaaagagatgatattgctgacacacctactgttgcaacaccattccgtgagcctcgttattcattgggcggtgaaacaccaatgcacccgtctcgaacaccacatcatgcttatcagactccaatgcgtgaccctggagcaacaccaatacatgacgggatgcggactcccatgcgcagtcgagcctgggctcctatgagccctccgagggataattgggaagatggaaatcctgctacttggggtagcagtccagcttaccagccaggaaccccacaagctcggccatatgaagcccccacacctggatcagggtgggcaaacactccaggagttagtttcaatgatgcccctactcccagggataactatgcaaatgccccaagtccatatgtgccttccacgcctgttggtcaaccaatgacaccaaactcggctgcatatcttccgggcacacctggtggtcaaccaatgacccctggcactgttggactggatgcaatgtccccgatactaggtggtgagggtgatggtacatggctgttgccggatgttatggtcaatgtattgaggggaggtgatgatggtcctggtgtggttagggaagtactcggggatggatcttgccgagttgcacttgggtcgtcgggcaacggtgacatggtgacagtccttccaaacgaggtcgaggtcatcaggccaaagaagagtgacaagatcaagatattgaatggtaatttccgtggatacacaggaaaactcataggtatagatggttctgacggaatagtgaggcttgacgacacatacgaagttaagatattagatatggtgattttggccaaactggcgacttgaaatggatatatatattctgtaacgtgtccatcatagaacataattgtaacaatgccctcgtttgcgaattcttt

SEQ ID NO: 440 - DNA, 2855 bp, Sorghum bicolor
cagacatggcagatgccctatttgtagttcttaggaaacttgctgattccctaggagaacgggcactagagaggattggcacagagctggttcaagcagcaccagtttcgacagattatgagcatagcatgaagcaaatcgaggccgagctattgattctgcaggcttttattgctcaggctggggcaaaggtcggtgataaggcattcgatgcctggctggaccaagtgagagatgttgcccatgaggtagaagataccattgatgagtatgcttaccttgcggttcaagccgtggatactggcagcttctttaagaggaagttccgtcagataaaaaagtttgcagcatggcagaagtttcatagccagatcagtcaagtagaagctcgaattcagaggctaggcgaaattaggaatcgatatggcatcttggcaggtgaaatagacaggagtaacaaattgaggaaacccaatcagctctttatgtcagattcttcttacttaactgatagctctgaaatagtggggtatgttgatgaaattggaagattgacacaatggttacttgaggacaaacaagagcgaactctcattgccatctttggtatgggaggtctaggaaaaactactattgcaagcagtgtgtacaagaatcagaatatcacaagaactttcaactgtcacgcatgggttactgtatctcagacttatcaagttgaagaactactaagagaaatcataaatcagctaattgatcagagagcaagcatggcaagtggtttcatgaccatgaaccacatgaggctagttgaggtaatacaaagctatttgctagacaaaaaatatttaattgtcttggatgatgtatgggataaagatgcatggttatttctaaaccatgcgtttgtcagaaacaactgtggaagcaaagtgctgataactactcggagaaaggatgtatcttgtttggcagtagatcactataggattgaacttaaaactcttcaatatgctgaatcctgggagcttttctgtaaaaaggcatttgttgcattaaaagatagccaatgtcctgaaaaccttaggttttttgcagagaaaattgttgccaggtgtcagggattgccactggctattgtaaccattggaagtactctatcatatcgtgaattcgaggagcaggggtgggaatctttctacagccaacttagctggcaattagctaacaatccagaactgaattggatttctaatgttctgaatatgagcttgaatgatctcccatgttatctgaggagctgcttcctgtactgcagtctctatcctgaagattacaaaattagaagaaacgtgatttccaagctttggattgcagaaggttttgtggaagatagagacgatggaacaacaatggaggaggttgccaattattaccttgtggagctcactcagcgttgtcttcttcgagtcacagaaagtaatgcatgtggaaggcctagaacatttgttatgcatgatcttgtgcgagaagcaacctctgttattgctaaaagggagaagtttggtattgcatatggcgatgctagtacaacccaagttccccatgaagtccgccacttatgcatacaaagaggtgcccagaccttgaattttatagctagttcacggctccgctcatttattttgtttgacactgaagtaccatgctcttggatagatgatattttatcacgtttcagactactgagggtcctatgtctaagatttgcaaatattgaacaagtgcctggcgtggtcaccgaattgtataacttgcgctatattgatttttcatacacaaaagtgaagataataccagcatcatttggtaaacttgttaacctacaagttttggatctcagattcacatacgtggaggagttgccactggaaataactatgttaactaatttacgatatttacaggtgttcgtagtgcatgatcttctacaaagatcattggattgctttagtgctacaaaaattcctggtaacatttgccttctgaagaatctgcaagctttacatactgtttcagccagtaaagatttagtttcacaactgggtaacttgatgctgttgagaagtttggctataatgaaagtgcgtcaaagctacattgcagagttatggagctccctgacgaagatgcctaactttagcaggttgcttattttcgcaattgatatggatgagattcttgacttgaaaatgctcaagcccttacccaatctgaagtttctctggcttgctggaaagttggatgcaggtgttcttccatcaatgttttccaagtttgagaaattagcatggttaaaggtggactggtctggtcttaagaaggatcctattatctccttttctaacatgttaaacctagttgatttgaggctctatggggcatatgatggggaacaactgaccttttgtgcagggtggttccctaagcttattcgtctggaattaggtgacatggaacatctggattggattgagatagaggacgggacaatgataggtctacatgatctagaacttgttggtctagggaatgtaatggcagtacctgcgggcatccagtaccttaggacactccaccaaatgtttctgacagatatgtcgaagggattcatacaaagactccaaggaagtgacaattacattgtccaacatatacctaacattcatattttttactcctctgattctcaagcagtaaataacctccatcttgtgccatggcttgtgaagaagtacggtcctggtgcagccaagcatgcccccacatactgggactcatctggcacatgatga

SEQ ID NO: 441 - DNA, 436 bp, Glycine max
gatcattgagcattcagcattgagcagagtatggatatatcaaatcctgcagccttagtcaatgcggaactgttgcacttctatgttggaagaagggtaaggatcgtggtgcaggttgtgcgatctgatggtggagttgtcattggaaaatcaacagatgagaaacaactagttgtaaaaggatcacccccacctgctgctcctcttacaacttttgttgaagtttatggtcttgttaacagtgataagtcaattggtgctgagatatggaccaattttggtgatgccatcgatatggatagctacaataagctttgtcagctcgcaaatggagaatttaaacacttgttcctgtgagttctaacaagcttgtctgatgatacagaggcctttctatcatttggaatactagaggagacataatcaatgtgttggc

SEQ ID NO: 442 - DNA, 516 bp, Glycine max
aagaagatggacttactggagttatgggcaattttcggccccggcgtcgccggcgctgtcttcggcgccggatggtggatctggcttgacgcggtcgtctgcagcttggtcaccgttcccttccttcactaccttcccggaattttcgcatcttttgcggctttgatgttcaattgcgttagaaaagaagacatcgattattctccatatgacgaaggcgagtggagactgaagctgtggctcttcattgcatatgttgtatcctttgtttctttagctggatcagctggcctactgatccaagattcacttgataaatctgccccttcagtttggactggagttgcaggtgttttgcagtgtgtttttgtcttgatcagtggactggtatattggacttctcatcctgaataagttgcaccaagatatgactcggagcttcaaactataccaggttatgcccacccatgtattgtcttgtttgttttatgtgatgttaagtcgctggcttcatag

SEQ ID NO: 443 - DNA, 338 bp, Glycine max
agctcatggctggtttgcaaagatctgaggtgtctttcaggagacagggttcatcagggcttgtttgggacgacaagttattatcaggggaattgaacaagaacgaagacccaaagggtgctcatggtggtgaccttaaccttaaccttaacgttagaacaacaccacccatccagagaagtcgctccaacggcggctaccgcaccggaaaagtctcgccggcgatcgagcctccctctcccaagctctctgcttgcggcttctgcagcgccttcggaaaaacaggggaaaagggtcgtcgcgcaaagccccgtgcaaagcatcgatcaaggtagtag

SEQ ID NO: 444 - DNA, 1167 bp, Glycine max
cttcataactaaaccgccatcgctatcttcgactttctgcgccccaaagatgagaaaacgcaccgtttacgcatggcttgtagcacttctttgcttcctagttctcatgatcgtcaccccatccatcccccagtcccaagaataccatgatttcgccgaccaccgcaccttcctcggtattcctaatgcacttaacgtcatatccaatttcccttttctggttattggcctcgttggacttgtgctctgttatcatggaaattactttaggctcagcttgcaaggtgaactatggggatggacatgcttctatgttggtgtggctgcagttgcagttggatcttcattctatcatctcaagccagatgatgctcgccttgtgtgggatcgcttgcccatgactgtcgcttttacatcaatcatggcaatattcatcattgagcggattgatgagaggaagggaacagtttcaattatacctctagttttggcgggtataataagcattgtgtattggagattctttgatgacctgcgtccatatgctctagtccaatttgtgccatgcattgtcattcctctaatggctattttgttgcctccaatgtacacacattcaacatattggctctgggctgcagggtcttatcttctagctaaggtgctagaggctactgatgatgtgatctacgaatggacgcgacatattgtcagtggtcacacacttaagcatctggttgcagcaatggttcctgtcttcttaacattcatgcttgctaagaggagtgttgaacctgagaggcaaagtttgcttaaaacgtggagggtttcctggacgaagttcagagagggcaactccaacactgaaagctactcttactcttacacaaatgtgcaggctgtggagccccagtgatgtgctactttcccatagaacaaaaaataataaaggcttatactggattacggaatattgttacacttgactgtggactaggtaaaacaagacataccaagttagcttttacacaaaaatattaactgtaaactttgtatagttcccgatctttatcacatagagaggaccattttagatctgtgattctgtatgtgttgtctattttttgttcagcatggttataatctgcacaccttcaaagttcaaac

SEQ ID NO: 445 - DNA, 688 bp, Glycine max
tgaaagaagaatggtgctttcggaggaggaaatcggtcgtctataccgaataaggaagacggtgatgcagatgctgagggacagaaattttctggttggtgacttcgagatcaacatgtccaagcacgagttcaagtccaagtacggcgaacacatgaagcgcgaggacctcgtcatcaacaaatccaagaaggacaactccggcgaccagatctacgttttcttccccgacgaacccaaggtcggcgtcaagaccatgaagacctacaccaaccgcatgaactccgaaaacgtctacagagccatcctcgtcacccagaccaacctcacccccttcgccagaacctgcatcagcgaaatctcctccaaattccacttagaagtcttccaggaggcggagctgctggttaacattaaagagcacgagcttgttcccgaacatcaggttctcactgacgccgagaagaaaaccttgcttgagagatacaccgtcaaggaaactcagttacctaggattcaggtcacagatcctgttgcgagatattatggattgaagcgtggacaagttgtcaagattatccggccaagtgaaactgctggcagatatgttacgtaccgatttgttgtataggaatttgctttaacatactggcaatattgccagagtgatggatagggatataaagcc

SEQ ID NO: 446 - DNA, 2546 bp, Glycine max
ccatttacactcactcacgcacgagcttcaaaaccaaaaccaaactctgttctaacctccaaacttttatgccattcatgactcataacatcatagaaaaagaagaactactcacgaaccgcgaccaccaccgacaataaaaggacaacaacgtcagtgtttaaaagcatgaaaatgctgccacctcccaccgccggaggtgcctcccacagcggcgccggtgaccgcaccgtggtggtgggcatgaagatggactctcacagcaccgagttgctcacttgggctctgttcaaagtggctcagcccggtgatgttgtgcttgctcttcatgttcttgggaatgatgaaattgtgaatcgagaagggaaatcctcgttgttttcacttgtcaaagcatttgactctattcttgccgtttatgaaggattctgcaatttgaaacaggtggatcttaagttcaaaatatgccggggttcatcagtgaggagaattttggttcgagaagcgaatgcttattctgcaacacacatcatagttggaagttctcaaggtcttcatataattcggccatgtatatctgtggcaaggtactgtgctaagaagttaccaaaggattgttgggttcttgctgttgataatgggaaaatcgtgttcaagagagaagggtcacccgcaactcgtgctgaattgaaaggacttgaccaggatcacaaaactcggttgctcggttcgattcataggacaatcagcaagggttcaaaagtgctagatgatgatggtacagggattcatgaaaagggttgtggtaatggtgaatattcagatcacagtttggctaaggcttttttggattctaaagaattcgttgagaagaagaggtgctctatttgtgcttcagaagaagagtcttgtggtgatgcttctgatgagaataaccctttggcaatagtgcctgtgcagaccaacgatgctgcttctaaaccaggttggccgctgcttcgtaagacaattgcatctgacaagaaatgttccgaaaaatcactgttgcgccagatctcggtggtacaatgggcaatgcagctaccctctagagatctttcatatgctgcacatcaagaccataaagcaaacaattgtgaccaaaataaggatcagtttttggctctggatagcaagagtggtgctcttgttccagtggatgccgaaataggaactgcttcttcgcctgaacgcaattcgagaagcattcctaaggaattggagggccttcatgagaaatattcttccacttgcagattgtttgagtaccaagaacttgtattggcaacatcaaatttcttgccagaaaatttgattgggaaaggaggaagtagtcaggtttatagaggttgccttcctgatggcaaggaacttgctgttaagatcttaaagccatctgatgatgttttgaaggagtttgttctagaaatagaaattatcactaccttaaatcacaaaaacattatttccctccttggattctgctttgaagatggcaatcttcttttggtctatgatttcttatcaagaggaagccttgaagagaatctccatggtaataagaaaaatccacttgtgtttggttggactgagagatacaaggtggcaatgggtgttgctgaggctttggagtatctgcataataatgaaggccaatctgtgatccatcgcgatgtaaaatcatcaaatgtgttgctatctgaggattttgaaccccagctctctgactttggacttgctaaatgggcatcaacctcatcatcacatataatttgcacagatgttgctggaacctttggttacatggctcctgaatacttcatgtatggcaaagtaaatgacaagattgatgtctatgcatttggtgtagtgcttcttgagcttctttcagggagaaagcccataagtggtgattatcccaaaggtcaagagagccttgtcatgtgggcaagtccaattctaaatagtggaaaggtgttacaaatgttagatccaagtttgggtgagaactatgatcatgaagagatggaaaggatggtcttggcagctacactttgtatcagacgtgctccaagggctaggcctctaatgagccttatctctaagctccttggaggtgatcctgatgtgatcaagtgggcaagactagaagctaatgctttggaagcaccagaaatgcttgatggtgaagcttgtccaccttccaatttgcagtcacatctcaaccttgcattgcttgatgtggaggacgactcgctctccatgtgcagcgttgagcaaaacgtctcgttggaggactacttgagaggccggtggagtcgctcatcaagctttgattaagcaaactactagcaaattgctagaagaataagaaggattgtgttttttgaaatctaaatccttttgtagataattttgccgtgttgcatgtgctgtgaatgtttttatagatgggtttaggatgagaggttgtttgtgtgtgccctcctccttcccttgattgtcaa

SEQ ID NO: 447 - DNA, 1189 bp, Glycine max
acgtacacaaagcaaatcccacgaaaaccaaagcaatcaaactggcatcaatgtcagagcccccaaaaaccagagcagtcatctgcgtgggcgacatccacggcttcataacaaagctccaaagcctctggaagaacctcgaaggcagcctcgaccgatccgaattcgaaaccgcaaccctaatcttcctcggcgactactgcgaccgagggcccgccacccgccaagtcatcgacttcctgatctccttaccctcgcgttacccgcggcagaagcacgtgttcctctgcggcaaccacgacttggccttcgcggccttcctccgcctcctcccggcgccggcggatgggtgtgggttctcggaggggtggagggaatacgaggcgagcgaggagcgcgaagggtggttcaagggggaagggtacgaggacatgcacctgcaagggaggaggtggagtgggaagataaaggtgaagtttaacacggttaaggggacggagtatcagggctccatttatgacgctggaccaacctttgagtcctatggagttccccatggctccgccgatttggttaaggctgttcctgatgatcacaagaaatttcttgctgatttggtttgggtccatgaagaggacgatgtctttgtgaacactgatgatggagttaaatgctgcaaattgattgctgttcatgctggtttggagaaaggaaaagatgtgaaagagcagttaaaacttttgaaagctcgggatactcgggtgcctaaggtggaggctctaagtgggagaaagagtgtttgggatattccagaggaactaactgcaagtccagccattgttgttagtggtcaccacgcgaaactccatgtagaaggcttaaggctgatcattgatgaaggtggtggatataaagatagaccagtggctgcaattattcttccttcaatgaagattattcgtgatacagatgaattagcaaaatagtttcatatttgtgatattttttgcttttatacggcgtagtcaagctgttcagcttttagatctcatgagctcatagagatgagatattgcgtgttgttgatctgaaacacgagatacatttagatggcttatcctcttgttctgatttttaatgaagctctgaactattcctttcatcaacgctatggatctgagtctttcgc

SEQ ID NO: 448 - DNA, 2067 bp, Glycine max
gtccgcaatgtatcgatgatgttgtgtccccatcacaagttgattgtcagaataaaaacattaaattcatccaacattgggaagaagaaataactgagcagcaaagaaagcgagtaatcttttccgtgagatcggtgtgtgaattgtatattcccatttcaatgcagagatccggttatgggtccgacggaatatacaggtcactcagaccttccatcgtttttcccaaaaactcaaacctctcactcgtttcccatcttttcaacagagtcgcagcctttccatcaaaaccagctcttatcgatgcagactcttcagaaacactttctttcgcggaactcaaattgctaactgttagggtcgctcacggcctccttcgtctcggagtgaccaaaaacgacgtcgttctcttcctcgctcccaacgacatccgctacatcgtctgcttcctcgccgtcgcctctctcggcgctgccgtcaccaccgtcaaccccgcctacaccgccgccgaagtctccaaacaggccaacgactccaaacccaaacttttggtaaccgtcgccgaattgtgggacaaactcgaacacctcaaactccccgcggtcttcctacgttgttccaacgctccccacgcgccatccagcgcgactagcttcgacgcgctggttcaactcgccgggtcggtgaccgagtttcccgaaattaaaattaaacagagtgacactgcggcactgttgtattcttcgggtaccaccggcttgagcaagggcgtggttctcacgcacgggaacttcgtcgcggcgtcgttgatgattggcttcgacgatgatttggcaggggtgttgcatagcgtgttcctctgcgttttgcctatgtttcatgtttttggtttgatggtcatttcgtacggacagcttcagaggggtagtgcggttgtgtctctcaagaagtttgagtttgaattggttctgaagaccattgagaagtttaaggtgacgcatttgtgggttgtgcctccgattattcttgctctcgcgaaacacggtttggttgataagtatgatctttcgtctctcaagcatattggttctggcgctgctcctcttgggaaagagttgatgaaggagtgtgctaaacgttttcctcatgccattgtttctcagggatatggtatgactgaaacttgtggaattgtttctgtggagaatgcaaggatgggaattcggaatagtggctctacgggaatgcttgtcgccggaatggaggctcaagtagttagtgtggatactctgaagcctctccctcctggacagttgggggagatatgggtacggggccctaatatgatgcaaggttatcacaacaatccacaagccacaagattgactatggataaaaaagggtgggtacatacaggagatcttggatattttgatgaggatgggcaactttttgttgttgaccgaatcaaagaactgatcaagtataaaggttttcaggttgcgccggcagaacttgaagggcttctggtttctcatgctgaaatacttgatgctgttgtcatcccatatcctgatgctgaagctggtgaggttccagttgcctatgtcgttcgttcacccaatagttcactcacagaggaagatgttcaaaaatttattgctaagcaggtagcgcctttcaaaagaataagaagagtgacattcatcaatgctgttcctaagacagcatcaggaaaaattctccgaagagagcttattgagaaagtaagatccaaaatatgatgatatcatggtgtaatttttttgtgtgttttcaaaaccatttcggggtttaaattcagaagtagaatgcaagtccagagcgaatccggaaaggtatgatggttgtcatagtggatcaaatatgtatctggctgggaacagtacttactgttgggtctagcatatttcaatccattttataaatgggtcaattcattctagttcacttaaggttgaatctttaaaaaaatggtctgatgtgacctaccatggattggtgagataaacaggttgacccaggcct

SEQ ID NO: 449 - DNA, 3208 bp, Glycine max
gtgttgatagtgaaaggcatcgtcctcatcatcatctatcatggcatggtttagagctggagcaagcatagcaaaacatgcaattaggagaactctttctaagggtggatccacacaccttgtgtcaagggcaagggtccttccatcgataccatcatcacatagcagaagcttccacagctcggttttcaaggagcaagctgcacctgttcctcgtgcggttcctctttcaaagctaacagatagtttcttagatggcacaagcagtgtgtatctggaggagcttcaaagggcttgggaggctgatcccaacagtgttgatgagtcatgggacaatttcttcaggaactttgtggggcaggccacaacctcacctgggatttctggtcagacaattcatgagagcatgaggttgttgttgctggtgagggcgtaccaggttaatggccacatgaaggcgaagttggatcccttgaatctggaaccaagggaaatccctgaggatttggaccctgcactttatggcttcactgaggctgatcttgatagagagttcttcttgggggtgtggaggatggctggtttcttatctgagaaccgccccgtgcaaacccttagatccattttgacaaggcttgagcaggcctattgtggaagcattggatatgagtatatgcacattgctgatcgtcacaagtgtaattggcttagggataggattgagacccccacccctacacagtttaatagggagaggcgcgaggctatctttgataggcttgcttggagttctttgtttgagaacttcttggccaccaagtggacctctgcaaagaggtttggacttgagggtggagagactcttattcctggaatgaaggaaatgtttgatagggcatctgatcttggggttgagagcatagttataggaatggcacatagagggaggctgaatgttttggggaatgtggttaggaagccgctgcggcagattttctgcgagtttagtggtggtcttcagcctgagggggaagttggactctacactggaactggagatgttaagtatcacttggggacgtcgtatgatcgccctactcggggtggcaagaggattcatttgtctttggtggcaaatcctagtcacttggaagctgttaatccagttgttgttgggaaaactcgtgccaagcagtattactcaaatgatgtggatagaacaaagaacatgggtgtgctgattcatggagatggaagttttgctggacagggtgtggtctatgaaaccctgcatttaagtgctcttccaaattacactactggtgggacgattcacatcgtgtttaataatcaggttgcatttacaactgatccaacatctggcaggtcttcacaatattgcactgatgttgccaaggctttggatgctcccatctttcacgtgaatggtgatgatgttgaagcagttgttcatgcctgtgaacttgctgctgagtggcgccagactttccactctgatgtggttgtcgacttggtgtgttaccgtcgatttggccataatgagattgatgaaccatctttcactcagcctaaaatgtacaaggtaatccgaagccatccatcaactcttgagatctatgagaagaagcttttggaatcaggggagttgacacaagaagaaattgataggatacacaagaaggtcacatcaattctaaatgaagaatttttggctagcaaagaatacattccaaaaagaagagattggctttcagcatattggcttggtttcaagtcacctgaacagctttcacgtatccgaaacactggtgtgaaaccagagatcttgaaaaatgttggaaaagcaatcacaaccatccctgaaaatttcacacctcatagagcagtgaagaggatatatgaacaacgggcccaaatgattgaaactggggaagatattgactggggatttgcagaggcgcttgcttatgctaccttgcttattgaaggtaaccatgttcgattaagtggtcaggatgttgaaagaggaacttttagtcaccgccatgctgtagttcacgatcagacaacaggagagaaatattgtcccctggacaatgttataatgaaccaagatgaagagatgtttaccgttagcaatagttcactttctgagtttggtgttcttggatttgaattgggttactcaatggaaaatcccaattcattgataatttgggaggctcagtttggtgattttgctaatggtgctcatgtcatatttgacaatttcttggcttctggtgaggctaagtggctccgtcagactggtcttgttgtgttacttcctcatggttatgatggccagggcccagagcattcaagtgcaagattggaacgctttcttcagatggctgatgacaaccctcatgttatccctgagatggatccaactcttcggaagcagattcaggagtgtaatttgcagattgtgaatgttacaactcctgctaattttttccatgttctaaggaggcaggtacatagagaattccgcaagcctctcattgtaatgtcccctaagaacctgcttcgtagcaaggcttgcagatcaaatttatctgagtttgatgatgtccaaggccacccaggctttgacaaacagggaaccagattcaagcgcctcataaaagatcaaaatgagcacaaagatgttgaggagggtattagacgtttagtactttgctctggaaaggtttactatgaacttgatgaacatcgaacaaaggttgatgcaaaggatgttgcaatatgtagggtggaacagctttgtcctttcccttatgaccttgtccaacgagagcttaaacgatatccaaatgccgaggttgtttggtgtcaagaagagccaatgaacatgggtggatacacttacattttaccccgacttatatcttcaatgaaagctgtaaataggggaggttatgatgatgtcaaatatgttggtcgtgctccatctgcggccacagccactggtttcctcaaggttcaccagaaggagcagactgagattgctgaaaaagcccttcaacaggaaccgatcgacttcccattttgaaaaggcatttgcacatgcatccatcttttttgagagtgataataatgcatttagtttaatttatccaccacgtaaggagctatagttgga

SEQ ID NO: 450 - DNA, 1054 bp, Glycine max
aaaggatcctttggtctacacacaccaccacatgaagagcatggtgacgccattgacgagggtcttaccctttcgtcacccaaatggccataatacccttccattttctcttacacgctacccttcttcaccaaacttctccttctcccctctcactctcactctttccatggctgcttcaccccaatcctccgctccaactgtgtcgcctggtgatgttaacatcgacaaagatggtgtatttcaattgattcaagctcatcaggaaaaagctgctagacttccaccagttgaggagattcgaactgtccttgatcgtagcgtgcgcgggatgctctctacattctcaaagaagtttgatggttatccatcagggtctatggttgactttgcatgtgattcaaatggatatcctatattagcagtgagcgacttggcagttcattcaaaggacctaactgccaatcctaaatgttcattgcttgtggctagagatcctgaagataggactgatttagtgattactgtacatggtgatgctatctctgttcctgaaaatgaaagagaagccgttcgagctgcatatttggcgaggcatcccaatgcattttgggttgactttggagacttccaattcttgcgcattgaaccgaaagttgtacgatttgtgtcaggtgttgccacagctttgttaggatcaggagagtttagtggagatgagtataaatctgcaaaagttgatcccatagctcagttttccaagccagtggcgtctcatatgaacaaagatcatgctgaagataacaaagtgattgtgcagcattggacctcagttccagtggactttgccttcatactagatttggatagtcttggtttcaatgttaaggctggttatcagggtgatactttcaagcttcgtgtacctttccctcgatgtgcagaagatagaaaggatgtgaagactctcattgttgagatgcttcaagctgctaggcctaaagttgattgatcacttcacagatcaatgatgaacaggtgctaggaattcttt

SEQ ID NO: 451 - DNA, 806 bp, Glycine max
gaacgatgaagtttgaagatttggcagaaggatgcatggcaaaaatactgtcctacaccactcgtgcggatgtatgcaggctttctctggtttccaaagcctttcattccgcggctgaagccaacactgtgtgggattgctttctcccctctgatttgtcctctatcatctccccttcttcttccgttcctccctttcgctctattaaggatctctatctctatctctccgatcgtcccaccatcatcgatcaaggtataaagagttttcaattggagaagcggactgggaacaagtgttacatgctttccgctagagatctgagcattatatggggtgacactactcattattgggagtggacaaccctaccagagtccaggttcgaagaagttgctaggcttcgagctgtgtgttggtttgacattactgggaggatgaacacccgcgttttgtcgccaaatactaattatgcagcttttcttgtgttcaagatgatcgatgccggtggatttcactacgatcctgcggtgttatcagtaggtattttgggaggcaatagcagtaccaaaaatgtttgtttggatcccaacttagtagataatcgacttgatgatagattccatggactccaacgtccaactgtgaggagcgatgggtggctggagattgagatgggtgagttcttcaatccaggcctagaagaagatgagttgcagattaaagtctcggagacaacaagtaattggtggaagcgcggtttcattcttgaaggaatagaagttaggcctaaacatgtttgatga

SEQ ID NO: 452 - DNA, 425 bp, Solanum lycopersicum
caaagatgtctggggaagaagaagaaaacgccgctgagctcaaaattggcgatgagtttttgaaggccaaatgtctaatgaactgtgaagtcgcattgattcttgaacacaagtatgagcagatccagcagatgtctgatgatccaacaaatcagatttcgcaggtatttgaaaagtcgctgcaatatgtgaagcgtttcagtcggtacaagaaccctgatgctgttagacaagctcgagaaattcttagtaggtatccacttgctgaattcgagctctgtgttcttgggaatctttgccccgaaactgttgaggaaggtattgccatggtcccatccatcaagaatagaggacgtgcacttgacgaggaagcaattgagaaaatgctaactgacctttccctaataaagaaattcgagtagtag

SEQ ID NO: 453 - DNA, 443 bp, Solanum lycopersicum
caacaatggcggacgatgactatgatatggacggaggatacgtggacgagccaatggatcctgaacctgatgaaggagcagagattgaagaagataatggcaacaatgacgacataccagatcccctgatgggtgaaggtgaggaaaaaacagagcagcaagagcctgtggaacgacctcgtaaaacatcaaagtttatgacaaaatatgaacgtgcgagaatcctgggcactcgtgcactccagatcagcatgaatgcacctgtgatggttgagctggaaggagaaactgacccacttgagattgcaatgaaagagctccgagagaggaagataccattcacaattcgccgttacttgcctgatggaagttatgaagattggggagttgatgaattgattgttgaggattcatggaagagacaagtcggaggaacttgatga

SEQ ID NO: 454 - DNA, 869 bp, Solanum lycopersicum
agacataaggaagcgtctgcactaggcagactccatatggggatgatcttttactagtcaagtcgaggaatgaatgcctgttaaggacttgattagctgatctgccatagtagggttccatcctcaagctattatcagcttgggaaaggacgaattcgcttcattttgaagtaggcgcgctatggaattgaatgctagtgtgtccacaaaaaggacaatgaaccctaggaagacagatattggaggtaaacccttcatactcatcatttgtggcagcctcgtttactaccactgtgcctatcggaattctagtcttgtctctctcatctcagacgtctttattgtactcctttgttcccttgccattctcggactcctctttcgccagatgaacatctcggtacctgtggatccgcttgagtggcagatctctcaggacgctgccaacatgttttttgcctgcctcgccaataccgttggtgctgctgagtctgttctacgtgttgcttctactggccatgataagcgcttgttccttaaggttgtggctgctctgtatgttctatcatctctgggaaggatagcttcgggtgttaccattgcgtatgctggtctctgctttctttgcctttatatgctcgctgagaacttgcaattgattagctcgaggtatcctaggagaagagacagcacagacacagttcaggacgactaaattgatttgatctggttcaaaagggatgaaggaaggagtcaatgcattatttacagctcttgcttctagttatgccaggttcatcgcgtgttatttgccttattaacgtgatttctctttccattcatgtctgcagccttgtgatttccttaca

SEQ ID NO: 455 - DNA, 820 bp, Solanum lycopersicum
cttcccattcatttcttgaagcagagctggaatttgaattctgagggatgctaggaaaatcatttgctactcctgtgctgacctttaactctgcatcatgcttctcctctcctggttgtgagtccatctcaacaacagctaacactctagtagggtatgtaaattgctcgagtagcattacatttaatgttactaggggatcttggacgtccaattatccattcaagaaatggacgttgcattcaacagctactgacaatatagtattaactgaagaagagaagaaaacgtggaacgatagcagacaagctctttctgcgttaaaatttagcccagaggaagaagacaaaatattaggaaaagcatttggccacatacattcgccttactggtatgaagaacggaagaaagaggttccacgactagaagttgtgaacgagatactggattatctaaggagtttaagccttactgatgatgatctcactaaacttgtcaagaaattcccagaagttcttggatgtagccttgaagatgaaatgaaaaccaatgtcgaaattctggaaaaacaatggggaattgaaggtaaaactctgagaaatttgcttcttcgaaatccaaaagttttaggctacaatgtcgattgcaaaggtgattgtgtggctaaatgcactcgctgttgggctcgattctagctgcattcttgtgtttcatcctctatacctttctttatgtataactttcgccaaccattttatctaattattcaaaatcgaaagtaaattcatacaagtctgtattgcactgatatgtgactcaa

SEQ ID NO: 456 - DNA, 773 bp, Solanum lycopersicum
aaaatcagtcttcaatggcttctctgctgaacccacctctcactctgcctcaaaacaagctgaaccctgggggtgtcttatctgtatctactagtggaataccaaacaaaatttttcaaccatcttcaacacgatggagccacaggcggcgtttgatgacgagagctaaaccatcggtggaaatggatatgctggcaaaagattctgtaggcaccgacgctgttgatgataaggattttggagttgtttgcatgcaccacgttgggatactatgtgaaaaccttgagaggtccttagacttttaccagaacattcttgggctagaaataaatgaggcaagaccacatgacaaacttccctatagaggtgcttggttgtgggtgggttctgagatgatacatctaatggagcttccaaatccagatccttatactggtaggcctgagcacgggggcagagaccgtcatacttgcatagcaattcgcgatgtgtctaagctgaaagctattcttgataaagctggcattccctacactcttagtcgctctgggagaccggccattttcactcgagaccctgatactaatgcactagaatttactcaagttgatgcttgacaggatctggactgcttgctctccaatttgtaatccttatatatagttaaatatacagctattgtgaatatataaataggggatattcaacaagtagaatctattggaagcacttcagctattagtggttatggcttatcaatccccacaatgtca

SEQ ID NO: 457 - DNA, 450 bp, Solanum lycopersicum
ttccatagcagaggaagaagaaagagtttactccaatggcgtctggatggggaattacagggaataaaggacgatgctatgatttctggatggatttcagtgagtgtatgtctcgatgcagggagcccaaggactgtgtacttcttagagaagactacttcgagtgtcttcatcattccaaagagtatcaacgtaggaaccgaatctacaaagaggagcagcgccaattgagagctgcttcacaaaagaaaaaggaaggtgtagatggtggtggtggtggtcatcactgacctttattattcttgatcaatcatggttttatcaactaaaagacattgaagtaaactgtatgtggttttgaattttgaaataaagaattctatcagttgcatttgatgtgagttgcatcattgaaatgactcagttcagtttctttctcatatggcctgg

SEQ ID NO: 458 - DNA, 2657 bp, Hordeum vulgare
acgggatggcctcgagatcctactccaacctcatggagctcgccgccggcggtgaccgcgaccagccgacgctgccgtcgctcgggcagcgacgggtgccgcgggtggtgacggcgtctggcattgtgcccggcctccactgcttcgacgacgacgctggcaccgcctcggtggcctccgaccagccaaaccaggcgccgcgggagcgcaccatcatcgtggccaatcaacttcccatccgcgccacccgcggcgccgacggcgcctgggagttctcgtgggacgaggacagcctcctgcggcagctcaaggagagcatgcgcgggcaccagggccgcgtcgacatggacttcgtctacatcggcagcctgcgcgacgacatcccggcggaggagcaggagaaggtcgcggccgagctctacgatcgcttccgctgcgtgcccgcgttcctggccgccgacctccgctcccgcttctaccacggcttctgcaagcagcagctgtggccactgttccattacatgctgccactgtcgcccgagctcggcggccgctttgaccgcacgctgtggcaggcctacgtgtccgtcaacaagatcttcgccgacaagatcctggaggtgatcaaccccgaggaggacttcgtgtgggtgcacgactaccatctcatggtcctgcccaccttcctgcgcaagcgcttcaaccgggtcaggctgggcttcttcctgcacagccccttcccatcatcggagatctacaagactctgccggtccgcgaggagctgctccgggcgctgctgaatgccgatctgattgggttccacacatttgattatgccagacatttcctatcatgctgcagcaggatgcttgggctcaagtacgagtcgcagaggggatacattgcactggactattacggacgaactgtcaccatcaagatactgcctgtggggatacatttagtgcagctgcagtcggtgctcaacctcccggagactgggctcaaggtcgccgagcttatgaagcagttctgtggtcggggccgcatcttgatgcttggcgtggacgacatggacatcttcaaaggtatcagtctgaagcttttggcatttgagcagctgttggtgcagcatccagagtggcgagggaagctggtgctggtgcagattgccaatccggcgagggggcggggaaaggatgtgaaggatgtacaggatgagagctatgcgatggtgaggcgcatcaatgaggcatttgggcagccagattaccagccagttatactgatcgacaggccactgcacttctatgagagaatggcatactatgttgtcgctgagtgctgtttggtgaccgcagtgagggatggcatgaatcttataccctatgagtacatcattgctaggcaagggaatgacaagattgacaggatcctgggtctcagcccttccacaaagaagaaaagcatgcttgtcgtgtcggagttcattggctgctcaccctccctgagtggcgcgattcgggtgaacccttggaacattgattcagtgactgaggcaatggagaaggccttgtccatatctgactgtgagaaggtgctgaggcacgagaagcatcacaaatttgtgagcacacatgatgtcggatactgggcaaacagcttcctgcaggatctgttgaggagttgccaagaccataacaagaggcgctgttggggcataggatttgggctaaggttcagggttgtggcccttgatacgagcttcaagaagctcgcggctgagcagcttgtctcagcctaccggaaggcaaccacgcgtgccattctcttggactatgatggtacgctgatgcctcagacatcgttcggtaagaatccgggctccaaaacgatagacatgttgaacagcctttgtcgcgatgagaagaacatggtcttaatcgcaagcacaaagacccgggcgaccttaagtgaatggttctcaccatgcgaggacctaggccttgctgctgagcatggctacttcctcaggctgaaaagagatgcagaatgggagacatgcggcattgcaacagactgcagctggaagcagatcgcggagcctgtgatgaaaacctacaccgagacaacggacgggtcagtcatcgaggacaaggagacagcaatcgtctggtgctacaaggacgccgaccctgattttggatcttgccaagccaaggagctccatgaacacctggagagtgtcctttccaacgagccggtatcggtcaaagctgacgtgaaccatgttgaggtgaagccacagggcgtgagcaagggcctggtggcgaagcggatgctgtcggcgatgcaggcgcgagggctcctgcccgacttcatcctgtgcatcggggacgaccgctccgacgaggacatgttcgaggtgatcaccaccgccgtggacggcccctacctgaaccctgaggcaaaggtcttcgcctgcaccgtcggccgcaagcccagcaaggccaagtactacctggacgacaccgcggacatcgtgcggctgatccaggccctcgccaacgtctccgacgaggtgcagggcggccctccttcctatttcttcgcctgcgccggcaccagcaccgacgacagggcgctgaattgatga

SEQ ID NO: 459 - DNA, 800 bp, Brachypodium distachyon
tcgaaatggccgcgtcggcgctgcaccagaccaccagcttcctcggcaccgccccacgccgcgatgacctcgtccgcagcgtcggcgacttcggcggccgcatcaccatgcgccggactgtcaagagcgcaccccagagcatctggtacggccctgaccgtcccaagtacctgggcccgttctccgagcagacgccgtcgtacctgaccggcgagttccccggtgactacggctgggacaccgcggggttgtcagctgacccagagacgttcgccaagaacagggagctcgaggtgatccactctcgttgggcgatgcttggcgcgctcgggtgcgtgttcccggagatcctctccaagaatggtgtcaagttcggcgaggcggtgtggttcaaggccggctcgcagatcttctccgagggcggcctggactacctgggcaaccctaacctcgtgcacgcgcagagcatcctcgccatttgggcatgccaagttgtgctcatgggcttcatcgagggttaccgtgttggtggaggccctctcggtgaggggctcgacaagatctaccccggtggcgcctttgaccccctcggtctcgccgacgacccagacaccgccgctgagctcaaggtcaaggagctcaagaacggccgcctcgccatgttctccatgtttggattcttcgtgcaggccatcgtcacgggcaagggacccgtcgagaacctcttcgaccacgtcgccgacccagtcaacaacaatgcatgggcctttgctaccaacttcgcccccgggagctaataa

SEQ ID NO: 460 - DNA, 1359 bp, Brachypodium distachyon
cacagccaacaattaacctcggcgcgcacaagcacagtacgcccaggagcacgcccaggcatggacgtggaagcgcccaaggagccgctccccgtgggaggagcggcgcgcggcaccagcagcaacaacaaggcgatgcactggctcatggtggcgctcaactgcggcatgctgacgctgggcacgacgggcgggccgctcctgagccgcctctactacagcaagggcgggcaccggcagtggctgtcggcctggctcgagacgggcggctggccgctgcttctcttccccgtgtccttctcctacctggcccggcgcgcccgcgacgggcccggcgcgcccctggtgctcacccggccgcggacgctcatggccgccgcggcgctcggcttggccacgggcgccgacgacttcatctacgcctacgggctctcctacctgcccgtctcaacctccgccatcctcatctccacgcagctcgccttcaccgtcttcttcgcgttcctcgtcgtgcggcagcggctcacggccttctccgtcaacgccgtggcgctgctcaccgtgggcgccgtcgtcctgggtctgcacgcctcgtccgaccgccccgcgggggtcaccagggggcagtactggctgggcttcttcctcagcctcggcgccgcagcgctctacgggctcgtgctgccgctcatcgagctcgcctacaagcacgccgcgggcggcggcagggaagtcacgtacgcgctggtgcttgagatgcagctcgtcatggggttcttcgccaccgccttctgcaccgtcggcatggtcgtcaacaacgatttccaggcgatctcgagggaggcgcgggcgttcgagctgggggaaacccggtactacgtggtgctggtgagctgcgccgtcctgtggcagttcttcttcctgggggccgtgggggtcatcttctgcgtgcacacgctgttcgccgggatcctcatcgccgtgttcatcccggtgacggaggtgctgggcgtcatcttcctgcacgagaagttcagcagcgagaagggcgtggcgctcgtgctctcgctctggggcctcgcctcctactcctacggcgagtacagcgacgccaaggccaagaagaagaaagccgccctgcaagcccaagatccgtagcattgtatatttgttttgtttttcctctttcgaagttttatatttcagtttgtatgtgtcgtatatgtgggctcgtcgtagccatgggctggctagcagatgtatttatcgatttatgtgtgtgactgaccagtgaccagatgagatagcaaactcaaaattttacagtggaagtgtacaacacgtaagggaatacgtgac

SEQ ID NO: 461 - DNA, 2114 bp, Brachypodium distachyon
aaagatatcctgctatacgagccagtacgagtggtagctacctaaacaggttgactcctggacagagtgagcggagacagcgagagaagctagctactaaaaaggaattcaactattcaagcatggacgtggagagctccgcggcgcacgaggtctccgtggactggcggggccgcccgtgcgagccgcggcggcacggaggcatgcgcgccgccgtcttcgtcctagggatccaggcgttcgagatcatggcgatcgcggcggtggggaacaacctgatcacgtacgtgttcggggagatgcacttcccgctgtcggaggcggccaacgtcgtcaccaacttcgtgggaaccatcttcctcctctcgctcgtcggcggcttcctctccgactcctacctcggctgcttctggaccatcctcaccttcggctttgtcgagctctcgggcttcatactgctgtcagtgcaagcacacctgccgcagctgaagccggcgccgtgcaacatggcgtccatggacggcagctgcgagcaggcgaggggcttcaagtccagcatcttcttcgtcgcgctctacctggtggcgctcggcagcggctgcctcaagcccaacatgatcgcgcacggcgccgaccagttcgccgccggtgccggggtcgacaatgccaagaggctctccacctacttcaactcggcctacttcagcttctgcctcggcgagctcttcgcgctcacggcgctggtctgggtgcagacgcactctggcatggacgtcggcttcggtatctcggctgccgccatggccgccgggctcgcctgcctcgcgtccggcgcggccttctaccggaacaagcctcctcagggcagcatcttcactcctattgcaagggtgtttgtggctgccttcaacaagaggaagcaaatctgccctgccagtcaagccaacgtcggagtctgtgagccggctcgcctcgacggcaacttccgccacggcaacaaattcaggttcttggacaaggcgtgcatcagggaaaacgcagggcagcagcagggtcaggacggcaacacgaagccggagagcccgtggcggctgtgcacggtggccgaagtgcagcaggccaagacgctcctggccgtgaccccgatcttcgcctgcaccatcgtgttcaacaccgttctcgcccagctgcagacattctccgtgcagcagggaagcgccatggacaccgccctcggcggccacgggtccttccgcgtcccgccggcgtcgctgcaggccatcccctacgccatgctcctcttcctcgtcccgtgctacgagctcctcctggtcccgctcatgaagcgcctcacaggcacccggtccggcatcaccccgctcacccggatcggtgtgggcctctgcaccgtcgccttctccatggtcgccgcggccaccgtcgagcgccggcgccgcgacctcgcgctctcgcccgggggagcgcagcagaagatgtccgtgctgtggatcgtgccgcagttcctggtgttcggggtgtcggagatgttcacggccgtggggctcatcgagttcttctacaagcaggcggccgcgtccggtgccggcatcggcatgcagtccttcctcacggcgctcacatactgctcctacgccttcggcttctacctcagctccgtgctcgtcaagctcgtcaacatggtcacggcgggccacggaggcgccggcggatggctcggggacaacgacctgaataaggacaggctggatctcttctactggatgctcgctgtgctcagcgtgctcaacttcttctgctacctggtatgcgcaaggtggtacaattcgggagcggacggccttgatgccgcctctgctcagattgctgctgaaggcgacggcaaggagatcagctgaacaactgcaacaagattgaaactgtatatgcgtataggtttgaaaaaatagtggtgggggaaggagtactagttctaagatgagtaaaatgcagtcgcagtcattgtatttgaaccgtattctcggtttagtcactgtattttgaaaaccggaaaatacggtcactggactcgacgaaatatcccacatggtaccttt

SEQ ID NO: 462 - DNA, 887 bp, Sorghum bicolor
accacatgttgcatgagcagcaggcaccgccatcaccaccgccggaagtagaagcagcgccaccgcccgtgccatcggcgccgagcccggccaggaaccaccaccaccacgacggcgacggcgacgtccacgatgtcgaggtcacgacgttccgcgacatccaccctctgacgcccgacgtgccgacgccccccgcgcgcaccaggtcctgggacaccgccagccaccgctccttctcgtccgaggagcagttcatgacgatgagccgcgagttcacggccatggtcgccgccggggcgaccatgcagacaggcggcggcgccaacggtaacggcgggtacgacggcgaccagctcaccagcatcggcgaggacgagctggaggagaccaacccgctggctatcgtccccgacagccaccccatcgccacgcccgccaggtccagggcgtccgccgccgcctccgcctccgggctggaggtcgtgccggcgccgacgccgacgccgcagcagccgcccgcgcacgtggaggccagccaggtgaagaaggaggaggtggagaccaaggtgtcggcgtggcagacgaacgaggtggccaagatcaacaaccgcttcaagagggaggaggtggtcatcaacggctgggagaccgagcaggtggagaaggcctccgcatggctcaagaagatcgagaggaagctggacgagcagcgcgccaaggcggtggagaagacgcagaacgacatcgccaaggcgcggcgcaaggcggaggagaagcgggcgtcagcggaggccaagcgaggcctgaaattggccaaggtgctggagctcgccaacttcatgaaggccgtcggcagggtgcccaccaagcgctccttcttctagtag

SEQ ID NO: 463 - DNA, 1121 bp, Solanum lycopersicum
tgttcagcgtctcttctctgtgtcttcctggagaagaaaaaggttttggaggtgtaagttaaattgtctgactccgcaacatggatggtatgagcagctattggcaattcggggatgagcttcgaggacaatcaaaagtatcggaggatcatacatggacaacgggtactgtaaaattggctgagcagttaaggtccaagggtgagcgggtgaataaccttgacctttcgaaaagctcagctgaaagtaggttcagggtttatcttggtttacaggaagataacaagtgggaaaaccaatacctcaacatgttgaattttgataccaagataactgacaatacgaccaagagctccttcagtaatgacattcacaacgttaattctgtttgtccgaaatccaatgtcaacagcttgggaaatatgtcatttagcaagttcagtagcaaccacacaaatgacgctagcagctatggcaataacaaaaacactgagagtatcaacgggaacaatgctgttgacaaaaggtttaagactttgcctgctgctgagacactgcccaggaatgaggttcttggtgggtatatctttgtttgcaacaatgacacaatgcaggaagacttgaagcgccagctgtttggtctacctccaaggtacaaagattctgtgagggcaataacaccagggttaccgttgttcctctacaattacactactcaccagttgcatggtatctttgaggcaacaagttttggaggttctaacattgatccaactgcttgggaagataagaagtgtaaaggagagtcgaggttccctgctcaggtgaagatccgtatcaggaaacttggtagggctttggaggaagatgcttttagaccagtgctgcatcactatgatggacccaaatttcgtcttgagctctctgtgcccgagactttggacttgatggatctctttgaaaataccagcgtgttcgcgccagtctgaagtcatggatttattatttattagcatatattatgaactcatgaatattgtagtttagtagtagaaacgtgttctccacagatttccaaagcacaattttggtgtaaagtctggctgagagaggttctgaat

SEQ ID NO: 464 - DNA, 1501 bp, Triticum aestivum
aaaggatccaatcaatcccaacctccactgcctccatagctggctgcagcctagcttagctcctgctctgctctgctgtctccgccggccggtcagtaaccgatggaagccccgctgctcctccccgtctccacggccgcctcctcctccacgtccatcaccgtcgacgatgacagccactgcgcggcccagaacgtctccccgtcccgcgcctcgccttccgcccggagcatcgccgcgcgctacctggccgtggccctcgtcgccgccgtctcgctgttctcgcagcacgaggcgtccaagggctttcgcatcgacgtcatccgaggcggtggcacggccgatgccgccggcaagcgcttcgacctcctcttcgttgccaacggccgcgccgagcgcgtgctccaccgcgccagccgccgcgtcgaggaggcgctcttcccggacccctcgttcccgcggcgccgggtcgcccgcgtcaccgtgcggctgatggccggcggcaacctcaccgctgacgacgcggccgtcgacgctgtcacggatggggagtacgtcatctcgctgagcccacgcctcctgtcgccgtcctccggcggcggcagcagcgccggggccgccgacgccgtcgccgccacggtgcgccgcgccgtggcgcgcatgtggctgtgggacggccggggcgccgcgccggcgcgcgtcacggagtccatggtggagtacctcgccaccgccgtcccggccgagtcgtggccgccggcggaggagcacacgtcggcgtcgaacacgcactgcatctcgccgcggttcctgaagcacctggagcggcggcgcgcggggttcgtggcgcggctgaacagggcaatgagggaccggtggagcgacgccgcggtggacgccgcgctcggggcgccggcccggcccgtctgcgccgcctacctcgcggcggcgacggaaaccggcggccaacgaccggtggttggctccgcggtggcggtttgagagccagcaaggcgtcggaacagcgcacgaagggcggtttgcgagagatcgcacatgcacgccgtgcttgtcacgtgactcggtcggtcactcccttgtacgtaaatgtaattcatccgccattatcggtgagtggttaattaagtaatgggatgagacgagtcagcggtcgctactgctacaaatgaagtttttaggggaactacaaatgtagttaagcacaagccttctttgtaaatccacagtagttcttcatgtttgtgtggtggaatatatggcgatctcaaataattgtagaacgctcaagagaaaacaagccgaccattctatcgatcacttttgatttatggtctttctagttctaggtttttggtcccttataatcgatagtgtttattccccagaaacttaatagatctcataatagggttacagattgtctggaaaggtttggcagaggacctccatgtattgaggctctcttgctggagaattcttt

SEQ ID NO: 465 - DNA, 635 bp, Zea mays
gcaccatgtggtcggcagcaacggcggcggcggcgcgcgcggtgtccgtgtccccagtcccggcgccttcgctcctcagcggccggcgcggcgggtcgcggggcggccgggggtcggtgtcggtgcgcagcacggtgtgggacttcgtgggcggcgacctggtgcggccggacctgggcaagtggctggacgacgtggagaagcacaaggcgctggccatctacccgccgcacgagggcggctacgagggccgctacctgaaccgcctccgttaccagggctactacttcctcgacctctccgcgcgggggctcggcgacccggagaccacgctcaccaaggtccaccccgtctgcccgcctagcctcggcaggcagccggtggcgcggtggtacttcccgccggaggtggactacaggctcagcctgctgcacccggacgccaaaggcctcgtcgtctggatcatcgaagccaaggttctgtccaaggctgagctgcagttcctggccatgctcccggacatccgccccaaagtcagggtgatcgcagaatgcggcaactggagaagctttgtttggaagccactgaagcagatcgcaggcctcgagccggacccggacgcggaggaatgatga

SEQ ID NO: 466 - DNA, 1586 bp, Zea mays
caccaatggggccacccgccatggcgttccaagccctcaccctcacgccactccccttctcactccacagctcgagccgccgcgtccgcgtgcttgccgttgcggccgaccagactcctccgcccgcccccccttcggagccggcgaacagccctagccgcctccttcgcgagctcgcgcagcggaagaaggccgtatcccctaagaagaagcatccgccgcgtcgcttcatcctgaagccacctctcgatgacgagcgccttacccggcggttcctcagcagcccgcagctgtcgctcaaggcgctcccgctgctctcttcctgcctcccctccgcgccgctctccaccgccgacaggacctggatggacgagtacctcctcgaggccaagcaggcgctcgggtacccgctcgcgccctcggagacgctcggcgaaggcgatgactgccccgcgcgtcatttcgatgtgctgttctacctcgcgttccagcatctggacccctctagcgagcgcacgcggatgcggcacgtacggaacggccactccaggctctggttcctgggtcagtacgttctggagctcgcgttctgcgagttcttcttgcagaggtaccccagggagtcacctgggccgatgagggagcgggtgttcgctctaattgggaagaaagtgttgccccgatggctcaaggcggccagcctgcacaatttggtcttcccctatgatgatttggataagatgatacgaaaggaccgggagccaccgtccaaggctgtattctgggcaatatttggagctatatatttgtgctttggaatgcctgaagtctatcgtgtcctttttgaggcatttgggatggatccagatgatgagagctgtcagccaaaattgcgtcgtcaactagaggatgttgattatgtttcagtggagttcgaaaagaggcagctcacttggcaggatgttgctgcctacaggccgccaccggatgctctttttgctcatcctaggcttttccgagcttgtgtgccaccaggcatgcatcggttcagaggaaatatttgggattttgacagtagacccaaggtcatgactaccctaggatatcccttgcccatgaatgacagaattccagaaatcacagaagcaaggaatatagagcttggacttggtcttcagctgtgttttttgcacccatcaaaacataagtttgagcatccaagattttgttatgagcggcttgaatacgtcggccagaaaattcaggatctagtaatggcagagaggctactcatgaaacacctcgatgcaccaggcaggtggctggcggagaagcatcggaggacgttgatgaacaagtattgtggacggtacctgcgggacaagcacctgcagcactacattatctacggggagacagtgcaagacagattcgaacacaatcgacgtctaaggaatccttcaacgacctctgtccagcaagcgctacatgggcttgcatactgtgtgtatggcaaacctgacgtgcggcgtttgatgttcgaggtgtttgacttcgaacaggtccagcctaaagcagtctgatga

SEQ ID NO: 467 - DNA, 2057 bp, Oryza sativa
cgaccatgtctgcctattccgacaaaggggagggggatttggagattgggttggcgtcgccggaggcggagggagggggtcctggagggccggcgctggacctgtcgccacccagggcggtgaggcggccggggctagtgatgtcccactccgggaagcggctggaccagtcgccggcggcgtcgccgtcgccgtcgcggccggtgctggtgatgtcccactcgagcaaccggctggaccagtcgccggcgcggccggtgctggtgatgtcccgctccagcaaccggctggaccagtccccggcgtcgtcgccggcgtcctccaggggccccgtgctggtgatgtccggctccggtaaccgcctggacagctcgggcccgtccccgtcgccgtcgccgaccgccgcggcggctgctgcgccggtgctggtgctctcgaactccggcaagcggatggaccaggcggggcggaagaagtacgtcaagcaggtgaccggccggcacaacgacacggagctccacctcgccgcgcagcgcggggaccttgaagctgtgcgccagatcatcgctgaaatcaacgcgcagatgaccggcaccggggaggagttcgacagcgaggtcgcggagatccgcgccgccgtcgtgaacgagcccaacgaggtggaggagaccgcgcttctcatcgccgctgagaaggggtttctcgacatcgtcgtcgagctgctcaagcactccgacaaggagagcctcacgaggaagaacaagtccggattcgatgttctacacgttgccgcaaaagaaggccaccgagatattgtgaaggtactcctggatcatgatccatcccttgggaaaacgtttggccaatcaaatgtgacacctctgataactgctgcgattagaggccacattgaggtagtgaaccttctactagagagagtttctgggttggttgagctatcaaaggggaatggaaagaacgccttgcattttgctggccgtcaggggcatgtagaaattgttaaggctttgctggacgcagatcctcagcttgctcggaggactgataagaaaggccagactgctttgcacatggctgtgaaaggaactagtgctgcggttgttagggcactagtgaatgctgatccagctattgtcatgctgcctgacagaaatggcaacttagctttgcatgttgctaccaggaaaaaaagatcagagattgtaaatgagcttctccttcttccagacatgaatgtgaatgcacttactagggatcgcaagactgcgtttgacatagcagagggtcttccactttcggaggaatctgcagagataaaggattgtttgtctcgtgctggtgcagtcagagcaaatgatctaaaccagcctcgagacgagctcagaaaaacagtgaccgagatcaagaaggatgtgcacacacaacttgagcaagcaagaaaaaccaacaaaaatgtttctggcatagcaaaggagctgaggaaactccacagggaaggcatcaacaacgcaaccaattctgtcactgttgtggctgtgctctttgctacggttgcatttgctgcaatcttcactgtgccaggcggtaacgataacaacggcgtggcaatagctgtgcatgccgtatccttcaagatcttcttcatcttcaatgccattgccttgttcacatcattagcagtagtggtggttcagattacacttgttaggggagagactaaagcagagaggcgggtagtagagattatcaataagttgatgtggctggcttctgtgtgcactacagtggcgttcatatcatccgcttatattgtagttgggaagcacttccagtgggcggcgcttctggtgaccctaatcggcggagtgatcatggctggtgtgcttggtacaatgacctactatgtggtgagatccaagcgcacacgttcgatcaggaagaaggtgaaatctacaaggaggagcggctcaaactcatggcagcaaaactcagagttttcagactccgagatagaccggatatacgccatatgatga

SEQ ID NO: 468 - DNA, 1220 bp, Oryza sativa
aacaaccagcgtgctctctcctccgaatccgccgtcgacgatgccatccgccgcggcgggcgacggcaagggtaagcggcggttagtggggatgccgccggcgagggcggcggcggcggacttcgcgatgggcggggcggcggcggtggtggcgaagacgggggcggcgccggtggagcgggtgaagctgctgctgcagaaccaggccgagatgctccgccgcgggagcctcacccgcccctacaggggcatcgccgacgccttcggccgcgtgctccgcgaggagggcgtcgcggcgctctggcgcggcaaccaggccaatgtcatccgatacttccccactcaggcttttaacttcgcattcaagggctacttcaagagcatctttggctacgacaaggagaaagacggaaaatggaaatggttagctggcaatgtagcatctggcagtgctgcaggggctacaacctcatccttgctatatcatctggattatgcacggacaaggctagctactgatgcaattgaatcacagggaagcaaacgtcagttcagtgggctgcttgatgtctacaaaaagacacttaaaactgatggtattcgtggattatatcgaggtttcagtgtgtccattgtgggtatcactctatatcgaggtctctatttcggaatctatgataccatgaagcctcttattctagtgggaccactgcaggaaaatttcttcgccagttttgccttgggctgggcaataactacgttctctggagcctgcgcctatccatttgatacactccgtcgcagaatgatgttaacttctgggcagccattgaaatataagaacgccttccatgcagcaaaacagatagtttctactgaagggttcttcacactattcagaggggtcggcgcaaatattctctcaggaatggcaggagctggagttcttgctgggtatgaccagctccaccggtttgcaggtcaacatggttacaattttgagagcaagatgaaaggggcattgaaatgatgtgcaaatggggataaatagaggcatatccttggttgaagtttggattggccaaatgggatgtatgagcttggataatcaagcgggcgaaacagaactccagatactcctgcagttgataggattgacggcgaagagaacagcttttgcaggatgtatactttcaaggagcggagatgaagtcagaatc

SEQ ID NO: 469 - DNA, 1454 bp, Zea mays
tgatcatggagcatgtgatcggagggaagtataagcttgggaggaagattgggagcggatccttcggagagctatatctcggtgttaatatacagaatggagaggaagtgggaataaaattggagcctgtgaaaacaaaacatccacagctgcactatgaatctaaagtttatatgctgctgcagggtggaaacggtatcccacacctcaagtggtatggtgttgagggggagtacaatgttatggtgatcgatcttcttggcccaagcttggaagatttgtttaattcctgcaacaggaaattttctatgaaaacggtgcttatgcttgctgatcaactgataaaccgagtggaatacatgcattccaagggatttattcatcgtgacatcaagccagacaacttccttataggcttaggtcggaaagctaatcaggtctatatcattgattatgggcttgctaagaaatacaaggaccttcagactcataaacacatcccatacagggagaacaaaaatctgactggaacagcacgttatgctagtgtgaatactcatcttggaatagaacaaagcaggagagatgatctggagtctgttggctatcttctgctatattttttaagaggaagcctcccatggcagggccttaaagctggcactaagaaacaaaagtatgataaaattagtgaaaagaaaatgcttacctcggcagagattctgtgcaaatcttacccgccggagttcgtctcatatttccactattgtcgctccctgcgatttgaagacaggccagattactcttcaatgaagaagctctttcgtgatgtatttatacgggaaggataccaatttgattacgtatttgactggactgcactcaagtaccctcaaatgggctccaacaacaagcttgttcaacaaccaagtgcaagaatggctggagttggaccatcagttgagagaacagacaaagcttccatgggacaagagatccgggataggttcactggtgctgttgaggcattcgccagaagaaatccaggctctgggcgccctgcagatcattccagtcattccaggcacaaaagctttgcagattcctttggaacgtccaacgaagcagttgccgactcatcagagaaaacgcgcatcttgtcccggggagggagctcgtcgaaaatgcccgcagctccgtccacccggccgacctcttcgggggactgcagtgaccagaaccgccggtgggtctccggcagcagtggcggcagcgggcgcccgtcccccgcgcagaggctccaccactcgggaggcgccgagaacagcaggtcgtccccgcgctcccccgtggcccggaacgcggccgggaggggaggctccgcctcgcgggacaacacgacgttccgcagcctcgagcgcctcaccatcaccaccagcaggaggaagtgatga

SEQ ID NO: 470 - DNA, 1037 bp, Sorghum bicolor
tgccaatggactcgcgctgcccccacctactcctgctcctcctggcggcgctcctccccccgccgtcgtcgggggcggcggcggcggcggcgggggtcatccggctgccgacgggagggagagcgggggccgtggcctgcgcgccgccggaccccgccctgtacgaccgtcccgtcatcggcatcgtctcgcacccgggggacggcgcgggcggcaggatcagcaacaccaccgcgacctcctacatcggcgcctcctacgtcaagttcgtcgaggccgccggcgcgcgcgtcatcccgctcgtctacaacgagcccgaggagcgcctcctcgagaaactgagtttgttgaatggagtgctgttcactggtggatcagagaagcaaggtgtatattttgagacgataaaaaaagtgtttcagtatgttttggacaagaatgacgcaggtgaaccatttcctttgtttgcccaatgtcttggctttgagctaataagcatgattgtcagcaaggacaataatatcttggagacgtttgacgcccagaatcaagcatccactcttcagtttcccagctatgctttggagggctcagtgtttcaaaggtttgaccctgccctcataaaaaaagtcagcaccagctgtcttgtcatgcaaaatcatagatatggtatatcaccaaggcgatatcgagagaatgatgcactatcaagtttcttcaaaatcttgactacatcacctgatgaaaacggcaaggtctatgtctcaactgtacaagcctataattatccaatcacttccacgcaatggcatcctgagaaagccatttttgagtggaggaaaccaatgattccacacagcgaagatgcagtacaggttactcaacattttgccaatcattttatcagccaagcacgcaagtctccaaacaggcctcctgccgacaaagtgctggataacttaatttacaactacagcccgacatttagtggaaaaaaatcgaaatcatttgaggaggtctacatctttgcctgatga

SEQ ID NO: 471 - DNA, 815 bp, Sorghum bicolor
cacaaatggacgctcccgcggcggccgagggttccggcaacggcggcaagcacattgtgctggtccacggcgcgtgcctgggcggctggtcctggttcaaggtggccaccccgctgcgcgcggcggggtaccgcgtggacacgccggacctggcggcgtcgggcgtggacccgcggccgctgcgtgaggtgcccacgttccgggactacacccagccactgctggacctcctggcgtcgctgccggagggccaccgcgtggtgctcgtcggccacagcctcggcggcgtcaacgtggccctggccgccgagacgttcccggacaaggtcgccgccgtggtgttcctctgcgccttcatgcccgactgcacggcgcggccgtcgcacgtgatggaaaagttcgtggagggcaagtggctggactggatggacacggagatgaagccccaggacgccgagggcaagctccccatgtctatgatgttcggcccccggatcatccgagaaaagttctttcagctctgcgagcccgaggacatcacgctcgcggcatctctaatgagggtgagctcgatgtttgtggaggatcttgtcctccagcaaccctacaccaaggaaaggtacgggtcggtgcgcaaggtgtacatcgtgtgcagggaggaccacgccatcgtggaaaagttccagcgctggatggtggagaacaaccctgtggacgaggtgaaggagatcgtggcggaccacgtcgttatgctctccaggcccgacgagctggtgcgctgcctcaccgacatcgccaacaagtacgcttgatga

SEQ ID NO: 472 - DNA, 4481 bp, Sorghum bicolor
gcacatacgcagctacctcacgtttgctagctagtagctgcatttggtccatgccctaggcgcagctggtgctccatccatggcgacggcggcggcaccggtggcggcaacggtgaatgggatggccgttgatcgggtggtgttcgccctgaacgggcagcggtatgaagtggccggagtcgacccgtcgacgaggctgctggagttcatccgcacccagacgcccttcaggggccccaagttcggctgcggcgaaggaggttgtggggcttgtgttgtccttatagcaaagtataacccagagacagatgaagtgactgaatttactgcaagttcatgcctgacacttctctacaatatcaatttctgttcaattatcactactgagggtctagggaattcccgagatggctttcattctgttcaggaaaggatgtctgggtttcatgcctctcagtgtggcttctgcactcctggaatgtgcatgtctattttcacttcccttatcaatgctgataaatccaagaggcctgaaccaccaaatgggttctcaaaactaaaagtatcagaagcagaaaaggctttctctggcaacttgtgcagatgcactggttaccgtccaattattgatgcttgcaaaagttttgcatcagatgttgacttggaggatttgggacttaatatattctggaagaaaggtgataggaaaccagatgttagtgacttgccacattacactcttggtggcggagtctgcaccttcccagactttctaaaagctgagctaaaatcatcgcttgatcacctgaataatccttgtattgcagactccagggagggttggtatcatccaaggagtatcaaagagtattatgagttaataaattcttgtttttttagtgactcagtcaaagtggttgttggcaatactagtagtggtgtaccaggatacaaggatcaagacctctataataagtatattgacataggagggattccagaactatcaaatattgtaaggagggagtctggctttgaaattggagcagctacaccaatcgctaggaccattgagatacttgaggaagaatgtgaatctatatcctctccaaacggaagtgtggttttcagaaaacttgcgaaccacatgagcaaagttgctacaccttttgttcgtaacacagctagtattggaggaaacatagttttggcacaaaaatacccatttccatcagatattgcaaccatactccttggtgctggtgcaactgtttgtcttcaggtagttgcagaacggagacaaattactttggaagagttcctagagcagcctcctatagaggcgactactttactcctgagcatatttattccacattggattccagattctgggacaaaaacaagtttgttatttgaaacttacagagcagcgcctcgtcctcttggcaatgctgtttcatatgtaaattgtgctttcttggggcatgcttctgtggatgaacaatcagatactcttgtattgagtaatctgcgcttggcttttggtgcatatggaacagaacatgctattagagcaaagaaggtggaggacttccttactggcaaatcactcactgcatcggttgtacttggtgcaattcaattacttagagaaaccgttgtaccaatggagggaacatcacatcctgaatatagagtcagtgcagctattggatttctcttcagttttctatctccgctttctaaaggcatcccagagcctggaaagtctctgaccagtagttctgctgattcagcagttacagatgatgtctgtaacatgccattatcaacacgtcgagaaacagttttcagtgatgaatataaaccagtcggcgagccgattaagaaatatggtgttgaacttcaagcttcaggggaggcagtatatgtggatgatattcctgctcctaagaattgcctctatggagaatttatttacagcacacaaccccttgcttatgtcaaaagtataaaattcaaatcttctttagcatcagagaagatcgtctcttttgtttctgcaaaggatattccaagtggaggacaaaatattggatcatccttctcgtatggtgacgaaccactatttggtgatccagttgctgagtatgctggtcaagcacttggcattgtgattgcagaaacacagaggtatgctgacatggcagccaagcaggttattattgaatatgacacaaaggatttgggcccaccgatcataactgtggaacaagcagtggaaaacagtagctattttgaaattccaccagaaatgtatcctaaagaagttggtgatgtttccaagggcatggcagaagctgatcacaggattccctcaactgaagtaaagcttgcctctgagtactacttctacatggaaacacagacagcactagcagttccagatgaggataacactttggtagtttacagttcgtcgcaataccctgaacttgcacaaagtgtgatagcaaggtgcctaggcattccattcagcagtgtgcgtgtcattacaaggagggttggaggtggcttcggtggaaaggcatatagatcattccaagttgcaactgcagctgcgctttgtgcatacaagttacgacgtcctgtacgaatgtaccttaatcgcaacactgatatggttatggttggtggtagacacccagtgaaagctcattattccgttggattcaagtctgatgggaaaattacagccttgcatctagatttattaattaatgctgggatatctccagatgcaagccccattataccagatgctattatatctagtgtcaaaaagtacaactggggtgctctgtcatttgatatcaagctctgcaaaacaaatatttcatctaaatctgtaatgcgtgctcctggagatacacaaggctctctaattgcagatgctgtaattgagcatgtcgcgtctgccctttcactggatgctaacagtgtgagggaaaagaattttcacacttatggtactcttcagttgttttacccagatagtgcaggcgaagcttctacgtacacattgcattctatttttgataggttgatctcaacttcaagctacctggatcgagctgagtccataaaggaatttaacagtaacaacaagtggcggaaacggggcatctcttgtgtgccactcattttcaaagttgatccgagggcagcccctggaagagtttccgtgctcaatgatggctccatagtggtggaggttggaggaattgaaatcgggcaaggactgtggactaaagtacagcagatgactgcctttgctctgggaaaattgtggcctgatgggggtgaaagtcttcttgagagagtgcgtgttctacaagctgacaccttgaacttaatacaaggcggacttactgctggcagcactagttctgaatctagttgtgcagcaactcttcaggcatgtaatatgctgattggcagattgaaaccagtcttcgataggctgcagcagcaatcagaaaatgtctcgtgggatacattgatttctcaggcttctaaagacaatgttaatttatctgcgagcacgtactgggtacctggtaaagtttctaataagtacctgaactatggagctggtataagtgaggtggagattgatcttcttacaggagcaattactttactaaggggtgatcttgtgtacgactgtgggaagagcatgaaccctgctgtggacttaggacagattgaaggttcctttataaagggaattgggtttttcgtatatgaagagtatcttacaaacagtgatggcctcatgattagcaacagcacatgggactacaagatcccaactgtcgacataatcccaaaacagttcaatgctgaggtgctgaacactggatacaataagaaccgtgtgctttcttccaaagctgctggtgaacctgccttggttcttgcctcatccgttcattgtgcactgagagaagctatccgagcagcgagaatggagtttgcaaacagcactgtatctggacgctcaccgctggaattcaagatggatgtccctgcaccaatgacgctggtgaaacaactatgtggtttagatattgtggagaagtacctagaaagtctatctacctagaaaggagtggtatcatctttgttgttgttgtttgcaataaaacagaaaggaggaaggaggatttccatttccctcaatggaaatagggtttcctcgtgtggaaaggaaggagggaggtgttaaattagcacaatatttgaataatgctttcaaccatctgtattcatatgactcttaagaccaaccacctttctctcattgacatgaacattgggttgtatatcagatgcataaccagcaggaaactttaccacttttagcacttgacaaaataactttttctcatcaggacacactgaatatggtgcag

SEQ ID NO: 473 - DNA, 883 bp, Sorghum bicolor
cgtgtactacttcgtgatattggtggttgattccgtgatgagaaatccaacgagactcgagcccctcgatgagtcgatccctcagatttctctccggggctcgaattttccactggggcgagatttccggagatcttgagtcgcttcgcctactgcccaccgtgaggcgcagcgaataacattctccaagatttgcccgcaaaaaagttcttccagatttctgtccgtatatttttgtttattgtgcgttttccggttgttctgtgagccccgtgatggcacaatctttgagacctgagattttcttccttgatgaatttcaaaagcatgattactgagggccacagattcgatcaccttttcttactccttttcgtcagagcctagttgttttacttgatcgtgttgtggatgatgaaatgcactgggctccgagcagtgaaatttgctgtgttttgacggagatgcacttgcctagaaagcattgtctgacatgcacagtatagtcttatagtctagtaacatatcattgccctgatgagtcattgaagaaggctgcattgtaccaagattggggctcagtttctttaccctcgtcttgaatttgccgattcggctgtagccaaattaacgaggaagaaaaactggtcggcttgcccttattcagtgggttatccgcttaccgatcttcccatatgccatcaaatcaagctttttcttcactttgctattaaaacgaggtgatagtggaggggcatggcgtatgctgtagccattcttgtagaacacctcgaacagcaagttcctgccgctgtctttctcatacttttgatttctagtgatccttctccgcgggcgttttaaatcactggaggaagacgtg

SEQ ID NO: 474 - protein, 266 aa, Hordeum vulgare
MALHAVSPAAAAPPPRALSSARLPQRPGCGCLSNRSSLLSSPTNFMKIQSGAVGFFGVPLVLQHSDKRAVLRHATNEEIEEEKTIVEEQAKEKMEKAIETVQSNFNTVRTGRANPSMLDRIEVEYYGTPVNLKTIAQVNTPDATSLLIQPYDKSCLKLIEKAIVAANIGVTPSNDGEVIRVTVPPLTSDRRKEMTKTVAKLSEEGKVAIRNIRRDAIKAYDKLEKEKKLSEDNVKDLSADLQKITDEYMKKVEAIQKQKEQELSKV

SEQ ID NO: 475 - protein, 333 aa, Hordeum vulgare
MAGIRWPPEDPEMFPTRMLGTGVWGGPPAAPGEAASDDDRSVAADSWSIKSDYGSTLDDEQRYADTAEVLLASSSSSAASAAAPSACSSSLSAHHSSDFSFDKDVPDVVPPMLGLHNYQDGAFAEDLANYHERSHADDWFGTEAMDVLVGWTKNLCSSKDLSGCSVLDIGTGSGRLLQQLAKQGFSDLTGIDYSEAAIELARNLAIRDGFEHINFLVDDVLESKLERRFELVMDEGTLDAIGLHPDGPVKRMMYWQSVASLVSPGGILVITSCSRTKDELVQEVENFNQRKLGATLSEGALTSDAVVFKYLDHVQAYPNVDGVCIATVAFLHT

SEQ ID NO: 476 - protein, 278 aa, Hordeum vulgare
MGMGTTVLPVAHKLSLASPFLPRHRRPCRPPAQQHCRRRRHGAVVAYMEPDPNSPAAILGRIVGALPVVGLVARILSDDGGVGGDTVDFAEFRRRVSKKCTVMDSQAFYDFNDRRGKVGDPFYVLLCCWLAAIGAGLLKTEEILEGVARLRMSNDIQYEEETFLDMMKIAREKRAKSKSQAPVIPMEVRAEKALEAIYVCCFGQEMVEPEDEKLLCTMLNAVFPSVGRPAVERMVSTMAKQVASGERRGPDTKVVSKEVAQRQLKDLEFLQQNKLDSV

SEQ ID NO: 477 - protein, 367 aa, Hordeum vulgare
MSAASRDAPVPPAMPDLVRDHLYFGDINDAIAALTASLPDGTDITHVLSVVSSASISFFTDYRPGLCLPTEEVRRVVAGEDGTPSVVAPGRLVRVVERTGEGLRVTRMAVPLKDTEEENLLDHLEPCLDFIDEGRKAGSVLVHCFAGVSRSATIITAYLMRTEQKSLEEALQSLKEINESVCPNDGFLDQLKLFEEMGFKVDTSSPLYRRFRLKLLGQSYRVGEKIGNHVFEDDPGVTRQPNPTEELSGKGKTPKTAYRCKKCRRIVAAQDNVIGHTPGEGNSSFEWHDKRKGHTHNKEQQDCSSLYVEPLKWMTPVEDGALEGKLSCIHCGARLGYFNWSGIQCNCGSWITPAFQISKSKVDVSTI

SEQ ID NO: 478 - protein, 263 aa, Hordeum vulgare
MEGGGMDQVCMAAMTNQPSVSDNKLMKNISGEMPATATAGSGSFDCNICLDFAADPVVTLCGHLYCWPCIYEWLRPSVVSATSGNNTSARQQCPVCKAALSADSLVPLYGRGGSSKKSLDGTAIPRRPTVHRENVAQQHAQTSIDDLHHQNMEPSPPLRPLRHAHHHHHPGATEFDFVYPPSPMGRGLIHSTAGGVLGGMAEAVLPWAFRGQVPPSMYYTSPYAVADHTVGPRLRRQQMEVERSLHQIWFFLFVFVVLCLLLF

SEQ ID NO: 479 - protein, 433 aa, Hordeum vulgare
MAPLTPRLVVPIDVKKKPWEQKVRLHNRWHPDIPPVADVTEGELFRVEMVDWTGGRVRDDDSADDIKFLDLTITHYLSGPLRIVDAEGVPASPGDLLAVEICNLGPLPGDEWGYTGIFERENGGGFLTDHFPSARKAIWYFEGIYAYSPQIPGVRFPGLTHPGIVGTAPSAELLNIWNERERKLAETGHESLKLCEVLHQRPLANLPTSDNCLLGKIQEGTAEWQKIANEAARTIPGRENGGNCDIKNLSRGSKVYLPVFVDGANLSTGDMHFSQGDGEVSFCGAIEMSGFLELKCEIIRGGMKEYLTPVGPTALHVNPIFEIGPVEPRFSEWLVFEGISVDESGKQHFLDASVAYKRAVLNAIEYLSRFGYSKEQVYLLLSCCPCEGRISGIVDAPNAVATLAIPTAIFDQDIKPKRLGHGPKLRRLPDVLR

SEQ ID NO: 480 - protein, 504 aa, Hordeum vulgare
MKPKVAGAAAAGEKGRGVDPSLPRFKCQECHRALVVVGVESFPDRLPAHANSGMHASSVQGSIMGASRMDSSYVVLSKQNRPQGPGIPPRPPSAAARHVEPNQSTRAMEGSYIMLPPAAASIYKTSTSEGGGAHLSPPNLNSTSPSPGNNSGFHSSVTVLKRAFEIASSQTQVEQPLCLECMRVLSDKMDKEIEDVNTDIKAYDACLQRLEQESYNILSETDFLKEKEKIEEEEKKLKAAIEEAEKQYSEVSSEMKDLETKSKQFEELEERYWHEFNSFQFQLTSHQEERDAVMAKIEVSQVHLELLKRTNVLNDAFYISHDGVIGTINSFRLGRLPNVQVEWDEINAAWGQAALLLHTMAQYFPKFQYRIKIHPMGSYPRVTDINSNTYELFGPVNLFWSTRFDKAMTWFLTCLQEFSEFAISLDKENNVPAEKSLKLPYKIDGDKVGSYTIFLSFNKLENWTKALKYMLCNLKWVLYWFIGNTSFAPPSASLYLAQSPNKKG

SEQ ID NO: 481 - protein, 107 aa, Hordeum vulgare
MDTSAPSPFVNGEILKMFLGRRVRTVVQVQHNEGGVLLGLSTDGHQLTIRGAPGAPEPPHYIEVIGIADSSLSIRAESCTDFGENFDGVAFNGLCKLANDKYKYMFL

SEQ ID NO: 482 - protein, 440 aa, Hordeum vulgare
MDEGLVSVDKFSGGSQVYFLTHLHLDHTRGLGASGGWRHGPLYCSPATARLLPIRFPGVDASLLRPVAAGASASLSLSSPNSGRPVSIHVTALPALHCPGSLMFLFRSDIGCMLYTGDFRWELGCDKARSAKKALLDALAGDTVDVLYLDNTYCHPSLNFPPRHVVAQQIVDIIRAHPDHEFILGIDTLGKEDLLLYIARALQTKIWVWPQRLLTIHLLGIDNNEEIFTTQTSLTRIRAVPRYALSIESLEALNTVCPTIGIMPSGSPWLWRNSEGKAKFSDKAPAKSSRCKGRGRGAGAIEMNYDPLSPPKLFEKDSYTLPYSDHACFLELEDFMQTVRPSAVVGIVRTSYCYVNPRGHFGHLCADEDEACTDNTPKQSYNDEKENSPPKRRPSALKTPRRRMVKISSPTLYRSRAIMMKRRHSCGAKIEEPEETIPFS

SEQ ID NO: 483 - protein, 303 aa, Hordeum vulgare
MLSLARRPLSAAVPAGNLLGIHLFQCPDAVGIVAKLSECIASRGGNIHSVDVFVPDDAPVFYARSEFTYNPRLWPRDVLRTDFLHLSDCFNAQKSTVRVPDIDPKYKIAVLASKQDHCLFDLLHRWQEGRLPVDIHCVISNHDRPVDNHVMRFLQRHEIPYHYLPTTSGNKREQEILELIEGTDFVVLARYMQVMSESFLKAYGKDIINIHHGLLPSFKGGSPSRQAFNAGVKLIGATSHFVTPELDAGPIIEQMVERVSHRDTLHSFVVKSENLEKQCLAEAIKSYCELRVLPYEVMKTVVF

SEQ ID NO: 484 - protein, 581 aa, Hordeum vulgare
MYRAAAAAISRSSSSALRRHLARGGGGGGEQRQWARGYAAKEVTFGVGARAAMLRGVNDLADAVKVTMGPKGRNVVIERPNRSPKVTKDGVTVAKSIEFEDSAKNVGASLVKQVADATNKAAGDGTTCATVLTQAILTEGCKAVAAGVNVMDLRNGINKAISAVTAHLKSKAWMIDSPDEINQVATISANGEKEIGDLISKAMGIVGKDGVITIADGKTLDNELEAVQGMKLTRGYISPYFVTDQKTQKCELKNPLILIHDKKISSMNSLLPALQISIQNNRPLLIFAEDVEGEALSMLVLNKHRAGLKICAVKAPGFGENRRANLDDMAILTGGQVISEEQGLDLDKVELQMLGTAKKVTVSLDDTIILDGGGERQQIEERCQQLRESLENNTAMFDKEKAQERLSKLSGGVAVLKIGGASEAEVGEKKDRVTDALNAARAAVEEGIVPGGGVALLYAAKELDQISTSHEDERIGVQIIKNALKAPLMTIAANAGVDGAIVIGKLLEQDNLSLGYDAAKGEYVDMIKAGIIDPVKVIRTALQDAASVSLLMTTTEAAVAELPSTKARIASRMPDMSGMGF

SEQ ID NO: 485 - protein, 391 aa, Hordeum vulgare
MRGSRWCCCCFGRGGGGAGRSGSVADDGLVWDVGLKAHASGEYSVAVAQANEALEDQAQVLVSPASTLVGVYDGHGGPDAARFVNARLFSLIQELASQSGGLSAQVIKRAFGATEEEFMGMVEKSWPSQPRLMSVGSCCLVGAIEDGTLHVANLGDSRAVLGRLASTAGKKRRARAVVAERLSRDHNVADEEVRREVAEAHPDDPHIVMSSHGVWRIKGIIQVSRSIGDAYLKRPDLCSPAVMQSLCPFPLRRPVMSAVPSVTSRRLRPGDQFIIFASDGLWEQLSDDAAVGIVSRSPRKGVAMRLVRAAQLEAARKKDMRYESIAAIEKGRRRRFHDDITVVVLFLDNRCEGTPQSTVGAGEIDGTRAPVDVFSLGPDDHGDDPTRPVLR

SEQ ID NO: 486 - protein, 278 aa, Hordeum vulgare
MEPHHPRRAPTAAMEPPTPAGARPAMSHSSAFLLPSSATPAGSGDAYAVVVLNQRLPRFAPLLWDRAQVRVCADGGANRVFDGMPELLPGHAPDDVRSRYKPDVIKGDMDSVRPEVKEYYSNLGTKIVDQSHDQDTTDLHKCVAFITDKSPGPDKSNLCILVLGALGGRFDHEMGNINVLHLFPNIKIVLLSDDCLIFLLPRTHSHNIHIERSVEGPHCGLIPIGTPSTSTTTTGLRWNLDNAHMSFGGLISTSNIVDEDQVMVTSDSDLIWTISLRH

SEQ ID NO: 487 - protein, 1796 aa, Hordeum vulgare
MGSPEGRLVELLGTVKSRMPRRGEHSPPPAPKAAAADVPQPHDLSRDFWMPDQSCRVCYDCDAQFTILNRRHHCRHCGRVFCARCTANSVPRSLGDATREDIERIRVCNYCFKRWLEEEAVTPRDVAQPSGLSHSATSAGSEKSCSTGRSSTVTSDQMLSYANACCTDSASRSVGSEGNCGELDASLELQHAAMEGVEHVAYVDNSPDPFNFCLNRSDDEDDDYTIFRSDSEVHHLQNSGGPMCFDDHQVVCSDAAKGSVSPRKDTATLVNSEGMCKTGDHHIIDNAEDCNARSSSLYGMEVLENELVDFENNSSLWLPPEAEDEEDDHDGAPFDDDEGEDATGEWGYLRSNSFSGHCRSRDKSTEEHKKAMKDIVDGHFRALVAQLLQAEKVELADKIGNESWLDIVTSLSWEAASLLRPDTSKGGRMDPGGYVKVKCLACGRPSDSLVVRGVVCKKNVAHRRMSTKKEKPRILILGGALEYQRVSNLLSSFDTLLQQETDYLKMAVVKIKAHQPSVVLVEKSVSRYAQDLFLEKNISLVLNIKRPLLERISRCTGAHIVPSIDYLSSQKLGNCDLFHVEKYIEEHGTAGEGGKKMLKTLMFFEGCPKPLGFTILLKGANGDELKKVKHVVQYGVFAAYHLALETSFLVDEGATLPELPLKSPIIVALPDKPSSADRSISTIPILQMPTISSPNNNLQAFDIQKDDFTFSGFRIMDQTAAASFPDNKCCERLGVTQASSVQINDQTGNIGCLLGMNPQSYNDPLVQQLRISFCHCPACTRDVGSKMKFEELQPETNRHTLANGLSVLPAHPANLVAAESDLSFAHNANNGAKVAAKPSAPLNLQVSYNNGSSNDGSIVKRDEIPASPADNQSILVSLSSRSVWKEAICERPHLLRIKYYGNFDKPLGRFLRDQLFDQSNRCLSCELAPEAHVYCYVHPQGSLTISVRKLIVKLPGEHDGKIWMWHRCLRCSRDKGLPPSTKRVVMSDAAWGLSFGKFLELSFSNHAAASRVASCGHSLHRDCLRFYGFGEMVACFRYASIKVHSVYLPPPKLDFTSQHQEWVEQEANEVVDSAELLFTEVLNALHQISEKRPITGSFDGNMKILELRQNIVELEDILQAEKVDFTESLKNLLKKEIRKGQLFIDILEVNKLRRQLLFLCYLWDQRLSFIATSGGKYCDALGGLRVGSNNSEINDRSADSDTNTKLVKNSKGTDSNALHADDEEINQHDQSNETNSRNTEELNGAEGTIAKLNHANSVNVNDHLDHQGSIIGVRRVSSEGQFRVATDISDKLDAKWRGEDRPAPDASLVKPLALLEGTAADVKKQAKAVPRHTSASVRSGDTVEDLLSCLKMPYMTFYNSLNTNSGTAPTFGTLADYNPVYISLFRDLSQQGGARLFLPTGANDVVIPVFDDEPTSIISYALVSPVYHFQMSVESNQNKDSGDSSLSLPVYDSGNFNLFHLFEDFGSSDDFASSISSSRGSFARDLLHSRVSFQDGGPLGKVKYTVTCYYAKNFEELRRSCCPSELDYLRSISRCKKWGAQGGKSNVFFAKSLDDRFIIKQVTKTELESFLQFGPDYFKYLSESVSTGSPTCLAKILGIYQVTIKHLKGGKESKMDLLVMENLLFGRNITRLYDLKGSSRSRYNADSSRNKVLLDQNLIEAMPTSPIFVGNKAKRLLERAVWNDTSFLAGIDVMDYSLLVGVDEEKHELVLGIIDFMRQYTWDKHLETWVKSSGILGGPKNAAPTVVSPMQYKKRFRKAMSAYFIVIPEQWMPAIINPDQSSSNICEDDSQNASPE

SEQ ID NO: 488 - protein, 344 aa, Hordeum vulgare
MDRLLLPVRVKEEWPPPPPPEEEEEELEEHRGLAPRPMVGLHETGPPPFLTKTFDLVADPATDGVVSWGRGGNSFVVWDPHLFAAVLLPRFFKHSNFSSFVRQLNTYGFRKIDPDRWEFANEGFIRGQRQLLKMIKRRRPLSYLPSSQQQALGSCLEVGQFGFDDEIEVLKRDKNALLSEVVKLRQEQQSTRADMRAMEERLHRAEQKQLQMMGFLARAIQNPDFFLQLVQQQDKLKDLEDPYPTKRRRSINVMPFLGPEGTSQSEQLESTFIFEDREFSELENLAMNIQGIRKGMEDDKGGRSQGCGEAELTDDFWEELLSEGMRDEAEMLELERRRSRYVDA

SEQ ID NO: 489 - protein, 296 aa, Hordeum vulgare
MGDIAKDLTAGTVGGIANLVVGHPFDTIKVKLQSQPSPAPGQLPKYAGAFDAVKQTVAAEGPRGLYKGMGAPLATVAAFNALLFTVRGQMEALLRSEPGVPLTVKQQVVAGAGAGLAVSFLACPTELIKCRLQAQSSLAEAGAVSGVALPKGPMDVARHVIRDAGFKGLFKGIVPTMGREIPGNAIMFGVYEAVKQYMAGGRDTSGLGQGSLILAGGLAGGALWLTVYPTDVVKSVIQVDDYKKPRYSGSIDAVKKIVAADGVKGLYKGFGPAMARSVPANAATFVAYEITRSAMG

SEQ ID NO: 490 - protein, 392 aa, Hordeum vulgare
MEALHEETPFDLSFHPSSPLVATSLITGELHMFRYADGLPLERLFAEKPHKDSCRAVRFVDSGTVILTGSADMSIVASDVETGKVIARLDDAHGDAINRLVCLTETTVASGDDAGCIKVWDTRQRSCCNTFHRHEDYISDMTYVAGSDQILATSGDGTLSVNSLRGNRVKSQSEFSEDELLSLVIMKNGQKVVCGTPSGALLLYSWGHFKDCSDRFLGHAQSVDNLLKLDEETLISAAADGVIRLVGILPNQIIQPLAEHSEFPIEALGFSHDRKYLGSVSHDKMIKLWDMEELLGGPQLNHQNDMPEATAVAVDHDDELPEANAANAVQHEELPEANVAAVDDDQLTAQADSDDDGMDVDMEPSSSNGSRSKKKGKGKKLNGFAPDFFADL

SEQ ID NO: 491 - protein, 630 aa, Hordeum vulgare
MADPVELVRRLCLRFPPRLPPPRRSRVPPPQSRCLVRARLRLQRSPLSLRCRALDASKSSAVKGEPSEEYDDDDEEPYFSVTSSRLSEVDYLGESTKGDLNVRRRHLDALGGNGKSTLHGPIEEIAWKEARQAETLLSDLGIADPLTVRNSPRGIFCTRTLNLRSISVIGYDMDYTLIHYNVMAWEGRAYDYGMANLKSMGFLVDDLEFDPDLVIRGLIMDKVKGNLVKADRFGYIKRVMHGTQMLPTRAVSEIYGRELVDLRKEDTWEFLNTLFSVSEAVMFMQMVDKLDQGLVPAELGPLDYKGLYNAVSKALFRAHVEGQLKSEIMAEPERFVEPDPELPLALLDQKEAGKRLLLITNSDYHYTNKMMNHAFNRFLPNDMGWRDLFEMVIVSARKPEFFQISHPLYQVVTDDGLLRPCFKANSGGLYSGGCAQMVEKSLDIHGDEILYVGDHIFTDVSQSKVHLRWRTALICRELEDEFDALIQSHGQKEKLVTLIQQKEIVGDLFNQLRLALQRRINSRPAQTLAATCMNDQELTESMQKLLIVMQRLDEKIVPLLESDGELFNKRWGWLSRAGLWDKSHLTRQIEKYADIYTSRVSNFLHYTPFMYFRSQEQTLAHDVHSYSRGQ

SEQ ID NO: 492 - protein, 191 aa, Hordeum vulgare
METLVISQQRSHHHHHSGRRRKPSPHYSSPQPMRGYHAFNCRAFHSSISIGILPSPPPPPAPPAPRARTYSPEPKTPKQQLHNGKKRSRAIPITPSGSPPSRPELWAGPAYSNSPPPSSLPIPKFSLHQKRSVSLELPPADRTEHVEVLVHAKSAPSTPTAGSGFGFFGENDTAIATENLRRILNLEITED

SEQ ID NO: 493 - protein, 267 aa, Hordeum vulgare
MPRRSQSSDPIDLDEEDECKSKRSRASIRRAPKMPGSSNRIASSRRDKENQDKLDTRIFDLYMEDLWKRTDEDQKNAYAYLDPLWFNSYVNGGNEQKSRILRWTKKLKIFSRKYVFVPIVLWGHWNLLVLCHFDETDCSDAKKGPRMLLLDSLNTTDPKRLGPDIRGFIRGIYEIEERKESAHFIEKIRLEFPKVPQQNGEECGIYVLYFINCFLQNGKLAEVLQNKTLEEDFKQLFDDGTFDPEELENFRKDVHAFQVERSTETGQ

SEQ ID NO: 494 - protein, 500 aa, Hordeum vulgare
MASPPCPPSPLARVRLDDVAPHDGAAAPGYARAVAALAASLARRGAAVLELPAADAAVVRCALESARAFFRGRHAAYLYRAGRTLEDGELSPACMADAFRCLGKAARAALCAIARHLRLRTDVFNQLLDDTPLPVNEISSSELLVSYSHEQLQSGQALMGCPSRSSMPQVDRGFVMLVASDCPGIEVCDPNGHWYIADGVSGPNNLLLLTGRALNHVTAGLCPISHYRVTNENRASLTFRLVPHANAILDCSPILAAGHCIRQVYQPIPASQFMDDSCAEEHAVSSHLDEPSESQGNFVSDPSLRSVLSDPLSGSFLEDAMVLQCGHSFGGLMLKKVIEMARCTICNGEVDPSSLFPNLALRAVATVVKMEDDRRLFHNAALRKRRKDVTEHTDVPKRTGSSKDNNELALDAGSPVAFKGVQYPFVVGERVLIMGNKRTPDKFVGKEAVITSQCLNGWYLVKALDSGESTRLQYRSLKKVSELQLQTQARLQPLAFLGGR

SEQ ID NO: 495 - protein, 326 aa, Hordeum vulgare
MLEAWRMRRLMERELDKRSNDWSARLARFQAEQQRLRDRVMELAEQNVSFQREVTLFESNRVEASNKIRSLELQNKQLNDEMDKVKGEHTSLYRSSVELHDSFTKAAEERDQIQECLKSKEDNSRALHKVIARLQGASNEQEKTINGLRQGFSVELGNRSVGSSESITRMQMELLRLTGVQQKLRKEIQSCNLEVESLQQENIGISNRLQSSGNGLSLSSHRLVLELHARVDNLHMQGLSLLEDTSCLCGKLLGVMKSKSETIGSVDALADIEYTVKYQNLRQGIDYLALSLRKVKSVLVEKHNKEDNIVGVSVGHDTLYVIAVLE

SEQ ID NO: 496 - protein, 98 aa, Hordeum vulgare
ESMVEYLATAVPDEPSSPAEERASASNTHCISPRFLKHLERRRAGFVARLNRAMRDRWSDAAVDAALGAPARPVCAAYLAAATETGGQRPVVGSAVAG

SEQ ID NO: 497 - protein, 218 aa, Hordeum vulgare
MRPPSSSSSIVAAAATAPSSSTAPPVAVTTRRALLFSTSFIALAPAAAAQAANPSSTPYSQSRTLQIGLDTNGKIRTCPSTNPGCVCTNPTVGASSSVASPLIIPESTSADAAAQLLRQAILKTQKNVSFNVDQQTPNGQYIQAEVDGGFGRDVMEFLVKKDAGVVAYRCVATKVTFVYPFTTAVGDSRGQEQRVAAVAQELGWYAPDIRSSVDDVAT

SEQ ID NO: 498 - protein, 260 aa, Hordeum vulgare
MSSAGSARIPKRRRTTKASEAADRQLREGQFPDLNLLPVVEALNTGGSLSINEPVSHRQPPPMVVSLGYETTQVVVSSAAAGSNIGMNSFPINVEVIDDDVAIYTSGPPPQARQQSSRTGPITVIIDDDSETTAGPAGEALDEHVNTLLSLGMNPRHNPSRAQPNTDLVINIVDIPETNNTPPKVAQAAPEPVKEIPKETKFSCPVCMNELVNASSTICGHIFCQKCIKASIQAQKKCPTCRRKLTISNFHRVYLPMADN

SEQ ID NO: 499 - protein, 247 aa, Hordeum vulgare
MESEGSTSANGGAACAVCGGSAALYCPADAAALCVPCDAAVHSANPLASRHERVPLAAAVAVAATSGVYDGLFAADDEGAASWPTPVQGSPNSGSSGFSNGSGVEVSLFDLLSDVDLVATGAGGSVSSDGGVAPLWLQPGLVSAAWNSSWSASEAVVVPSPADRAARVMRYREKRKNRKFHKTIRYASRKAYAEARPRVKGRFVKRPAAAATDDGNTSAAEAAKFWLSFSDNSVGFHVASHGVVPSF

SEQ ID NO: 500 - protein, 142 aa, Hordeum vulgare
MEAKKSPPTPASTGSAAAGNGYFSSVFSASPAANPRDARQMDLYTMLNKQNPKGQSGGGTADGKSQGSPAKGRVAYKDGKQFYPNESSESPYFGSSVHYGGRDFYDSSPHKQANESSRNYKEDNTDGSLATRGDWWQGSLYY

SEQ ID NO: 501 - protein, 211 aa, Unknown
  Sequence found in Organisms: Hordeum vulgare, Pseudoroegneria spicata
MATAMMAAATTSCSPRRALLKPVASSSSAPPPRPQPRSFLKQLPGLAATAAAAAVASVPLPALAVEMEKAALFDFNLTLPAITIEFLLLMVALDKLYFSPLGKFMDERDAKIRAELGGVKDASEEVRQLEEQAQAILKAARAEIAAALNKMKKETTKELEAKLDEGRRRVEAELVEALASLEGQKEEAIKALDAQIVSLSDEIVKKVLPSA

SEQ ID NO: 502 - protein, 310 aa, Hordeum vulgare
MSPSTLLVRPPAPANPSLPPRRCAPVSAAAATLRTSPAASSVAHFSRLRTKCRFAAPGVREDYSSTPIDVVADVKTEKIVVLGGSGFVGSAICRAAVAKGIEVVSLSRSGRPSYSDPWADEVTWLAGDVFYARWEDVLVGATAVVSTLGGFGNEEQMKRINGEANAIAVDAAKEFGIPKFILISVHDYNLPSFLLTSGYFTGKRKAESEVLSKYPSSGVVLRPGFIYGKRKVDGYEIPLDIVGQPLEKLLSSVENFTKPLSALPGSDLVLAPPVNVEDVAYAVINAVIDDSFFGVFTIEQIKEAAASARV

SEQ ID NO: 503 - protein, 481 aa, Hordeum vulgare
MGDYGNAMMRNQDAGVQTRVKAQSRANLLQLKLIGQSHPTGLTTNLLKLFEPRPPLEHKPPLEKRKLPAYTGMSQFVSRFAEPGDPEYAPPVPTCETRAEKKDRIRQLKLEEGAAKVAEELQKYDPQNDPNVTGDPYKTLFVARLGYETSEQKVKRDFEAYGPIKRVRLITDQVTNKPRGYAFVEYAHTRDMKSAYKQADGRKVDNKRVLVDVERGRTVPNWRPRRLGGGLGSSRIGGEDAAQKHSAREQQNAAGRPRSEEPRRDDRSADRDREKSRDRVRERDRDEKTRERSHDRARDRDPREDRHHHRDRERTRDRDRERDQERDRGRDRRDRDRHKDHGRDRDQDRDRKRERSHGRGRDRDRDYERASHEQDPGRDRDYKRARHEHERGHLQASDADYGNGEPGYNQHEHHRSHEQYGYGLDGHDRSKRHEHYRDDSHSKMATNHQGQPENAEPAVPEEGEAYEEGDYQHIQAGEYRN

SEQ ID NO: 504 - protein, 109 aa, Hordeum vulgare
MAGLQRSSLTFRRSGSSGMVWGERLMSDEHSQWTSGEPEFRELRHSRSVGSVGAQRRRNDGTEHGGQAFRTRRVAPAIDPPSPKVPGCIFCGIFRKAGPSQPSKARRYH

SEQ ID NO: 505 - protein, 265 aa, Hordeum vulgare
MSLALLGGYSSAEDEDPAAAELSDSGDSSAEEAGSDGDEKSAPPKPAAKPRPRVNPSPGDGDSSLPSALDVFAEISGPPAFLNRRVAQPEEVGEALGVLDRRSNSKQRRKPPPPGAVVAAKPQMVAIRERVSSDVKNGANPPVAVLSAKPQLVAGHERVSSDMKNGGNPPGSVDGKRKIGAANPGPEDAAELLRMCLQCGIPKTYSHAQGMVCPVCNDRPVQAKEPEKKKGSAVKDKEKVKRMRGQSSHASWKSETEMALRQQFD

SEQ ID NO: 506 - protein, 238 aa, Hordeum vulgare
MGRSPCCEKAHTNKGAWTREEDERLVAHVRAHGEGCWRSLPSAAGLLRCGKSCRLRWINYLRPDLKRGNFSRDEDELIVKLHSLLGNKWSLIAARLPGRTDNEIKNYWNTHIRRKLLGRGIDPVTHRPVTDAAGTTVSFVHPEPPKAEPVTEESKPPRCPDLNLDLCISLPFQEVEERPPARACAKPVKMEQLQGGGGGLCFRCSILRVRGAATECSCSSNFLGLRAGMLDFRSLEMK

SEQ ID NO: 507 - protein, 438 aa, Hordeum vulgare
MADSRPAAAPLLSPRKKPSAAQYTRSASHAGDELRSFRACLRWMCIDHTDGPRSAGSWAVFFLLAVAAPAAVALALPATAPPRPLDGQVQVSLTLAATLAFLSLCSLLRVGLRRLLCIDRLRHDSDEVRAGYTAQLNRSFRVLACFLAPCSLADAAYKVYWYWAAAPFRSPWWNAAACALEAASWVYRTAVFFMICVLFRVICYLQVLRMVGFAREFGRFADVAVVLEHHRRIRDQLRRISHRYRRFIIFCLVLVTASQFSALLATTRPHARINIATAGELALCSVSLVAGLLVCLHSAAKITHKTQAITSVAAAWHADATIHAFDNDLEDPDPALPAATGYLAPANAYRVAPGEESDSYGDDDDAMSEGSIDDSKLVPFQVNNMSFQKRQALVNYLENNRAGITVYGFVVDRTWLHALFMIEFSLVMWLLGKTVGIS

SEQ ID NO: 508 - protein, 311 aa, Hordeum vulgare
MDADADTVVFEAPAHFRFYKSGKIERLHRPPILPAGVDEATGVTSKDVVLDADTGLSVRLYLPKLQDPSAKLPVLVYFHGGSFLIESADSSTYHNYVNALAAAAGVLAVSVDYRLAPEHPLPAAYDDSWAALQWAASAQDDWIREHGDTARLFLAGDSAGANIVHDMLMRAASNHSSPRVEGAILLHPWFGGTKPVEGEHPAACMVTGMLWSYACPGAVGGADDPRINPLAPGAPALERLGCVRMLVTAGLADGLAARNRAYHDAVAGSAWGGTAAWHGSDGEGHVFFLEKPGCDNAKQLMDRVVAFIAGA

SEQ ID NO: 509 - protein, 66 aa, Hordeum vulgare
MASRTAVVVVAVTALLFAAASAQEMDMGMPPAPAPVTGAAAGAAASALAVACSAVLSLLVAGGLAH

SEQ ID NO: 510 - protein, 120 aa, Hordeum vulgare
QRGSFRRGWVRASGAGHGLARYMRPGSATALRFHGQASTRAKRSERPGAGLGAARARLTTAWHGRARSSAARRWRDRVHPVEAVDHVKRHSLHVAIRSASATPGSHDPLSQRPACLTYGS

SEQ ID NO: 511 - protein, 75 aa, Unknown
  Sequence found in Organisms: Hordeum vulgare, Pseudoroegneria spicata, Secale cereale
MARGDSCLARIGAGVAIGGAVGGAVGAVYGTYAAIRLRVPGLLKIRHIGQATVGSAAVFGLFLGAGSLIHCGKNY

SEQ ID NO: 512 - protein, 498 aa, Hordeum vulgare
MGKGNKVDRLSALPDDILVDILDRLNVPEAARTSILSRRWSQLCAKLSRLIISALDFLPEGVSRSSADISDDELVRINEAVVQATNSVLARRNPGEHTIDLLSTTFHLRDDLPISMGHAVGHAIATHSVKNAKFCVRTRKDDAAEIDDDEEMVIWAREFMLFFDACPIAFGGLTTLNIGNFRFGESDISSILTTCKRLKHMHLYNCDSGDCSTLQVEHANLSELCIMDCRLEQVKLNWLPQLTRIVFDGWIDFQDPLVLGHVPLLESVSLTNIAISVNKMVRLSWFLSSTSVRVLKLGFSSEKIWVQPECPTQGLASVFRQLRFVNLVKLPEGYDLTWTMFILEAAPLLKELYMTVWDDLCSMELDEEKRKNGSYSENKGVEWGSAAADFQHHSLVTLVIFGFESEDYAVNYVRRVMVAAVNLEDVFLYSRLELECGDCQDKKPTRFAWTKRQKISLKKRITAGIESFAIIHSNKTIRADHEAKLFYPQCSHFDTTSG

SEQ ID NO: 513 - protein, 1134 aa, Hordeum vulgare
MAAEEPCCISHAFDRAARRDPARLAVVHAVANGERRFACGDLLSAVSSLSRRISAALPRPSTDHRGCSDRHGGGAGATHRVVGLYASPSAEYVAAVLAVLRCGEAFLPLDPSWPEDRVRSAVSASNAALVVSAGVSNEDDVLKGCPCPVLRFSGEIRQGLYDGEVGIGGDGLAWPCERRRPREFCYVMFTSGSTGRPKGVCGTEKGLLNRFLWMQRRNPLCSDDVLLFKTSVSFVDHLQEFLSAVLTSTTLVIPPIDWRANPTSLATLIKAYHISRMTIVPSLMEMILPTLEKNISCGYNSLKILLFSGEILSLVLWKRVREILPETTIINLYGTTEVSGDCTFFDCKDLPAILEREEITSVPIGFPIANCEVFLMTHAGMADEGEICVSGACLFNGYLAEFCRSNHTEGSEGSTYYKTGDYARRLKAGELVFLGRKDRTVKIYGQRFSLEEIESTLKEHPNVSDAAVTFQSKGSPNYKAYLVFRNNDEIVKGRPQYREVNSSQDIMASIRSWLIKKVPPAMIPSFFLPMKSLPLTSSGKVDYFKLSSLECALEPCEMEQIDSGSGPVNPHLEVIKKAFCDALLVDEVSEFDDFFTLGGNSISAAHAAHKLDIDMRLLYIYPTPSKLLHALVMEHNNSVSPTDEPHPKKGLNGSASIQRLFDSIAANTNDSFHEGKAQINGKRAHYHIAGSYGNGTDGQLSKFPFSPNDRYQASDLNLDTCLKDRNSVMGSQWILNFCLQKKWSIGRSNRFMHDYEGKLLLEDCCSYVSCNKRGYLQELWNIPLDSCVDASPLLVLNNGMMNIFIGSHSHLFLCIDGCNGSVRWSVKLEGRVECSAAITGDFSEVVVGCYKGKIYFHDMLTGKLSWTVQTDGEVKMQPVVDRTKNLIWCGSYDHHLYALNYKDRSCAYKVSCGGSIYGSPAVDMAQNMIYAGCTSGLVTAISLEVPSFRIVWQYEAGAPMFSSLAFDHQSGNVICCLVNGLVIALNSHGTVVWKATVGGPIFAGACVSSALPSQALIPSRDGSLYSFDTASGDLLWSYDAGDPITASAFVDEVLASTPSGSSERFICICTSSGKIRVLGIRTDAEQEKDGYSVQEFTAMDLPGDIFSSPLMVGGRIFVGCRDDRLHCLSIASHP

SEQ ID NO: 514 - protein, 307 aa, Hordeum vulgare
MEGSTPTITRIAVVTGGSKGIGLEACKQLAGSGITVVLTARDETRGTAAVEQIKRLGHSDVIFHQLDITDASSIARLADFLKTRFGKLDILVNNAATDGIEHVINPVYGLIPGDETFNGMDAGQRMDWMWTTCRQTYETAKQGLQTNYYGTKRVTEALLPLLRSSSDGRIVNVSSNFGLLSFFRNEELKKELNDVDSLTEERLDELLAMFLKDFEAGAVEAHGWPAEFSAYKVAKAAMNAYSRILAKRHPELRVNCAHPGYVKTDITRNSGILTPEEGARNITGVALLPEGGPTGKYFSEGEEASFV

SEQ ID NO: 515 - protein, 268 aa, Hordeum vulgare
MGGTSTSTFVIRWINFLTMILAILVVGFGFWMSTHNDECRRSLTIPVMALGGVIFLISLAGFVGAWKNISCLLWTYLIMLFVVLVAIMVFTVLAFIITNTGTGHAVAGSKYKEYRLQDYSSWFVKQLNDTDKWIHLRSCLVKSDDCNSLSKRYKTLKQYKLADLTPIESGCCRPPAECGYPALNASTFDLSYHPVSTNVDCKLYKNDRSLRCYDCNSCKAGVAQYMKTEWRVVAIFNVVLFVILSFVYFVGCCARRHAGGSDSKVPGR

SEQ ID NO: 516 - protein, 202 aa, Hordeum vulgare
MAMATARLIHPCLVVSKSPRTAPTPLLLHTHKPLTSSFHFTLHSVDVSKDDKPLDTALETKQEDAAGVGVGDLTTPLPGELDAEEDVPKLDPRRFEEQFAVLNTGVHECRSCGYLYDQAKGDPSYPVPPGLPFAKVPDDWRCPTCGAAQSFFDSKSVEIAGFAQNQQFGLGGNSLTSGQKTLLIYGSLLVGFAFFLSGYFLQ

SEQ ID NO: 517 - protein, 133 aa, Hordeum vulgare
MATYYPSGASALLLPVPRTRAAFPQGFPGPASGRSSPCAVVRRQRRGRGAVVGVVRACFNPFGDERILREALKEPVAFMGGVFAGLLRLDLNEDPLKEWVTRTVEASGIAEENSAEESNEGAQNDGPQQIEIE

SEQ ID NO: 518 - protein, 311 aa, Hordeum vulgare
MVLLATLSRDAGAHPCPAQEFQGEAGPPRPRRPSAFYSSVFAQIEEVGWGQLVSAAGDDGVSCLTFRVMDEQRRHHLLEITLPMNYPTCPPSIAADVPYLPKLQWSKSSRLKDVLCQFQEHLKVLQDYWSTMDGIDKALWVVDPTKPTYAMSHRRIALGDDCYILLHVDAQKPNSLPECRFLGTDGKLERLIKNWRKNRKRWSADKKFHENLSTVLDFALPQPPSMCIKDDQQADCGICYATHLPVDDELGTQSGCAADYKCENPSCSRAFHSVCLRDWLRTITTTRQSFDVLFGNCPYCSEPVAVKSTDS

SEQ ID NO: 519 - protein, 208 aa, Hordeum vulgare
MWSGAAAAVAARSVSPPLHAPTSLTGRRGAGRPSTVSVRAGGGLMDFVGGDLVKPDLGRWLDDVEKHKALAIYPPHEGGYEGRYLNRLRYQGYYFLDLSARGLGDPESTLTKIHPVCPPSLGRQPVARWYFPPEVDYRLSLLHPDAKGLIVWVYEAKVLSKAELQFLAMLPDLRPKVRVIAECGNWRKFIWKPLKQISGLEPDPDAEE

SEQ ID NO: 520 - protein, 527 aa, Hordeum vulgare
MAPPAMAFQALAFSPLPLHLPATRRRVRVLAVAADQTPPPPQASPSEPANSPSRLLRELAQRKKAVSPKKKHPPRRFILKPPLDDERLTQRFLNSPQLSLKSLPLLSSCLPSAPLSAADRTWMDEYLLEAKQALGYPLAPSETLGEGDDCPARHFDVLLYLVFQHLDPSSERTRTRHVRNGHSRLWFLGQFVLELAFCEFFLQRYPRESPGPMRERVFALIGKKMLPKWIKAASLHNLVFPYDDLDKMLRKDREPPTKAVFWALFGAIYLCFGMPEVYRVLFEAFGMDPEEESCQPKLRRQLEDVDYVSVEFEKRQLAWQDVAAYRPPADALFAHPRLFRACVPPGMHRFRGNIWDFDNRPKVMNILGYPLPANDKIPEITEARNIELGLGLQLCFMHPSKYKFEHPRFCFERLEYVGQKIQDLVLAERLLMKHLDAPGRWLSEKHRRLLMNKYCGRYLRDKHLHHYIIYGETVQDRFEHNRRLRNPSTTAVQQAIHGLSYCVYGKPDVRRLMFEVFDFEQVQPKAV

SEQ ID NO: 521 - protein, 424 aa, Hordeum vulgare
MVILCAGHPAPSVHSEFLSGWLSLNSSRRPYRLSSTGRNIRKQNRHQRAITFAKSSSLQDSVASVKPSRLLPTVEPKTFPNSVPDEMLSKLRLEESDAFYILELCTSRELSSSLLDKNSAILVCLIDVDGDSLLQRVPAIYGDQPSHGTKASQFLPFQSGSVDIITFKGPKLQTIKEIWIGLESGSWRLDGLSLKVIHGARDTPEDLKGTLELKFSGLQYTFDKLSALLGEEGASVVEARPIAVTDLSGISISDLQEGQLSSARTASSIKELKEDGLREYADLKQSLLLYDISIVITGFSAFTLASNDGAAYSFLVGGIGGFLYLLLLQRSVDGLPAISSTSEVSSSEPSVNFSGVRRPWLILSIVMVAGAVALKYGASGDSFELTPTELFVGAAGFLANKVAVLLAAFKPLQSNLESDDGSVD

SEQ ID NO: 522 - protein, 147 aa, Hordeum vulgare
MEPKRSSPQPRAATTKKSPPRAAAADAAGADSPLSSLFHPASHGVNGKEQDLYAILFKGQNGNAQASMTDGQSQWSPAKSRTTYTKDNKYDSVGTSSCFGSSVHYGGRDYYGSSAPKQAAEYSDYKVDKKDPVADSHGDWWQGSFYY

SEQ ID NO: 523 - protein, 364 aa, Hordeum vulgare
MEDDDDCPPLAVELPPQRTSPLVPASSSASAPVGVTVITGYLGAGKSTLVNYILSGQHGKRIAVILNEFGEEIGVERAMINEGQGGALVEEWVELANGCVCCTVKHSLVQALEQLVQTKERMDHILLETTGLADPAPLVSILWLDDQLESSIRLDSIITVIDAKNFRRQIDEHTNSSSFPEAFHQIAFADVVILNKIDLVKDDLEDLERQIHDVNELVTVVRSVRCQVDLNTIFDRQAYGVKNSSQLQELLEYSKSAPPNSRHDNSISTLCIHEQDPVNLAKVESWLEDLLWEKKSNMDIYRCKGILNIHNSNQLHTLQAVREVYEVVPAREWSETQPRMNKIVFIGRDLDISTLQDSFSRCKH

SEQ ID NO: 524 - protein, 240 aa, Hordeum vulgare
MASPQCCANPPTLNPAAGEGKVVDSFGGIKAYVAGAQESKAAVVLISDVFGFGAPNLRKIADKVAASGYFVVVPDFLHGDPYVPEDADRPIAVWIKEHTAGKAFEEAKPVIAALKEQGASSVGAAGYCWGAKVVAELAKANEIQTAVMSHPSFVTVDDIKEVKCPIAVLGAETDVMSPPELVKEFEQVLSSNSGIAHFVKIFPGVSHGWTVRYNGEDAAAVKSAEEALTDMIDWFNKNLK

SEQ ID NO: 525 - protein, 632 aa, Hordeum vulgare
MSSSGKRLDQSPSPSRPVLLMSHSSNRLDQPPGRPALAMSRSSNRLDQSPASSPTPAKGPALVMSGSSKRLEQSLASPSPSPKAGAAAPPVLVLSNSGKRMDQAGRKKYVKQVTGRHNDTELHLAAQRGDLDAVRQIIAEIDAQMTGTGEEFDSEVAEIRAAVLNEPNEVGETALLIAAEKGFIDVVVELLNHSDKESLARKNKSGFDALHVAAKEGHRDIVKVLLDHDPSLGKTFGQSNVTPLITAAIRGHLEVVNLLLERVSGLVELSKANGKNALHFAARQGHVEIVKSLLVSEAQLARKTDKKGQTALHMAVKGTSAAVVRALVNADPAIVMLPDKNGNLALHVATRKKRSEIVNELLLLPDMNVNALTRDRKTAFDIAEGLPLSEESADIKDCLSRAGAVRANDLNQPRDELRKTVTEIKKDVHTQLEQARKTNKNVHGIAKELRKLHREGINNATNSVTVVAVLFATVAFAAIFTVPGGNDEKGVAIVVHALSFKVFFIFNAIALFTSLAVVVVQITLVRGETKAERRVVEVINKLMWLASVCTTVAFISSSYIVVGRHFRWAALLVTLIGGVIMAGVLGTMTYYVVKSKRTRSIRKKVKSTRRSGSNSWNHNSESDSEIDRIYAI

SEQ ID NO: 526 - protein, 578 aa, Hordeum vulgare
MGGGNGIVDGFRRLFHRRTPSGSVLGSSNQSSAGEDSSELEAVEDLDLVGLRPIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKHPVPLTQKFPNADPLAVRLLGRLLAFDPKDRPSAEEALADPYFASLANVEREPSRHPISKLEFEFERRKVTKDDVRELIYREILEYHPQMLEEYMKGGDQISFLYPSGVDRFKRQFAHLEEHYSKGERGSPLQRKHASLPRQRVGASNDSNNEQHISDQEMSAEPDAHGAVSPQKPQDAPGVGQNGLSPTSLSSRTYLKSASISASKCVVVNPNKQPEYDDAISEETEGAVDGLSEKVSKMHA

SEQ ID NO: 527 - protein, 177 aa, Hordeum vulgare
MLAATAACRAPARPLPAARPGSSYLLGRVLLPKRRAPAVRRRGRSAAVRCGLLPVDPWAPGVDSQSIASQLFAVSLFPYLGFLYFMTRSKTAPGLTLFGFYFLLAFVGATIPAGIYAKVHYGTSLSNVDLLHGTAESLLTLTNLFIVLGLRGALRNLDKAEESSPEAPRDSKEKSSV

SEQ ID NO: 528 - protein, 99 aa, Hordeum vulgare
MASFSKQAALFLLAALLLCLVCTRGQAARPTPGSSHYKSQDAGSAIFHEKVAAGAEMEMEQEDQEAVRGCEGGEEVEECLMRRTLVAHTDYIYTQGKHN

SEQ ID NO: 529 - protein, 131 aa, Unknown
  Sequence found in Organisms: Gossypium hirsutum, Hordeum vulgare
MASQLSAMTSVPQFHGLRTYSSPRSMATLPSLRRRRSQGIRCDYIGSSTNLIMVTTTTLMLFAGRFGLAPSANRKATAGLKLEARESGLQTGDPAGFTLADTLACGAVGHIMGVGIVLGLKNTGVLDQIIG

SEQ ID NO: 530 - protein, 587 aa, Hordeum vulgare
MEPLTGFRASVWSCFKFLPFFCGLLLLGIIKGVLFGPWAWFIMAIGISALVLGLWPMHVIWTYYCIIRTKLVGPVVKLLLLISVSGVLVMWLIVGVLGSVLAGLAYGFLAPVMATFDALGEGKERPLVHCFVDGTWSTITGGCTVVRDMKDMLLHSYLAYMDDLRFHEPPGGKPFEIRVLDIPGAVLAAACGLLMDGIMFTVIALYKFPVMLFKGWKRLIEDLVGREGPFLETVCVPFAGLAILLWPFAVLGAFLASMISSVPLGAYAAIVVYQESSLFMGLSYAISSVSIFDEYTNDVLDMAPGSCFPRFVYRKNQASVESGPLSRPASFRDKQDGKKAPARITSFKSSFDEFNPFKLLDHLFEECQHRGEALVAEGVITPKDIEETKSGKGGSGVLNVGLPAYVILNALLRSAKADSNGLLLRDGCEITSDNRPKNTLFDWFFDPLMVIKDQIKAENFTEEEEAYLQKRVLLISDPKRLKATLPHLPSLNERKQAEIDAFARRLQGITKSISRYPTSKRRFDDLVKALSEELERAMGGSRSVRGSQFQKLKSGLVRMLSQRSMGKTTSIRGYDQEAQLNSNASAA

SEQ ID NO: 531 - protein, 1203 aa, Hordeum vulgare
MDGGETQVVDDGGTPPLGSPVSSGDTTQSGGEEDGNGLRLGSPVSSGDTTQSGGEEDGGVLYGETQPLDEDDEETEAVEEFEGEGEERMSDDTQVVEDSEDDAGGFAGQTQAVEEEEEDGGSTEDEAGDGVVEDSEDDAGGVAGQTQVVEEVEEEDGGSTEDEASDGDRTQLVEECEVEDGGSGETQLAEECQEEERENDSSDDEAAVQRGTTQLVEDSDKEMGGDGDDELSQGTQVQSDDEGLPNNEGDVKDYAEDSVDSDASTEEEGATVKSLEQGKRHASTNGTFLRTEIVDNSTSCNASFGDCPGRRIDDGSFGYVQSHEKDGSKSKGRCSTAKKLFADTTNEQKEIKSRCFSGLSYLGSQEPGELSQANALDVVEGLISIHGGISSQEPSPKKLEKAKPPVSVKMGTLLLAEKVDRRRSSSGKAEVFAWVDSREDDGGGDFFRKNKDILLHQSAGRGKSKIPRPKKCSTKIAPPDKKIIEGRKRRTRSKLCEKTETLPSSDSRLLKSEVKSKRASGKRTEKKLLKDLDDHLSTAKPIERQQEKVSVDLHDVGQDTQMAVEAIEALAQSSPAENLSARVEPPVKRDLRVGSKVEKGNPKSGPPRKRTSSVQEGVTTRSKRIKVTEMNHKPQKGQGGIEMRHNLEDCATKTKHKQAKPVPQKNKVANIVDGNSYDSTPVVRRTRHTGRNNLYESPELCSNKNLKKATVADVRNNHSEHGLERPVISERTAEYGSDSMFKENTEIACANNAQGLQPSTDASIQHTSANVAQNLEPLRDEPTTHVFRREPSSHPKQRRTPTAVVQAKAPAVTEAATGHDMQPEVTRPSKKRRIFIRSSELLTYARRERSDCRSNCLLSSILTQSSAASPVLDSSSGVNSKTSGVSSSDQRQKKPSGVKDAGNSPKCNSPVPCSGLKTPSKVVSKLSPTFSPLNPSKASSRSLLKPSIARELLELDPENALPSRYRKDSRRKDMTSCSIIFSHHLDEDVIKRQKKILARLGAHEAYSVADATHFVADGFYRTKNMLEAVTRGKLVVTSMWLESCGAAGCFVNDKKYILRDAKKEKEMGFSMPISLASACKSPLLLGKRVFVTQNVKPSREVVTSLVSASSGQPLERMGRSIRKEKEAADDLLVISCEEDYQTCAPLVEKGIDVFDVELLLNGIVTQKLDYERHRLFLDRVKQTRSTRWLKDGAHGQFVPVSKS

SEQ ID NO: 532 - protein, 482 aa, Hordeum vulgare
MAAWAEQLQRELAGRGLAVASVPGKGRGLVAARSFFPGEVIICQEPYASTPNRISVGSSCDHCFASGNLRKCSVCRVAWYCGSACQKEEWKLHQLECQAISALTEERKKMLTPTIRLMVQLILRRKLQSEKAIASSATDNYNLVDALESHISKVDDNQLVLYAQMANLVQLILPSIELDLKEIAHTFSKFACNAHTICDPELRPLGTGLFPAISIINHSCVPNAVLLFEGRTAYVRALQPLSSNTEVSISYIETAATTLKRHNDLKQYFFTCTCPRCIKDSEEDDLLEGYRCKDQKCDGFLLPDSGKKAYTCQKCSISRDEEEVKKVSSEILLLSDKASSLLSSGNNSEAGSVYKIIEQLEQKHYHSFSITLLHTRETLLKIYMELQDWQTALMYCRLTIPVYERVYPPFHPMVGLQFYTCGKLEWLLEYTEDALKLLTRAADVLRITHGTQSQFMKELFGKLEEARAEVSFRLSSGEEQIS

SEQ ID NO: 533 - protein, 473 aa, Hordeum vulgare
MARCGVAVLLPILLACVAASAAAGGADRQHRRGSGASARLQLVPAAPGASLAERAQDDRHRHAYISARLASSSSSSSRRRAAETSTAPMPEASAFAMPLTSGAYTGTGQYFVQFRVGTPAQPFVLVADTGSDLTWVKCRGRRASSPDASPLASPRVFRPANSKSWAPIPCSSDTCKSYVPFSLANCSAGTTPPAPCGYDYRYKDKSSARGVVGTDAATIALSGSGSDRKAKLQEVVLGCTTSYDGQSFQSSDGVLSLGNSNISFASRAAARFGGRFSYCLVDHLAPRNATSYLTFGPVGAAHSPSRTPLLLDAQVAPFYAVTVDAVSVAGKALNIPAEVWDVKKNGGAILDSGTSLTILATPAYKAVVAALSKQLARVPRVTMDPFEYCYNWTATRRPPAVPRLEVRFAGSARLRPPTKSYVIDAAPGVKCIGLQEGVWPGVSVIGNILQQEHLWEFDLANRWLRFQESRCAH

SEQ ID NO: 534 - protein, 345 aa, Hordeum vulgare
MDDAANATQTSATSSVAAVAAAAQHQQLQRQLFLMQQAQAQAQAQPHPQAQQLSQQAMSRFPSNIDAHLRPLGPHRFQQPASAPSQLQTPPQPHSQGQPSPQQSAQARVRSPEVEMALQDAMRVCNPDIKTPFHSLEDAVSRLLPYHVVADYEAEEDDRILDSDATGQIPSRLQQWDHNILVKIAEFTTTFEKQVLAYNIMTKKRAIGEFRSEERLMLEQALLQEEKQASMELRAEIESREKAGREAAEAKMRMAMVEHARVEAQPHPEVIGHGPLRANSAASQGDDGPSHDMAQEHVEDGWENTQRDDDDPSEDFLNDENEPDNGNSDMQEEWRRSGEFDLNSR

SEQ ID NO: 535 - protein, 857 aa, Hordeum vulgare
MGAIGGDESVQWDKMNGAEVVNGGGSGAGSLDRIQVLVRVRPLSDKEIARGEPAEWECINDTTIMFRSTFPDRPTAPTAYTFDRVFHSECSTKEVYQEGVKEVALSVVGGINSSVFAYGQTSSGKTYTMTGVTECTVADIYDYINKHEERAFVLKFSAIEIYNEVVRDLLSAENTPLRLWDDAEKGTYVENLMEVILRDWNHLKGLISTVESSAREFLGKDKSTTLVASVNFVDLAGSERASQAMSAGTRLKEGCHINKSLLSLGTVIRKLSMGSNAHIPYRDSKLTRILQPSLGGNARTAIICTLSPATSHIEQSRNTLFFGSCAKDVVTNAQVNVVMSDKTLVKHLQKEVARLESELRHPVSSNSSLEAQVKEKDNQIRKMEKEIKELKTQRDLAQSRLQDLLQVVGDRDPKHQVSGKRSIRSPPSVGMPPSASRDDSSQISHDDSEHYKEVRCIETIETGGNERLSLSAGESTSPQDSNRNSSMRGNDSNRNSSMRGNDSTASVNSRRLGETPITLEQHLENIRRPFITKDLGSSTRNPSSCRVIGRSRSCRSLTGSTLLDEMELEDCTPVNRSLVIFPGRPEEYQRRGSALNYDAGSETPSRAGSEISTSKGASKAGDAEFTGIGEFVAELKEMAQVHYQKQLGDQSANGKSVGLDPMMDALQSPSRWPLEFERKQQEIIELWHACSISLVHRTYFFLLFKGESADSIYMEVELRRLLFLRDTYSRGSTPSNVVVGSLSSSPVASAKKLQREREMLARQMQKRFSVEERNHMYTKWSVPLDSKKRKLQVARRLWTESRDLEHVRESASLVAKLIGLQEPGQVLREMFGLSFAPQQPPTRRSSNGWRYGIPSFG

SEQ ID NO: 536 - protein, 331 aa, Hordeum vulgare
MAAAAAAAAATRKDRPPHRLRSPSRVAADFAMGGAAAVVAKTGAAPVERVKLLLQNQAEMLRRGALTRPYRGIADAFARVLREEGPAALWRGNQANVIRYFPTQACNFAFKGYFKSFFGYDKEKDGKWKWLAGNVACGSAAGATTSSLLYHLDYARTRLATDAIESRANKRQFRGLLDVYRKTLATDGIRGLYRGFNVSIVGITLYRGLYFGIYDTMKPIVLVGPLEGNFLASFALGWTITTFSGACAYPFDTLRRRMMLTSGQPFKYSSAFHAAKQIVSTEGFFTLFRGVGANILSGMAGAGVLAGYDQLQRFAGRHDYKIENKMKGALK

SEQ ID NO: 537 - protein, 266 aa, Brachypodium distachyon
MGIGALQPAAAMAPAATASNAAPRIHHRPWTRAAAPRTLVCNAGSGSSNTGAPPQPRTTRGRFAATTAAGAAPDAVTYSSSIDTDMPLYEPPGVSFDEYLEDRPRVFRAMFPDEGRSQRLGDDHWRVRMLPLEFLLITVHPVVVMQLRNRGRALHLRITEWELRGLDSGYTPASFDLGVRGSLYADRSGGGSRLRGHLEISITAVLPPPLRLVPDGVLRGVAESVLSTLAEKMKRDVDVGLVADFRMFRMEKAASRATGTAVARAE

SEQ ID NO: 538 - protein, 343 aa, Brachypodium distachyon
MRPFLLTPGARLASAPSPSTLSRLLLPLHLQNRHAHASPSPSLHARTNRSSPPLRRRSGRFFASSASSSQMAAPADAPGGSADAFEVIRAHQVKAARLPPIEEIRTILDRSVRGVLATHSQEHVGYPSGSMVDFACDQDGSPILAVSSLAGHSKNLSGSSKCSLLVAKDPEDRTDTVITVYGDATPVSDEEKDAVRSAYLRRHPEAFWVDFGDFRFLHIKPKAVRYVSGVATAILGSGEFSAAEFKEAKVDPISQFSTPITSHMNKDHADDTKLIVQHSTSVMVDFASMLDVDSLGINVKAGYDGSVLKLRIPFPRRAQDRKDVKTLIVEMLQAAKASSSHAE

SEQ ID NO: 539 - protein, 203 aa, Brachypodium distachyon
MATSTCHLPPLLPGPASPNHLHLRSSPPPFTRHLRNPTPVRLLRAARRRHPDAVVVVPDARPWVGDLSGSASYRDGSEEDGDAEEEDEEEEDDRSLDLLARFLQSVFRKASRRARRAARSVLPPSVPAELVKFSVNGVLVLTFLWILKGLLEVVCTFGSMVFISILLVRGIWSGVTYIRENRYSYIQQLNDEGNRWSTVQTAG

SEQ ID NO: 540 - protein, 366 aa, Brachypodium distachyon
MEVQAPCTFTCSYTHCSIGFAPRARLRCITRIRAAAHDQQGVGDDQPRRTSRLAADGPIPAAVAAAAAQGPSSSSSSVFGARDAELAMWEKLGALVRLSYGIGIYAAMALAGRFICHIAGIDSTGGFHPSLTALVEGLGYASPPIMVLLFILDDEVVKYSPHARAIRDVEDEELRTFFLGMSPWQFILIVAASSVGEELFYRAALQGALADIFLRGTELMKDARGIVSLSGMVPPFVPFAQTFAAAITAALTGSLYYLATAPKDPTYVVTPVMRSHNGRENIKKLFAAWYERRQMRKIYSPLLEGILAFYLGFEWIQTDNILAPMITHGIYSTVVLGHGLWKIQDHRRRLRQRIQEIRQSGSDTHQ

SEQ ID NO: 541 - protein, 1186 aa, Brachypodium distachyon
MEGTTAAVVGGDGAAGDAQIKGGKENGQQALQLQRPLQPSGGSEALEMPPTPLPIARDLDWSEHFSFFNSAGGFTDGARGLASTGLSNSVSRPDSVTQCCLEGTDERVEELTVGNCISSDAQPHASAGGSSSGGERPAVVRGLWGNFTRMAWRSSDVASRENLAAGRGDIANLRTGDVASRETLAVNLGNNMISQNNLRTGNVASRENLAANLANSIIAQNNLRTADMVSRENLAANLGNSMISQSIDASGKEMPFSRGDNANSEFNMSFGNQQQPIPSSRLNQTEQRFERENGLKVSSFSNRIIDQMRNKTATPSSGVQGFPFKTASKGKGVTYQSAREEIQAQANVRPRVPMDRISKIPSSTHNSMARLDGAFFNGGGNASESQNEGTSLRELIRPTGQVTSKFEKMQLFKQILDHVDKSHARGLTLQHVRPSYFIVSPPNQVKYTGSYATQDLSAPAKPDIATDDMFNRKRRFDQKNAHQEFNGNGNPNSILKYQKVGDQGSVAVRRPTHTFRTDHRGGNQSEDVDPGASGQGNSSCTVRGRFNFGEPYYGNGNNASYAQRLSNYGNQESVLDLRLLEDSWYRSPEELSQLKGTFPSNIYSLGVILFELFCCCETWELHCAAMSDLRHRILPPNFLSESPREAGFCLWLLHPDPRSRPKARDILGCDLINEGRDLSLLDNKVPAAVNEEDTESGLLLNFLSQLKEEKEMQASKLSADLAGLQTDIAEVERRHSLRNGFSLEDMGVLASSNDLPGTSSDALRGGSLSGLLPPICRSSIYEQRVMRNLEQLENAYYSMRSTIDTSETNVIKRSDNDALRVRDNFYQLHGDTDAMNEQTDRLGCFFDGLCKYARHSRFEVRGILKNADILNSPNVICSLSFDRDEEYFAAAGVSKKIKIFEFDALLNDRVDIHYPLIEMPSKSKLSCVCWNSYIKNYLASTDYDGTVQLWDASTGQGFTQFTEHRKRAWSVSFSEVDPTKLASGSDDCCVKVWSINQKNCVDTIRNVANVCCVQFSPYSSRMLAFGSADYKTYCYDLRHTRIPWCTISGHGKAVSYVRFLDPETLISASTDNTLKIWDLNRTNSSGLSSSACSLTLSGHTNEKNFVGLSVHDGYITCGSENNEVYSYYKTFPMPITSHKFGSIDPITGQETNDDNQQFVSSVCWRGRSNMVVAANSSGSIKVLELV

SEQ ID NO: 542 - protein, 313 aa, Brachypodium distachyon
MARPRAGPHPSSLVALLLSALLLLLARDGAARGGGGRGSSVYPASVVYPHHSRQISWKPRVFLYQHFLSDDEANHLLSLARAELKRSAVADNTSGKSTLSEVRTSYGTFISKGKDPIVAGIEDKIAAWTFLPKENGEDMQVLRYKRGEKDEPQFDFFTDTVNTVRGGHRVATVLLYLTDVAEGGETVFPLAKDFTDTGLHDKDTTLSECAQKGIAVKPRKGDALLFFNLRPDAATDPLSLHGGCTVIKGEKWTATKWIRVASFDKVYHMPGNCSDNNDSCVRWAALGECIKNPPYMIGTAALPGHCRRSCNVC

SEQ ID NO: 543 - protein, 161 aa, Brachypodium distachyon
MEVEMQLDDDVFFAELSKRISLLITDDDEADFGSAQFPASLPVPGFSMAPHVPQGASMLAPPAYTLFHHAASYGAAAANNNNNSAAGDIGRAWQQQQQQQCGSKGTGVFIPRSTSGSAHSKRKGRNWSGGSKAAAHKARAAAAAQTEAAAVAAGTSAKRRA

SEQ ID NO: 544 - protein, 271 aa, Brachypodium distachyon
MFFQRRNSKKVKDTDGSSPKKDKDGRGKNDFFDRAKGAFTGSLKSAKNDAQGRAEKVQADVKAGFETILEKGSGILEKAKEDVGGHSESEASRSKELGQGSEEQGKEDMEAFNSMLDKVKTHPDVMDKVHSVLDKVKKHPEVIEKVAEVLHLGKHESKEKEAAEVKEKTKGEKTQDADEGASGDKTKSSNILEEAVEEIQAVFAAVQQQDTDETEIPVEAAAETGTPAEGEQPEEAKREVEKDDPKKRIDFLGFFAMLFERFCSPAAKKKD

SEQ ID NO: 545 - protein, 131 aa, Brachypodium distachyon
MATISAAAATTVVARAVTTRPQALGLPQLRARSERVRCSYSKDAKEATPTTSVRGAGASLLAAAGAVTASAAPALALVDDRMSTEGTGLSLGLSNNLLGWILLGVFGLIWSLYTVYTSGLDEDEESGGLSL

SEQ ID NO: 546 - protein, 568 aa, Brachypodium distachyon
MEAVAGDETVGELLRAAAALVPAEHYAIAALVAFSVFAYRFLELHVIGDLLRGLRGGRVELVFHPASEIYHCVASKCRSLHGRYLATPWLASPHLQTLFLGISGRPPSFTYKRQLYTVRDGGTVALDWLLANLEDGIISQDASTPLVVVVPGLTSDSDAAYVKHLVHSMARKGWNVVVSNHRGLGGVSITSDYFYNGGWTEDVREIVNYLHQKYPEAPMFCVGTSIGANILVKYLGEEGENTPVAGAASICSPWDLVVCDRFISRKLVQRLYDKALAFGLKGYAELHQPIMARLANWEGIKKSRSIREFDHHATCVVAKYETVDTYYRRCSSASYVGNVSVPLLCVSALDDPLCTREAIPWDECRANKNIVLATTPNGGHLAFFQGLTAGRLWWVGAVSEFLCALHDSSCMHRQKAGDHVLQSSLESSIDKSPYVSIMGDGMVAPVTNDGSDNDEPPSNQIDNGLKLNNGVNDSQQDEKDHKSCISVDETPAKTPAGSAKQQGEEHYANKIHDAIDPVRRSINQLSRYQGKSVGLLAYIAFVTSWPLLGSLALIVFRKKFRKPLSAKL

SEQ ID NO: 547 - protein, 476 aa, Brachypodium distachyon
MEHVIGGKFKLGRKIGSGSFGELYLGINIQNGEEVGIKLEPVKSKHPQLHYESKVYMLMQGGNGIPHLKWYGVEGEYNVMVIDLLGPSLEDLFNSCNRKFTMKTVLMLADQLITRVEYMHSKGFLHRDIKPDNFLMGLGRKANQVYIIDYGLAKKYKDLQTHKHIPYRENKNLTGTARYASVNTHLGIEQSRRDDLESVGYLLLYFLRGSLPWQGLKAGTKKQKYDRISEKKMLTAAEVLCKSYPSEFISYFHYCRSLRFEDRPDYSYLKKLFRDVFIREGYQFDYVFDWTALKYPHMSSNNKLVRQPSGRMAGVGPSVERTDRSSVGQDIRDRFTGAVEAFARRNSGNGRHGDHSRHKSLAESFMSSREAVADSEKTHILSRTGSSSKMTITPSSRPTSSGDLTSRLVSGSGSSNHPSSSTVQRLHHSGGGSTAENGSSSPTARNAQGGRAGGRRDSHAALRSFERLAISAERRK

SEQ ID NO: 548 - protein, 463 aa, Brachypodium distachyon
MVANQEAAATESAPAATVDAMRLASRWRSPAEWEAAAAALEAEPLPSQLNTDNSSGLFAVVSIDKMSVKYLGVNHHGHDVGVVQADCPAPTHRAVYYFEMTVVNAGLKGQTSIGFTTESFKMRRQPGWESQSCGYHGDDGYLYRGPGKSESFGPKFTSSDIIGAGINYISQEFFLTKNGSLVGGFPKDIKGPLYPTVAVHSPGEELTVNFGKEQFCFDIEGYILEEKMKQQSVSDKLYLQPDISHWIVRSYLLHYGYQDTLNSLDMASETDPPANHQNGYGEPPEMYGLSHRKMLRQLIMNGDIDSAFKRLEEWYPQVIKDKTSVICFLLHSQRFIEYIRAEHLEDAVKYARANLANFLTHKAFEGLLKESVALLAYEKPSESCIGYLLDSPQREFVADAVNAAVLSTNPSMKDPESCLYSCLEKLLRQLTVCSSELRVFNNDQGDAFLLHKEVQTCERSRRS

SEQ ID NO: 549 - protein, 681 aa, Brachypodium distachyon
MAEAAASPAQPKLLYIAVADGGGRRAFRYTRPVLQSTLQLMGCKARHAFKISKRVFNMMKGEFLDTSKLDRAVKEGNSPGLDIGEDAKMLNPETSDASSNSVPFELYKTQTTIIVSREKFLNVVCDALSSYKYVGPNQKADLLLACRIKERKESVTVLLCGTSGCGKSTLSSLLGSRLGITTVVSTDSIRHMMRSFADEKQNPLLYASTYHAGEYLDPIAVSQSKAKRQAKKLDMVSRPSTLEGKDDISDVQSRHGASELPPRTELIGNKQMAIEGFKAQSEMVIDSLDRLITSWEERKESVIVEGVHLSLNFVMGLMKKHPSIIPFMVYIANEEKHMERFAVRAKYMTLDPAKNRYIKYIRNIRAIQEYLCNRADKHLVPKINNTNVDQSVAAIHATVFSCLRRREAGEQLYDSNTNTVSVVDEEYRNQRAANSLGSKGMFQFIQRKGSSRNLMALLNPDGSVTKAWHVDTSDANGNGSTSSEKSVRNHMVNPSQIGKAESVNLQFGSFGISAWLSDIGGTSHAGSVDDLRADGIETASRYFSSCCSSPKTSDCASKEHMEDYSVYGSEEEADDPPDAETDDDLTDEERDVHEIEAGSVDEHSTKSDEEYDDLAMQDVMENGNSSDDEQAAGSGNRSSALEESILGAADGDDAMAGRYHHNLELFFKMSKEVAATEMPCA

SEQ ID NO: 550 - protein, 321 aa, Brachypodium distachyon
MDVRRQPNVAAAAAAAAAATLGDLFPHQPAMDSGDNNTEWLSIYLEDCLSTHPVSAEQASQGAVKQKLPPPSSSNARRKKRSLASVIRDEEEHCFTVFVEPPLLLPDQKHWLAESELILPKKDKDQELVQQQEQEHEEEKKRNASAEMLFQQEQMLVCSYCLSNQTPQWWDGPSGVLCNACGLRLQAGNEFSSMERCGQEISKEQEQGKRQEKRRIKRPAYIDEELPQKKRTKKTTYVNEELPPEEPVQRCTHCMSHKTPQWRTGPLGPKTLCNACGVRYKSGRLLPEYRPANSPTFSSYMHSNSHKKVMQMRKSVEHSGQ

SEQ ID NO: 551 - protein, 174 aa, Brachypodium distachyon
MSMALGRFTHWLWPGSSARVASHELPSTALMSSSFPDFPSGFREPDTVSFSTAGGGRRTRQRRVRNRRRSRGEPRVDREYDMVIVPSDGGGCLSGTESDDSDWSIGWLEPQAPEMQTDGDPETCFAVLVPCYRHGRAQEPAVPEGRFLGAGALADGGLSDGKNFVEQWLSSLQN

SEQ ID NO: 552 - protein, 421 aa, Brachypodium distachyon
MSHHLHLRGSVPPLSFRGGLDARFSPGVPWHFASSSSNVGVAAASSARTLRPPQHRAKVMAKEAGEQETAALGWAARDASGVLSPFDFSRRAQKDDDVTIKVLYCGICHTDLYIIKNEWGNAMYPVVPGHEILGVVTDVGSGVTKFKAGETVGVGYFVGSCRSCESCGNGYENYCYGMVLTSNGIDAEHGGAVTQGGFSDVIVVNEDYVVRVPDGLPLDKAAPLLCAGVTVYSPMMRFGLNAPGKHLGVVGLGGLGHVAVKFGKAFGMKVTVISTSPGKREEAIEKLGADDFLVSRDPGQMQAAFGTMDGILDTVSAWHPISPLFALMKPMGQMVFVGGPTKPLELPAVAIVPGGKGIAGNCVGGMRDCQAMLDFAGKHGITAEVEVIKMDYVNTALERLQKNDVRYRFVIDVAGSLGTTA

SEQ ID NO: 553 - protein, 141 aa, Brachypodium distachyon
MENLAMLWGVIGPGVAGALFGAGWWFWVDAVVCSAVQVSFIHYLPGIFASLAALMFNCVNKEDIGNDYYSSYGDDSEWRVKLWLFVAYVVSFVCLAGSVGLLVQDALTDKGPSVWTGVAGVLQCVFVLISGLTYWTCHSEE

SEQ ID NO: 554 - protein, 1415 aa, Brachypodium distachyon
MTGNSMLCLQRFPSKMGEQRLGFISARNPWFGRSRMFRHCLDLRHLCRLPNQIVTLPNYRPKHAPSAAVYRGVSSPLTEEFVDEVGSRSRIIHFYRKPFLQESETEELLRKVQAKVSCNVIDIKTEQCFNVELERALASEKLATLQWLLAETYEPDNLQTRSFLEEEVASGPYSVLVEVGPRMTFSTAFSTNAVSICKALSLMEVTRLERSRRYLLCLQPGGGALDESQLNSFAALIHDRMTECVYPSKLTSFWSDVVPEPVSVIPVIEKGREALEEINMRMGLAFDEQDIKYYTHLFRDDIKRNPTTVELFDIAQSNSEHSRHWFFNGKLVIDGETMASTLFQLVKSPLKANPNNSVIGFKDNSSAIRGHTVNHLRPALPGSTSPLSLMMRELDILFTAETHNFPCAVAPYPGAETGAGGRIRDTHATGRGSFVVASTAGYCVGNLQMEESYAPWEDSSFAYPSNLASPLQILIDASDGASDYGNKFGEPLIQGFTRSFGMRLPNGERREWLKPIMFSGAIGQIDHAHITKGDPEIGMLVVKIGGPAYRIGMGGGAASSMVSGQNDAELDFNAVQRGDAEMSHKLYRVIRACIEMGEKNPIISIHDQGAGGNCNVVKEIIYPKGAEIDIRSIVVGDHTLSVLEIWGAEYQEQDALLVKPDSRSLLEALCERERVSMAVLGEIDGSGKIVLIDSAAVEHAKSYGLLPPRPVVDLQLEKVLGDMPQKTFEFNRVSRLGEPLDIAPEVTLMDILKRVLKLPSVCSKRFLTTKVDRCVTGLVAQQQTVGPLQLPLADVAVIAQTYTDLTGGACAIGEQPMKGLLNPQAMARLAVGEALTNLVWAKVSSLSDVKASGNWMYAAKLDGEGADMYDAAVALADCMIELGIAIDGGKDSLSMAAQCDGEVVKAPGNLVISAYVTCPDITLTVTPDLKLGKDGVLLHIDLAKGKRRLGCSALTQVFDQIGNDCPDIEDVPYLKIVFETVQELLSERLISAGHDISDGGLIVTIFEMAFAGNCGVNLNIDLKGNSLLQALFAEELGLVVEVHSDDLDSVKQKLQAAGVSVHVIGEVNATSEIELVVDGEVRLKESILDLRDLWEETSFQLEELQRLKSCVNLEKEGLKSRTSPSWHLSFAPKFTNKKLLTASSKPKVAIIREEGSNSDREMSAAFLAAGFEPWDISMSDLLNQEASLTEFHGIAFVGGFSYADILDSAKGWAASIRFNQPLIQQFQEFYNRPDTFSLGVCNGCQLMALLGWVPGPDIGGSLGKGGDISQPRFIHNESGRFECRFTSVAIGDSPSIMFRGMEGSTLGIWAAHGEGRALFPDENVLSGVINSNLAPLRYCDDANNATEVYPFNPNGSPLGIAALCSPNGRHLAMMPHPERTFMMWQYPWYPKEWQVERGGPSPWLRMFQNAREWCS

SEQ ID NO: 555 - protein, 703 aa, Brachypodium distachyon
MEEDGASAAEAAVPAATKPLTPEEEALRRNTDCVYFLASPLTCKKGNECDFRHSEIARMNPRDCWYWLNGNCLNPKCSFRHPPIDGMFGAPSPGIPAVSSHYAAYNLGKQMVPCYYFQKGNCVKGDKCPFYHGPQSTGNNPPEQVAKVSSFPLEQPQTQKNDLLGIKESARTNNLIQRGGPIIDDRSKMAVDRPTANSAKTPADAIPAKLASSALKSLPKSEKLQSSMPAAKRSFRTSSGEDHPECYHNNLIESDPVQDWNEDYRPPADDDLPQNSREADELPGESSPGFDVLVDNDGDAAAYLHDEEDFGRDMYPVEDYEYAPADFEIPPHHERELFNRMGEQGPVGQIYDGYERKRRRTSSERNMDRPSHSERRSRHRDIGHVEIDGSDLRHRLRRRKINGSSGTSPERSGEHRRRDERYRERAYDGHHTHRDRHRSPRGSTLSSRLQGRIKLPGRSPDRVVTSSEKEQDRRPLRERLSPVKHMDVQGVRHREAGQHQERTLRRSSELPSSARNADGQHLRRNVTESLNFGRKANGRVESEASLDFEGPKPLSIILQKKRQATCGNGSSAHNGKQDKSAKVSHRQPESIVETEKEGYDNIVSSEEYKSRSGDEYKEESRIPAEGHGQSSSHGDKPETEDIIEVDPVVNQEADNYEQGEGESDYDAAEGQEYKSEDENAYQNDEDEFEDDDDFARKVGVVFS

SEQ ID NO: 556 - protein, 788 aa, Setaria italica
METTSSTNEDTGRGTMWELERNLDQPMDAEAGRLRNMYREKTYPTLVLLQLAFQSLGVVFGDLGTSPLYVFYNIFPHEIEDTEQVIGALSLIIYSLTLIPLVKYVFIVLRANDNGQGGTFALYSLLCRHAKINTIPNQHRTDEDLTTYSRHTYDEKSLAASIKRWLEGHQLRKNVILIIVLFGTCMAVGDGILTPAISVLSATGGIQVEEPKMRNDVVVIVSVVILIGLFSMQHFGTDKVSWLFAPIVLVWFILIGILGAVNIYKYDRSVLKAFNPIYVYRYFKRGRTSWASLGGIMLSITGTEALFADLSYFPVQAIQIAFTVVVFPCLLLQYTGQAAYIAQNTHSVPHAFYYSLPASILWPSFIVATAAAIVASQATISMTYSIIKQALALGCFPRVRIIHTSKKYRGQIYSPDINWILLIFCIAVTAGFKNQSQIANAYGTAVIMVMLVTTFLMVPIMLLVWRSHWTLVILFTTLSLIIEIPYFTAVVRKIDQGGWVPLVFAAAFLVIMYVWHYGTLKRYEFEMHSKVSMAWILGLGPSLGLVRVPGVGLVYTELASGVPHIFSHFITNLPAIHSTLVFVCVKYLPVYTVPLDERFLVKRIGPKNFHMFRCVARYGYKDIHKKDDDFEQMLLNSLMLFVRLESMMEEYTDSDEYSTGHELNQAGNANPRINGINNSSNMELSYTSHDSIIQVQSPNHTGNSQLMSSGQTYQTVGDEIAFLNACRDAGVVHILGNTIIRARRDSGFLKKIAINYMYAFLRKICRENSAIFNVPHESLLNVGQVFYV

SEQ ID NO: 557 - protein, 346 aa, Setaria italica
MDSSRGPHLLLPLLLPALLVLALAPSSARAAEPGVIRLPSGKAGARACAAPADPAAYDRPVIGIVSHPGDGAGGRISNGTATSYIGASYVKFVEAAGARVIPLVYNEPEERLLEKLSLVNGVLFTGGSEKQGVYFETIKKSFQYALDRNDAGEPFPVFAQCLGFELVSMIVSKDNNILEMFDAQNQASTLQFPSYSFEGTVFQRFDSDLIKKVSTSCLVMQNHRYGISPKRFRENGELSSFFRILTTSPDENGKVYVSTVQANKYPITCTQWHPEKAIFEWRKPMIPHSEEAVQVTQHFANHFISQARKSPNRPPADKVLDNLIYNYSPTFSGKTSKSFEEVYIFS

SEQ ID NO: 558 - protein, 1579 aa, Setaria italica
MRALQQRTMRDLYDHTRHKDLAAPEEPAEGRGGGRAEGSGYRELVPKEDKAAVRKRLVPSNSTRLKAESGTCNVCYAPCSSCLHRSLAVEDSNAECASSQTCSARSEVRNNSLVRSEKGLHNKGENDDEFSATSGHVSYSITGGNNKVFARPSIADDSSEVDMPAKRRRLLNQNKKQSRAEHHDDSNSCVTGTSAEGKLHADKKKLSTSASSRDLTANDYKDNSMVCRSRLKNQCVDESKKGSDAHDMHPSSSGRLFPADSPISTKKLLRTQSSVSASSRLSPKKKAHECGTVQDNSSHQSCEKVSLSKNNVEQPRGGKLDPCVAGSGNHGTLAGYSNINANKAGFSSKDLENGSSCRKDEIQEHAGIQSNDGVTRNEGDKQEWDQDCSMDISSDGKLNIQHDMMTDCGTSEGLIDVNVCDICGDVGREYLLATCTRCLEGAEHIYCMRVKLDKVPDGEWLCEECQLREDQNNTRSNYGVTAVNMSEGKKNQSSESRNKPKALQIVVPELDAPESTRSTPKADQCDGKNKKLHLASADTQTRQAKVTPLASERLDVKSKKLLSIANRNKQVLPSDLDARPHTHGTPTAGGSNKKCQSSEFLLNRKKLRVSTDMESPSSSEGLRSPTMSCKRQAENNSSPKPRLLKTDSFRKHDVISRENSFKKSDKGGLTSVDNAPVRTTQAVKNSQALSRSYSLGNMVAKTPVPSPKGLLSKQLSFNSTNNGPKVKQLAEGVASKLRPANHSPRDPRDKGAVKKLVQSGSFKREGSVCLDAGSSKQKQTFHLSQDEKPGILKPVKEKNLMERRASFSFKKPSIPSSPRPDSCMKLGERKNDQDISRSGSSILKSSKRPGNVEKKQSSDLSKSDNDKQDVTIHPKSMGVVSGKVAHVPDPPVSSKCVKKESSNGVSKSDNDKQDVTVHPKSMGVVSGKDAHVSDPPVPSKCVKKESSNDVEDEDLFISVKNGSRMPNESAEVVLTSSTTMTSESGLRDVAIASTSEDSAPKVVCFQQKPLESTGDDSCKIVEAAQATGSILNEIPPGVQMAHNLYPPDDKLDKPDLKQEAFMDQSSALENPLRDLVIPEQSYIWQGSFEVSRHGNSPEIFDGFQAYLSICASSKAREVGEQLPDKIQLAEVPRLSSWPLQFKEVNPTEDNIALFFFAKDVESYERAYGKLLENMLLGDLSLTANISGSELLIFPSDKLPERIQRWNGLLFFWGIFHARKASSPPELPLTGTNNCSLQQITGSDVGSPKALQSLGIDLNECPNDDISDPAISLGSESEKSGAFVDHNTFLVSKHEDRKLNASEIHHEETADAKQIIPGHPTAASYGIHPPTLSTGEGHDMIRNYSTAAKGSTGTAGRNKMEEDQNEALFCAAQQPGAIGSISDEIKPKKHDLLPSIEVSQRHFIGSKICDGPSKLIPNSDMGSFDPDLTYKRQKTSYGKYSACSFGDEMQPSKCLSKIHPLPVGQHNPFDDLQYNYRVPSDPGSLKQPVPDHIIHVLSSDDEDSPEPSTSLNKASLKADESSSPLLSLSLSMVATKHNLSGSDIVDDEPLSLSLGLPSVVEGGRALEMKQFLPEKPGINT

SEQ ID NO: 559 - protein, 594 aa, Setaria italica
MEVSAMEEALPNPKARREGGLRTIPFIISNEIFEKVATFGLTANMILYLTERYLMSNAFATVVLYNWNAFSNFLPIFGAVLADACLGRFRVIALGSFVSLSGMCLLCLTAILPVYKKTPECAARVADCEVVPWQLPLLFTSFALMSVGSGGIRPCTLAFGADQLDRRDNSSSNVRTLQTFFNWYYTVLGLAIVFAATVIVYIQQTRGWVVGFAVPVVLMVTALTLFLLGSPFYLKAAADRSAIVGLVQVLVASYKNRHEPLPPETADASTFYNKAGSKPRTPTNKLRYLNRACVLRNPSKELSADGAACDPWRLCTVQQVEDTKAVIRVLPIWSTGILPGVIVGQQMFPTLQAKTMQRRVGGLEIPAATFGVFSILTLTVWVAVYDRALVRPLSRLTGHARGLSLRQRMGAGLALFAAAMAVAARVESARRAAAVAEGLRDSDPRSGTPVHMSAMRLVPQHCLMGLAEGLNLIGQIEFYYSEFPKTMSSIGVSLLALGLGFGALLGSAIVGVIGAATRGGGHDGWLPSNLNRGHYDNYYLVLAVLGTANVVYFLVCAWAYGEEGHNRVVAADAEAEAAVEDGNVKEEQQKAVII

SEQ ID NO: 560 - protein, 454 aa, Setaria italica
MVGSGAAGGGGDHARSKEAAGMMALHEALRNVCLSSDWTYSVFWTIRPRPRCRGGNGCKVGDDNGSLMLMWEDGFCRPRVAECLEDIDGEDPVRKAFIKMSIQLYNYGEGLMGKVASDKCHKWVFKEPSECEPNISNYWQSSFDALPPEWTDQFASGIQTIAVIQAGHGLLQLGSCKIIPEDLHFVLRMRHMFESLGYQSGFFLSQLFSSSRGASPTPPFPLKQPAPAAARPPPQLFNWPGHQPPQLPPAAGASPLFPPGPAAAFHPSAARPMPPFPGGKQDEGHMFHLPPAHHGGGKPPHMDEQHQQQAMGPGGGEAPDGDLRWPNGLSFFTALTGRADDAKLLFGGPGGGGGGADEEKAAPDAAQGGAENVEEYLSLESHSNKARRVESAAQSTKFKRSFTLPARMSSPASTSPSVSASTAPPPPQQQQQGMEYRGPHEGGVYSDLMETFLE

SEQ ID NO: 561 - protein, 259 aa, Setaria italica
MGCIKHIVLVHGACLGGWSWFKVATALRAAGYRVDTPDLAASGVDPRLLREAAPTFRDYTAPLLDLLAALPAGDRVVLVGHSLGGINVALAAELFPEKVAAAVFLCAFMPDFAARPSHVLEKFVEGKWLDWMDTEMKPQDAEGKLPTSMMFGPGILREKFVQLCSPEDVTLVSSLMRVSSMFVEDLAVQQPFTKGGYGSVRRVYVVCTEDHAIAEGFQRLMVENDPVDEVKEIAADHMVMLSRPDELVRCLTDIVEKYT

SEQ ID NO: 562 - protein, 194 aa, Setaria italica
MGASAAPFTGGFLCPTKPRTPPLPSSTSRSSHSRLHFRIRSPKPKNPAAAPVSSRMEASLPQARDAQGGAESAMKLLFVEMGVGYDQHGQDITAAAVRACKDAISSNSIPAFRGGSIPGVNTDQMKLQIKLGVPRSTQHLLDAERVKAVFPYGEIISFEVVDGGMICSSGVCLEAMGDKNDDCYIVNAAVYVGY

SEQ ID NO: 563 - protein, 466 aa, Setaria italica
MRLAGILSASTVLLPLLLVLGASPPCHGASGHNITDILAAHPDFTEFSAALTSTGAAAEINNRTTITVLAVDNDVMSQLKAQQLQPRDLERVIYLHCLLDYFDATKLGSIRGGFVQATSLYQATGKAQGGEGMVNVTMFRGGRVAFALSGTSNVPPAAFYQKSIKEEPYQIAVLQVSAPIWSPAPVAGAQAPAPEPPAPGLADLLSKNGCGGFASLLAATADAAAKFERSAGGGGGLTVFCPDDKAVTAFDATFKNLSADGQLAVLLYHGVAAHYSAQSLKTINGDVNTLATDGSKGYKYNLTVRADGDTVELSSASQSAAKVTKTVVDKGPLAVYLIDAVLLPSELFNASHGRTAPAPAPASSPAHAPPPAPAPASSPAHATPPAPVPASSPAQAPTPPAIAPATPPTPRRHPAPPQEADTPADSPDADSQPPADQKNNGARDTVSWSLGMVVAAAVPVIVLLLQ

SEQ ID NO: 564 - protein, 372 aa, Setaria italica
MELHKYWGVGGRRCGSCEAAPAAVHCRSCPAGGAFLCTACDARPGHARLAHERVWMCEVCELAPAAVTCKADAAVLCAACDADIHEANPLARRHVRVPVAPIGSEAAAAAVEAMLFGTAEAAASEADEPHNATAAAAAGHQHQHHHQHHALNLNVEAKDMKLDYLFSDLDPYLSVEIPRFQHADSVVPNGVGAGAGGAIELDFTCGIGVKPSSYSSYTATSLAHSGSSSEVGVVPEAFCGGGGGSFELDFTRPKPQAYMPYTATPQSHSVSSVDVEVVPERGDMAAARPVPLMGESREARLMRYREKRKNRRFEKTIRYASRKAYAETRPRIKGRFAKRADHDADADDAEAEAAVPSSSYVLDFGYGVVPSF

SEQ ID NO: 565 - protein, 371 aa, Setaria italica
MGCCFGKKAEQAVQGDGDVHSVKVFSYSELRKATQDFSGANKIGEGGFGSVFRGVLKDETVVAVKVLSATSRQGIREFLTELTAISDIKHENLVTLIGCCAEGSHRILIYNYLENNSLSQTLLGTRYSNIRFNWRARVKIAVGVARGLAFLHEEIRPPIIHRDIKASNILLDKDLTPKISDFGLARLLPPNATHVSTRVAGTLGYLAPEYAIRGQVTKKSDIYSYGVLLLEIVSGRCNTNTRLPSEDQFLLERTWGLYEEERLEEIIDIDVGDDLDVEEACRFMKIGLLCTQDAMARRPNMTNVVRMLTGEKRINVDKITRPAMITDFADLKVSNKGQRSSETRSPATTAPTTFTTTEPFSSSETPTQSSM

SEQ ID NO: 566 - protein, 265 aa, Setaria italica
MAILVISVDLECCRCRAKITKVLDCLKEEFCIEKVEFEEKLNKVIVRGKFSGEQLSKKIWCKAGRIIKEIKIVEVWPPPPPKPDPPKEDPKPEPPKEEPKPPKEEPKPDPPKEDPKPPKEDPKPPKEEPKPPPPPKPEVKWVPYPYPLPYPWSPSQSWPCSCPPQRPCQCPPPRPLPWPPLPPHCTCSKNDDKHDRCSACGGERPDPPAKPPCQCGGRPPWPPCSCGPNKQPFWWPPPPPPPPGVVYPPPWCNIVTEDNPGCSIM

SEQ ID NO: 567 - protein, 262 aa, Setaria italica
MAASAMLLLFLLLASPAATRLASAACASEKFPAGRAYATCEDLPKLGASLHWTYDASKSSLSVAFVAAPAAPGGWVAWGLNPTGEGMAGAQALVALKGSGSGAPTVKTYNISGYGLGASSPLEFPATELAADAGGSGGMIRVYGKLQLRKGMKAVNQVWQVGSSVTGGAPDKHAFGADNLSAKAKLVLAGSKAAAAGSPSLSPVPAPEAGGPSASGSGTDSGAASSMAPSAGKSPNAAALTAAGVSAPALLMMALVGFLVTV

SEQ ID NO: 568 - protein, 501 aa, Setaria italica
MAGGGGKRRRVGGGGHEDEEEEEMVVEEDRISDLPDALRMQILSLLPLKSAIRTGALSSRWRCLWEQRWPEPSSVRIRLPPGAAGAAARVEQFGLIDRRGRRRMDCFSLAFHGGQLTQPDLRRCLDYAAVCEVEDLHLRVDGGAGRGSRGGGGTRGRGMLTVHFPVGSRLLARLSVRGLNLTAAANAMVATLEVIHLHSVFLTDAALRRVVAACPRLRELDLRYCRRLRRIDFSAVGVPNLRTFTLVDCSRTTEVRVPMAPRLRSFRLSGAFLSSNILTGAGGSLEHLYLCSGGPENGLPPTNLPISVPHLSNLSVLTLCSIALQYISAFTAKAVVESKLQSLRELNFLMFGMANSNLADIYSFLKTCSCPQLERLFVQLPTNVRDSFTENFLEVAEEEPPKGGLENLWLAKMTNFKGHRNEMQLVEFLLRKSSCLKKLFLIAPTEDHPQGLRKIQSDVLPSFLKTEIMHLERASANTQIIFSEPDGPQIQPLHSEVFVRF

SEQ ID NO: 569 - protein, 302 aa, Setaria italica
MAASTAAAAAPPSSCEIARIPEDLLAASIARTTPRNACRAAAVSPAFRAAADSDAVWACFLPGDLPPLADGELSPAPPSKKELFMRLSNSDSPVLLADRLMSMWLDRDTGAKCYMLSARALCIIWGDTPRYWRWIPLADSRFSEGAELQDVCWLEIRGKIHCKMLSRNSTYAAYMVFKISDESYGLDYPPQEAAVTIGESKFTRQVCLQGHENEGEGIEEVPQNYRSLMVPAITRRLRRNRPLPHGVTVPKKRADGWMEMEMGEFNNEEGEDGEVSISLMETIQGHWKKGLIVQGIEVRAKK

SEQ ID NO: 570 - protein, 82 aa, Setaria italica
MGGGGMVFEPHAGAAVGGGDVVFCVAIALLSLLSMIIFAAAAGGEGKPRRSGRASGPVFVGGKGCGCGGCRAGAGVCGTYLS

SEQ ID NO: 571 - protein, 464 aa, Setaria italica
MAPAGRLLAVAALSVLCLQGLLRDSGTAFAQSHLPLHRIVHAGENDGGLMPELPPSGLMPMPELSPSGSPKPFVPFLAPAPLAPFFNNSTPKLSGKCTLNFTAVDKLMTTTAVDCFTSFAPFLANVICCPQLQATLTILIGQSSKQTGSLALDPTVANYCLSDVQELLLSQGASDNLHSLCSVHLSNVTEGSCPVSTVDAFESVIDSSKLLEACRKIDPVNECCSQTCQSAINEAAQKISSKDGGLTSYTGSLKIDSCRNVVLRWLSSRLDPPSAKQMLRQISNCNVNGVCPLSFPDTSKVAKECGGIIKNGTTCCKAMLSYVAHLQKQSFITNLQALNCASFLGAKLQKMNVSTNVYSSCQITLKDFSLQVGSQESGCLLPSMPSDASFDRISGISFTCDLNDNIAAPWPSSMQAPSSSCNKSVNIPERPAATSAQNGVNHKNLKLSLLVSLVSLVLVLVVQV

SEQ ID NO: 572 - protein, 1322 aa, Setaria italica
MPSLQLLQLTDRGRGLLASRRRTLAVVSGALIAGGALAYARSSQSQRSRRSEANYGSEASELATNGDGLSQNCRLAATKQKKSGLKSLHFLTAILLKKIGPNGTRYLLGLVLTAVLRTAVGHRLAKVQGFLFKAAFLRRVPTFTRLIIENLILCFLQSTLYQTSKYLTGSLSLRFKKILTDIAHADYFENMVYYKMSHVDHRVSNPEQRIASDIPKFSSELSELVQDDLAAVAEGLIYTWRLCSYASPKYVFWIMAYVLVAGGAIRKFSPAFGKLKSTEQQLEGDYRQLHSRLRTHAESVAFYGGENREASHIMQRFDALVGHLNLVRHENWWFGMIQDFFLKYFGATVAVVLIIEPFFSGNLRPDSSTLGRAEMLSNLRYHTSVIISLFQSLGILSISSRRLNILSGYADRIRELLDVSRELSGIRDKSLNHNSSSGNYISEANHIEFSDVKVVTPAGNILVNDLTLRVETGSNLLITGPNGSGKSSLFRVLGGLWPLVSGHIVKPGVGSDLNKEIFYVPQRPYTAVGTLREQLIYPLTEDQEIERLTYDGMVDLLKNVDLEYLLERYPLDKEINWGDELSLGEQQRLGMARLFYHKPKFAILDECTSAVTTDMEERFCKKVRAMGTSCITISHRPALVAFHDIVLSLDGEGGWNVQHRREDSSFSTEESDFSSLETDRKSDALTVQRAFMSRAKSNASLGSKDHSYSTEVIATSPKVEIEHAVRTSRVPHLRCHPRPLPLRVAAMLKILVPKLLDKQGGQLLAVAVLVFSRTWISDRIASLNGTTVKFVLEQDKVAFIRLIGVSILQSAANSFVAPSLRTLTAKLALGWRIRMTNHLLRYYLKRNAFYKVFNMSGKSIDADQRLTLDVDKLTTDLAGLVTGMVKPVVDILWFTWRMKLLSGRRGVAILYAYMLLGLGFLRAVSPDFGRLSGQEQELEGTFRFMHSRLRTHAESIAFFGGGSREKAMVDAKFVKLLNHSKILLRKQWLYGIVDDFVTKQLPHNVTWGLSLLYALEHKGDRALTSTQGELAHALRFLASVVSQSFIAFGDILELHKKFLELSGGINRIFELEEIICAAQRNTVVSSNAISASSEDIISFHEVDIVTPSQKLLASKLSCNVVQGKSLLLTGPNGSGKSSIFRVLRDLWPTFSGRVIKPSEGMFHVPQRPYTSLGTLRDQIIYPLSREEAEMKVLSLHQAGNRSSASILLDDHLKTILENVRLVYLLEREGWDSTPNWEDVLSLGEQQRLGMARLFFHHPKYGILDECTNATSVDVEEHLYRLATNMGITVITSSQRPALIPFHALELKLIDGEGNWELCSIRQ

SEQ ID NO: 573 - protein, 175 aa, Setaria italica
MVREVAESCVDGVVMEMVAAYCGRFYAAKPELAARRIEAIGFQVGHQLSERYTMERPRFSDHLEAIKFICKDFWSELFKKQIDNLKTNHRGTFVLQDNRFRWLTRVSLDPPAESTDATDNDSAPLGDTAAQTTSMLLYFPCGLIRGALTNLGISCSVSADMSNLPACSFVVRIKT

SEQ ID NO: 574 - protein, 754 aa, Setaria italica
MRLLVPDGARRQRLLQCEAHLPPASPPPAPASPAPAAEPAAGGRTVVVGIRRDAASRELLTWALVKVANAGDRVVALHVAAQHVAAAADGLLMGLDERSRAADSLASVLAVYDGFCNLKQINLELKVCGGSSIRKTLVKEAASCGAAHLILGVAKNSRSFGSSSTSVAKYCSKRVPVGCSVLAVNNGKVVYHKDGGHGMQHELYQSTIPETPRRSYRKLLSSMIGEKLWDEHGKDNRSISRAVTMPMRSPASSIPMRSPARSKEVSLALVPVKACRRESPEVATGWPLLRKKFLPDRKASLPDKSKMSVVQWAMRLPSRYSGVSPVHSEYRTTRPDSMSTSHILRDRLVIPLRSNSGKSSVVIQELDKETPEELTLLKEKFSSVYSSFSYSELAKITSDFSPECVVGQGGTSQVYRGCLANGRELAVKILKYSDEVLKEFVSEIEIVSSLSHKNVISLIGFCFKNDDLLLVYEYLQRGSLEEILHGEKECKNIFGWTERFSVAVGVAHALDYLHGNDNSRPVIHRDVKSSNILISECFEPKLSDFGLAVWAADVTSQMTCNDVAGTFGYLAPEYFMHGKVNSKIDVYAFGVVLLELISGRKPLCNGCPKGQESLVMWANSIIQGGKLTQLVDPNLPTEGHTNEVERMTLAASLCIRQAPQNRPQIDAVLKLLEGDNDILKWARSQVGLAYEVDGDECVMTPPAPGSNANIQSYINLAFDVDDDSASVSSTDFIAANTSLEEYLKGRWSRSSSFD

SEQ ID NO: 575 - protein, 575 aa, Setaria italica
MISLLRRTVSSSAPAAARWRRPLLAALLSPPPAPPGPTRRAPALEPPRRAFHGSRAPLGFRATPASWAGPGPGAGVAAGEDGGLEIARLGISGRIVEKLAARGITRLFPIQRAVLEPAMQGKDMIGRARTGTGKTLAFGIPIMDRIISYNEKNGSGRNPLAIVLAPTRELARQVEKEFRESAPLDTLCVYGGVPINQQMRVLNYGVDIVVGTPGRVIDLLRRGVLNLSEIQFVVLDEADQMLAVGFDEDVEVIMEQLPQNRQSMLFSATMPSWIRKISNKYLKDPVIIDLVGDSDQKLPEGISLYSIASDNFGKPSILGPLIKEHANGGKCIVFTQTKREADRLAYVMGRSYPCQALHGDISQNQRERTLSGFRDGRFNILVATDVAARGLDIPNVDLVVHYEIPNTSELFVHRSGRTARAGKKGSAILIYTYEQTRAVRVIEQDIGCRFTEKNGWDFGRESYGGFGDHRSGGFGDFDSFGGSFDRGGGSRDSGSGYRGGSGGFRRPSNDFGRSSFGRSDRFGDFGEGDFSRRGSPDFGRSRSSDDSGSSRYGRGSSGVGTPGFGNFGGYGDSKR

SEQ ID NO: 576 - protein, 407 aa, Setaria italica
MEVSSRLQSLLRPLLRLPSRTTGRALQTLALRPPPPPPRVPSSFLLLRPRRLPPPHPASAPSRLLLRPFASVAPVPGRDHLDSKDQGPPPAPLPPPPPEELASDDEAYYHEHLLEVAQENQTRVVPVKAFFLCTSIDLRSLQSQNSFNVIPPTSRATNYVVLRYYDVKGDPEGFKSGVIDESHCHYMVVFQYGSIVLFNVSDHEADGYLNIVEKHASGLLPEMRKDDYAVVEKPTLETWMQGGLDYIVLRDLSIDGIRTIGSVLGQSIALDYYIRQVDGMVAEFTDINRGMEKTGTFTMERKKLFQLVGKANSNLADVILKLGLFERSDIAWKNANYAQIWEYLRDEYELTQRFGNLDFKLKFVEHNIRFLQEILQNRKSDFLEWLIIILISVEILISVYNIVQEQM

SEQ ID NO: 577 - protein, 2096 aa, Setaria italica
MIRYQIRNEYGLSDPELYAAPGEEDDPEALLEGVAMAGLVGVLRQLGDLAEFAAEIFHDLHEDVMATASRGHGLMLRLQQLEAEFPAVEKAIISQTDHSNYPHDDGVDWHANLQLKQNMITQGDMPRFILDSYEECRGPPHLFTLDKFDVAGAGASLKRYSDPSFFKAEHTSNMLEIDVSIEKKPRRLKKKAIRWRKGATLESLLAKSESFTTPKDRTSRKVPPRTTKLKSRHPRSPDHKTISRICREHLLEVISSQQKIFSRYSGRQCHVRFRSTDSSETGEMENFGAIVQSSGKLELTKIVPINESNTMEIISAPTDGSAYLELGDKQILGKQHEPLEKNGMVRDLGKLQDCPNFQVGESNHSSHSGHEEKHILAGVPADQDADGCRPDDICSDQDNFIDALNNMGPEGEADPEIETEFDPSANVEQIELNRDSKEGEDALYAESPQVGPAIDSSPGFNSSCNAEEATCMDLPSDSANPAVSASNGPSSVSQSGRQLNDVDWIKDEEPFDDEDLMDVSSSSSVASVNAVLQTDEDLYGCQQHQEKAYHYQSSDNAAVIHSSDKHSPKTSSDLDGTAVGNNNYTDEVYCSMEQGQDVVLDDTSMVSSKPNYVPEDEDKLSFRIADDLFPHPTIPNQEEIQEMEKELEGGSLDTDASPGILASWPDKNHVMCLNDVEMDKDNVIVPEEIAADMAPTGLDPHDNHDHQDGIAPEHSGMRNNLPYESYDDEIAEDMHSLLNDGLSTPFNKDVAEDNQIVVLEGGACPASLNSHKEDSEQAPAMARNLSDVQEFPVVIQGVPSQEETEAHAVETLAPVSCVFSADTEPVGISVLPAPNTSSLPDNSSSCVEQHALTEMEDIVEGGKVVVAEESTTSRFADDVVPPEDFIDDAIYTEKTQILATDSTEEASRHDLQLQHNSPLREGLEPVEATDRNLGEVDASREYISKERMLQTDNIPPLNEIEPTGEKCSDRDEVLSAGHFPVESDYQEELLESSHNAGVHSLCDLDKDFAVSLKCNTMGEQPEDVDDQDLAWGMPDQDFTSTNPFMDPAYMLSLTQTCPSPIVSCQPCFPEEQDFLSELLVQHDNMGAAADSLWEPATPPDEAPLPSEVMTEEDFRSFCREYHEINFSAAAEGCHSEPASDSNNISNAFLVSESDFPSSVSALPVKLNQEACVHSKFGSQCAEPSSTMDIQGATSMTFSGKEDLTDETPGVDSHLKSDASFSVNRSSELDMLSVPVDLQQEQLSGIDSHSSSPLLDKEMTGEGCCSPSSDVVEVKHDLEIHANLALHSFINETGDELDVAVQVEPEVGAHADDNQDIPCCSTSEKDDSLMGKPVLVQESEVFAFGEFDSPIVPLSSIDDIEDNQDSASRTYVQTEQESECCTSGELDSQTTPSPLLDEKIDKLDGPPLSNAAMLDQESEVCVPSGLDSRIALCSSTDENVHELDHPPLSSSVLINPESEDHVLGDTSSKVTMCSLVEDKIDESEDPQPNHNFPEVRQEALASPELDFQVAPCPLNDDKVGEIEGPPSCNGRVESEKESDCSIESDSQSAPCSSNSPVLADTGVLTSPVMPNNEEMNQLSPGPPPAVQFQNDSYEDPQAQAPPPLPPLQWRLGRPRLGLLSRKSSMPEPARSIDPVFQASNQDMDIRLGLLDQPDRSIEPVSSQATEEDTHQSSLLDGSDQNVEVGLSTSVTVTGVARTEHYWPFSEASENIKGPEHISSSFNRNLDAGVTSATADEEHLDDSGVTHGAVLYSSDPLLRLPADEQQEPQLCTLSSDTRETSVHPSRMHPGASENDKSTDAAGGMESTSTKGPDYENSFYQQPQHVESFSKTSDYGEHITNASVEGVKHQSGTSETLSDPAKHSAPGTLLKDGNSKGSQILQEQNVGSSQDNKSGGPLPSSESMASEDYRHDEYNLERENRHPPSNPGPLVAWPGDKNNFFSGLDEASFAHAEQPPVMGWTVGPQMIHPKYGISAEESQFEPNITDNHLIKKPISIKNIPRNPLVDAVAAHDRSSMRKISELAPSADKPKPTERNLLLEQIRNKTFNLKPVAPSQPTAMRSPARANTRNLKVAAIIEKANAIRQAVGSDDEDADSWSDA

SEQ ID NO: 578 - protein, 1226 aa, Setaria italica
MEDDEYEEGMEMGYGGHHQHRGGHAGYAEEEEEVGYGGGDGDEMEEDGDAEQRDEEEITQEDAWAVISAYFEEKGLVRQQLDSFDEFIQNTMQEIVDESADIEIRPESQHNPGRQAEFAETLHKISFGQIYLSKPMMTEADGETATLFPKSARLRNLTYSAPLYVDVSYRVMKKGHDCEEVTETSDYPKVFIGKVPIMLRSSYCTLYQQSEKDLTELGECPYDQGGYFIINGSEKVLIAQEKMSTNHVYVFKKRQPNKFSYVAEVRSMAENQNRPASSMFVRMLSRAGAKGGSSGQYIRATLPYIRADIPIIIVFRALGFVADKDILEHICYDFSDTQMMELLRPSLEEAFVIQNQQVALDYIGKRGATVGVTREKRIKYAKEILQKEMLPHVGVGEFCETKKAYYFGYIIHRLLMCALGRRAEDDRDHYGNKRLDLAGPLLGGLFRMLFRKLTRDVRSYVQKCVDNGKEVNLQFAIKAKTITSGLKYSLATGNWGQANQAGTRAGVSQVLNRLTYASTLSHLRRLNSPIGREGKLAKPRQLHNSHWGMMCPAETPEGQACGLVKNLALMVYITVGSAANPILEFLEEWGTENFEEISPAVIPQAAKIFVNGCWVGIHRNPDLLVKTLRRLRRQIDVNTEVGVVRDIRLKELRLYTDYGRCSRPLFIVENQRLLIKKAHIRALQQRETPDEGWHELVSKGYIEYIDTEEEETTMISMTINDLINARHNPEEAYSETYTHCEIHPSLILGVCASIIPFPDHNQSPRNTYQSAMGKQAMGIYVTNYQLRMDTLAYVLYYPQKPLVTTRAMEHLHFRQLPAGINAIVAISCYSGYNQEDSVIMNQSSIDRGFFRSLFFRSYRDEEKKMGTLVKEEFGRPNRENTMGMRHGSYDKLDDDGLAPPGTRVSGEDVIIGKTSPIPQDDAQGQASRYSKRDHSTSLRHSESGMVDQVLLTTNADGLRFVKVRMRSVRIPQIGDKFSSRHGQKGTVGMTYTQEDMPWTIEGITPDIIVNPHAIPSRMTIGQLIECIMGKVAAHMGKEGDATPFTDVTVDNISKALHKCGYQMRGFETMYNGHTGRKLTAMIFLGPTYYQRLKHMVDDKIHSRGRGPVQILTRQPAEGRSRDGGLRFGEMERDCMIAHGAAFFLKERLFDQSDAYRVHVCEKCGLIAIANLKKNSFECRGCKNKTDIVQVHIPYACKLLFQELMAMAIAPRMLTHDMKTGKDQKKR

SEQ ID NO: 579 - protein, 722 aa, Setaria italica
MARTNWEADKMLDVYIYDYLVKRNLQATAKAFIAEGKVATDPVAIDAPGGFLFEWWSIFWDIFHSSTAKPASSSASGPPLHDINKSREHQMRLQLLHQHNAAQLHTRGPDVSAVLASKMMEDRIRNPNPADSDASQHLLDANRIALLKSPPNQTGPPPMQQQQIHPRNQQLDIKPDVAMPQRTVPADHSSLYASGMMHPKPPLLAAGLNQAGGSVPLKGWPLTVTGIDQLRSNFGAQKQLVPSSNQFQLLSPQQQLIAQAQTPNDLTRMSSPAPSASPNVRSDDPDYLMKLKMAQMQQPSGYRPMELQQPQQQNTRKRKPTSSGAANSTGTGNTVGPSPPSTPSTHTPGGGVPVTSNANILQKSSMICGTDGTSGLASSSNQMDTLDSFVDFDENVDSFLSNDDGDGRDMFAALKKGSSEHNSESLKGLSLSEVGNNRTSNNKVVCCHFSTDGKLLASAGHEKKVFLWNMDNFKMDTKIEDHTNFITDIRFKTNSTQLATSSSDGTVRLWNAADESGTLQTFHGHTSHVTSVDFHPRLTEVLCSCDDNGEIRFWKVGQTTSTHVLRAKQGGTGRVRFQPRSGQLLAVAGGSMVNIFDVEKQANLPSPAKGHNSEVNCVCWDESGEYLASVSQDTVKVWSVSSGACIHQLRSHGNQYQSCVFHPRYPKVLIVGGYQTLELWSLSDNQRNPIQAHEGLVAALAHSPFTGMIASASHDRYVKLWK

SEQ ID NO: 580 - protein, 567 aa, Setaria italica
MLFARRPLSAALHLAPLSPPLLLFFASASSSCSPAAASASGGTRGCSAVRMDSGAVETTSTGAVWSTPSAEPRSVSIGKAIFCNRSLNMRNITAVGFDMDYTLAQYKPETFEALAYYGTIEKLVKDLHYPEELLTWEFDWKYMVRGLVLDKKRGNILKMDRHKYVKVAYHGFRELSKEEKVAAYGSTLIRDSFDEPDYALIDTLFSLGEAYLFAQLVDFMDNNPGKVPAGTDYPLMYKDVRSAVDLCHRDGTLKRMVAKEPGRYINEDLAIVPMLEMIKKSGRSTFLVTNSLWDYTDVVMNYLCGAYTSDAGSGLNHKWLQYFDIVITGSSKPSFFHDDNRAGLFEVEPDSGKLLNADIQIGSPRSSHQHATPVHKVYQGGNVGHLHRLLSIASSSQILYVGDHIYGDILRSKKVLGWRTMLVIPELEHEVKLLSESKSTRKELRHLRMERDSIEDRIHHLEWSLKFDDITENQKEKLFSEHVDLLQQREHVRRLHQEAQRQHHQKFHKVWGQLMKTGYQNSRFAHQVERFACLYSSQVTNFGLYSPNKYYRPSEDYMPHEFDVLGL

SEQ ID NO: 581 - protein, 380 aa, Setaria italica
MTTTMMRLRQHLASSPIYTSAIARIGNSRAPHRLLPVAPPQKHRPTSTTNKPLLLILLLLCFFFLFLIPTVLLPPARVMSSSSSASDAAAAAVPFEKPRAVVKKLLAESQPEGQGATVRRSIGRHELRNLDPFLMLDEFSVSKPAGFPDHPHRGFETVTYMLEGAFTHQDFAGHKGTIRAGDVQWMTAGRGIVHSEMPAGDGVQKGLQLWINLSSKDKMIEPRYQELQSKDISRAEKDGVEVRIIAGEAFGVRSPVYTRTPTMYMDFTMRPGSQLHQPVPEGWNAFVYIIDGEGVFGREKSAPVSAHHCIVLGDGDGISVWNKSGAPLRFALVAGQPLGEPVVQHGPFVMNSRAEIQQAMEDYYYGKNGFERASQWSSSA

SEQ ID NO: 582 - protein, 270 aa, Setaria italica
MQRKNFRKRSFEPDADDRSDDEDTRRVVLEEIKYMQKLRERKLGIPADPAAASTNGSAARGLVGGGGAAIGEAEKEDLVLQDTFAQETAVTIEDPNMLRYVETELAKKRGKTVDVGHKEEMDHVDELYTVPDHLKVKKKNSEESSTQWTTGIAEVQLPIEYKLRNIEETEAAKKMLQEKRLAAKPKSDSNIPSSYSADYFHRGKEYDEKLRRENPGLYKDKDSRPNESAGGKATDTKNTAGAGAGRREAASDDIMLERFRRREKIRVMRR

SEQ ID NO: 583 - protein, 249 aa, Setaria italica
MENVLLDRSSGSFEFPKRSLGRSRRGLAARPAAPGGAYSSFPTYQPPYSGAWTSAPALPYARPPIYSSPSLPLLPSNQPPLLPLPPTATKYATFPCLPAAAPPPSPPPAPRAAGRGSAGVTTAVPAAAAPAPARRERDRRRRPARPPPPPSTAEAPRAQKKKPLERATPLPPAPVVTEALDDLEREVARNFVQDLLHALAPPPSSLPLPRFSLVAKASPATSPRVVAPAAPSCNVEAAAADGIHGLLRL

SEQ ID NO: 584 - protein, 249 aa, Setaria italica
MEEYGGGDLLTEAMGSAARLVVVEDCVEAPGAFVLHLLLKRALAGGGAAAFLALAQPFTHYDRILRKMGCNLSLHRRNERLHFFELQAFPGGARDGAIADSFVRLYSEIQRVAEATRSGENAGQFTIVIDDVSLLEVAAHGSIDNVLDFLHYCVTLTSEMNCSLVILVHEDIYAGEENNGLLLHLRHIADLVVKAAPLSTGLAADVHGQLSVVNKGTFSEQRAKAQKVWNFHFKVKENGADFFYPGSRH

SEQ ID NO: 585 - protein, 263 aa, Zea mays
MLVIIAEVFVNIYFFSIDFARASIFYCNTMNSHGAGSHSRLLDLNYPPAEGAGEGASRFSSIPVSHREGSSSMPVQHIQASSSTPPATGEPRIGMRSCPIDVEAIDDDAVIYSSRPLPRARQQLTTTESITIIIDDDSETNLETAGDALDEHVNLLLSLGIERSHEPTSATNTFPGISMVDTPKVNTFKWIQVPPEPVKEVPKEPKLSCPICMNEITEAASTVCGHIFCQPCIKAAIKAQKKCPTCRRKLTPRQQHRVYLPSP

SEQ ID NO: 586 - protein, 140 aa, Zea mays
MAHSLAASFSPAAARRQVTNVISSRSSVSFQSHRMTSVSIRSRPSSLRFKICCSAKKETVDKVCSIVKEQLALPDGTAITGESKFAELGADSLDTVEIVMGLEEAFNITVDETSAQDIATVQDAADLIEKLMLEAPPKVV

SEQ ID NO: 587 - protein, 175 aa, Zea mays
MLATTCSRPPCPCPCARSRRLPAATFGGTSSAKRRAPRRAAAAVRCGLLPVDPWAPTMDSQSVASQLFAVSLFPYLGFLYFMTRSKTAPGLTLFGFYFLLVFVGATIPAGIYAKVHYGTSLSNVDWLHGGAESLLTLTNLFIVLGLRGALRKLEEEGTDEIVSEASQDSAEKSSV

SEQ ID NO: 588 - protein, 1016 aa, Zea mays
MTWFRAASGAARLALRRSLATRTPPAAATRCGRCFHSTAMRPRSAAPVPRAVPLSRLSDSFLDGTSSVYLEELQRTWEADPSSVDESWDNFFRNFVAQASPSAGVSGQTIQESMQLLLLVRAYQVNGHMMAKLDPLGLDDRAVPEDLRLGLYGFTEADLDREFFLGVWRMSGFLSENRPVLTLREILNKLQQAYCGPIGYEYMHIPDRDKCNWLREKIETAKPKEYNKDRRLVMLDRLIWSTQFENFLATKWATAKRFGLEGGETLIPGMKEMFDRAADLGVENIVIGMPHRGRLNVLGNVVRKPLSQIFSEFTGGTRPVEGEDGLYTGTGDVKYHLGTSYDRPTRGGNRIHLSLVANPSHLEAVDPVVIGKTRAKQFYSNDADRTKNMGILIHGDGSFAGQGVVYETLHLSALPNYTTGGTIHIVVNNQVAFTTDPRAGRSSQYCTDVAKALNAPIFHVNGDDLEAVVCVCELAAEWRQTFHSDVVVDLICYRRFGHNEIDEPSFTQPKMYQVIKNHPSSLKLYEQKLLGTGEVMKEDVQRIHDKVNRILNEEFAKSKDYVPNKRDWLSAYWTGFKSPEQISRVRNTGVKPEILKRVGQAITTLPENFKPHRAVKKIFELRAAMIESGQGIDWAVAEALAFATLIVEGNHVRLSGQDVERGTFSHRHAVLHDQETGAKYCPLDHVAMDQNEELFTVSNSSLSEFAVLGFELGYSMENPNSLVLWEAQFGDFANGAQVMFDQFLSSGEAKWLRQTGLVVLLPHGYDGQGPEHSSARLERFLQMSDDNPFVIPEMEPTLRKQIQECNWQVVNVTTPANYFHLLRRQIHREFRKPLIVTAPKNLLRHKDCKSNLSEFDDVEGHLGFDKQGTRFKRLIKDRNDHKQVEEGVNRLILCSGKVYYELDEERKKSERGDVAICRVEQLCPFPYDLIQRELKRYPNAEIVWCQEEPMNMGAYSYISPRLFTAMKALGRGSFEDIKYVGRAPSAATATGFLSVHAQEQSELVKKALQAEPIKFL

SEQ ID NO: 589 - protein, 210 aa, Zea mays
MSAGLVTDEATVGRLYRIRRTVMQMLRDRGYLVVDHELATSRRDFLRKFGESFHREDLLINKYKKNDPSDQIYVFFPNDDKVGMKHIKKYVEMMTHENVSRAVLVLQQNLTPFAKSFLIELEPKIHLEIFQEAEMLINIKEHVLVPEHQVLTNEEKKTLLERYTLKETQLPRIQITDPIARYYGLRRGQVVKIIRPSETAGRYVTYRYVV

SEQ ID NO: 590 - protein, 275 aa, Zea mays
MVAAAAEVSTAATASSSPPAEEGERRDESESDGEMAGLAAVLDFDMLCASVALSAERRKAGAALAGAAGDCGGGGGGVQRMWEGDVVLDCLDDRRIALETSCCPCYRFGKNMRRANLGSCFLQGMVYCILLAAVLISLIAFSVTRHHIYLYMGIGSVLLIAIYTGYFRRRIRKQFNIRGTESSLDDCVLHLICPCCTLCQEARTLEMNNVQCGVWHGRGDTICLGSNGAGNKAFAALNKASLVPVKSPGLCGMDRSSSAADEQQPLVPPDQLEQV

SEQ ID NO: 591 - protein, 422 aa, Zea mays
MGAKRAVLVGINYQGTKAELKGCHNDVARMRRCLVDRFGFDESGIRVLIDDGSAPQPTGANIRRELARLVGDARPGDLLFFHYSGHGIRLPAETGKDDDTGYDECIVPCDMNLITDQDFTELAQKVPSGCLFTIVSDSCHSGGLLDKTKEQIGHSTKQKQKQTQTQTQSRELEERSPSGTSFREFLKGTVREAFESQGIHLPHRSRSHQQGSGHGDDGDQESRYINTADAHVKNRSLPLSTLIEMLKEKTGKDDIDVGSIRLTLFNLFKDDASPKIKKFMKVMLNKLQQGQHGGIVGFMGALAQEVLKAKLDGKEEEEFDPAMKQHVHSDQEVYAGTTARVPSNGVLISGCQTDQTSADATTPKGVSYGALSNAIQAILAERGTVTNKELVLKARKMLSKQGYTQQPGLYCSDENASAAFIC

SEQ ID NO: 592 - protein, 354 aa, Zea mays
MPYLVRERLYFGGIKDAIAALTESSSTPDFTHVLSVVSSASISFITDCRPGLEIPTEEVLRVVAGEEGAAPTAAVPPGTLMRVVERAGHGLRVTRMAVPLRDTEEADLLDRLEPCLEFIDEGRKVGNVLVHCFAGVSRSASIIVAYLMRAEQKSLEEALEALKEISESACPNDGFLDQLKLFEEMGFKVDTSSPLYKRFRLKLLGQSYISGEKISSYMFEDDPGLSLESGSCQDSSKVEQRKTAYRCRKCRRVIAVEGNVISHVPGEGESCFDWNRRKSGHPYNNKEHGCSSLFVEPLKWMTPVEDGALEGKLSCIHCGARLGYFNWSGIQCNCGSWVTPAFQIVKSKVDISTI

SEQ ID NO: 593 - protein, 96 aa, Zea mays
MASLSRTAAAAVVALRSAVRSAPLTGRVLGAPLPSFASPSATRSARILRRSAAAASAGLETLMPLHSAVAAARLRSCIAVDSSCWCSLSQGLNKRI

SEQ ID NO: 594 - protein, 375 aa, Zea mays
MELGKPLSAHRCSYTATYTHCSIGFSPRVVRTSWIRAAAEGGDGGADRRRRGASFAADGPRVVEVAAAPVATSGGAAGAAGSAGFGARDAELAMWDKLGAVVRLSYGIGIYGAMALAGRFICQMAGIDCTGGFHPSLTALVEGLGYAAPPIMALLFILDDEVVKYSPHARAIRDVEDEELRSFFCGMSPWQFILIVAASSIGEELFYRAAIQGALADIFLRSTELMKDARGIASLSGIVPPLVPFAQTFAAVITAALTGTLYYVATTPKDPTYVVTPAMRSRTGRENLKKLFAAWYERRQMRKIYSPLLEGILAFYLGFEWIQTDNILAPMITHGIYSTVVLGHGLWKIHDHRRRLRQRIQKVRSEGSSSADDTL

SEQ ID NO: 595 - protein, 618 aa, Zea mays
MAAAAAATSLLIRHNRNPHLLLLRAAISSSRALSQQPELSPDPTTGAPDPAGAAPLPPNPSTGSPLYSQNWRNPAAANPPSSLLPTVAAGSSFGAQHRMAAFYDKPDAAGLKETFAKYMAEQRWEDMKLLFDHWVRSLDAATGKPNHPDVDLFNHYLRANLMTGAVPHEMLDLADHMREFELEPNSASYNLVLKSMVADKESYGAEKLIERMLQTGTVPDEESYNLVVGLLIRQNLVDSSLKYLDLMLKSGYTPSLTVFTDYIQACVRSGRLDTLTSIIQKCKTADKIKVLCPQWAWCIDISEAAFEANNSKLALFALEFLARWIVRGENVKPPVQLSVNEGLVISALSAAGRTFSTDLLNAAWSLLRKSLRQKRAPTPETYLAKIYAHSSIGQLQRAFGTLHEFENAYGNSKDVDLELFSPFTSLHPLVVACCKDGFSTLDLVYVQLENLSHADPPYKSVAALNCVILGCANIWDINRAYETFVAIKEKFELSPDIHSYNALLCAFGKLKQTGEACNVFQHVLTLGVKPNATTYSRLVDAHLANKDPKAALAIIDEMVDAGFTPSKDTLRKVRRRCSRESDFDSDEKVQSLAKQFNYRMGGENRREMLYSIEYNPVY

SEQ ID NO: 596 - protein, 248 aa, Zea mays
MSLTLLQGYSSAEDDDDPAAGAGAGTELSESGDSSAEEAGSDEDEESAPPKPPPKLRRRPNPKGGDAGGSDGGSLLPSALEAFADVSGPPDFLRHRVAEPEEGTEALGVLDRRGKEGSKQPPPGAVVVAKPQIVAIRERVTTTGANPPGSVTAGSIDGKRVIGAANPGPEDAADLLRMCLQCGVPKTYSHGKGMVCPQCGGRPMQTKEPEKKKGSTVKDKEKVKRMRGQSSHASWKSETEMALRQQFD

SEQ ID NO: 597 - protein, 223 aa, Zea mays
MLFLRCQPRVPSASAPPFRPRVRVAAPLGVRVTGGRRGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRDKLGDRPVFVLVEADA

SEQ ID NO: 598 - protein, 345 aa, Zea mays
MLLTKPYLSNSLLPVPSPPPSGPTLSSNHASPLAAPTCRRSRLRISATSTAAPSPSSAAAATASLSRVDVLSEALPFIQRFKGKTVVVKYGGAAMKSPELQASVIRDLVLLSCVGLRPVLVHGGGPEINSWLLRVGVEPQFRDGLRVTDALTMEVVEMVLVGKVNKNLVSLINIAGGTAIGLCGKDARLITARPSPNAAALGFVGEVSRVDATVLHPIIAAGHIPVIATVAADETGQAYNINADTAAGEIAAAVGAEKLLLLTDVSGILADRNDPGSLVKVVDIAGVRKMVADGKVAGGMIPKVECCVHALAQGVHTASIIDGRVPHSLLLEILTDEGTGTMITG

SEQ ID NO: 599 - protein, 539 aa, Zea mays
MWAVHGRESTAAALRLLLIAIACGLVFALLHLPLPDDRARTADPGGQRGAAGGGGARLSVQQGRVREARRLSVVTEETDGQTDETAAEEDERISKSPPDTKEKIWMMQDQLILAKAYLHFASPQGSVHLVRELKLKIKEIERAISHSSGGTHVPGSVLQKIKAMELTLSKAQRTYPHCSQMTSKLRAMMHNSEELVRAHQSESSFLEQVAVRTLPKGHHCLAMQLTAEYFSLDPTKREFPKRDNIQLGGYYHYAMFSDNVLASAVVVNSTIAASKDPGRILLHIVTDALNYPAMMMWFLTNPPTPSVIQIQSLDDLKWLPGDFSSRFKLKGVRDPRYTSALNHLRFYLPEVFPSLSKVLLLDHDVVVQNDLSGLWDLDMKGKVTGAVDTCTSSEGFRQLDSLIDFSNPSVFNELDPKACAFAFGMNIFDLNEWRKQGLSTTYHRWFQLGKSEKLWKAGSLPLGQVVFYNRTLPLDHRWHVLGLGHDSSIGRDELESASVIHYSGKLKPWLEISIPKYRGYWNRYLNYDNPHLQQCNIHG

SEQ ID NO: 600 - protein, 369 aa, Zea mays
MFNFQEMSCCFTCATGMERNNENEGGSKVRIFSYSEMRKATHDFSGANKIGEGGFGSVFRGKLKDGTIVAVKVLSANSRQGVREFVTELTAISDIVHENLITLVGCCAEGSQRILVYNYLENNSLSYTLLGSGRSNIRFNWRARVKIAVGVARGLAYLHDGIRPPIIHRDIKASNILLDKDLTPKISDFGLARLLPPNATHVSTRVAGTIGYLAPEYAVRGQVTKKSDIYSFGVLLLEIVAGRCNYNSRLPQGDQFLLEKTWAYYVQGKLEKVIDAEAGEDLNVEEACRFLKVGLLCAQDAMKLRPNMASVVLMLIGEKGISVDRITKPAVIGDPYLDRRPSNADSTTMKSFATTEALTSSEANTEWSL

SEQ ID NO: 601 - protein, 370 aa, Zea mays
MSLCSKLFALLRKSRALATSTAAAAAATTSATASANGMEEAVAAAGPLRTRVCIIGSGPAAHTAAVYAARAELKPVLFEGWLANDIAAGGQLTTTTDVENFPGFPDGILGADLMDRCRAQSLRFGTKILTETVTTVDFSARPFRVASDDTVVHADSVVVATGAVARRLHFAGSDAFWNRGISACAVCDGAAPIFRNKPIAVVGGGDSAMEEANFLTKYGSQVYIIHRRSDFRASKIMQARTLSNPKIKVVWNSEVVEAYGGADGGPLAGVKVKDVVTGEVSDLQVAGLFFAIGHEPATKFLGGQLELDSDGYVVTKPGSTHTSVQGVFAAGDVQDKKYRQAITAAGSGCMAALDAEHYLQEVGAQEGKTD

SEQ ID NO: 602 - protein, 186 aa, Zea mays
MDPTGVDGDSAAARGSGGGGGGGTGAGRWAVGAVCGGLVYYHCAVRRASAVSLAADVLLVLLCSLSILGLLFRHLHISVPVDPLEWQISQEMANSIVASLANTVGAAESVLRVAATGHDKKLFFKVVSTLYFLAALGRVVSGAAVAYAALCIFCLYMFAQSTDLFDQLPSWVPVGRDSLGGTQDTA

SEQ ID NO: 603 - protein, 501 aa, Zea mays
MAASSLLRSFTRRSCAGPSAFAYRHHQRQQPWSPFSTSAAAVTQDEAAKRFPGLGPTAKGEKARVVVLGTGWAGSRLMKDLDTQGYDVVCVAPRNHMVFTPLLASTCVGTLEFRSVAEPVARIQPAVSKSPGSYFLLARCTGVDPDGHTIDCETVTDGEKDSLEPWKFKVAYDKLVFACGAEASTFGIHGVTDHAIFLREVHHAQEIRRRLLLNLMLSDLPGISEEEKCRLLHCVVVGGGPTGVEFSGELSDFIIRDVKQRYSHVKDYIHVTLIEANEILSSFDVRLRQYATKQLIKSGVRLVQGIVKDVQPNKIILDNGEEVPYGLLVWSTGVGASPFVKSLPFPKSPGGRIGVNEWLRVPSVHDVYAIGDCSGFLESTGKEVLPALAQVAERQGKYLASLLNHVMKAGGGHANSETEADLGRPPFVYKHLGSMATVGRYKALVDLRQSKESRGISLAGFVSWFIWRSAYLTRVVSWRNRFYVAINWLTTLLFGRDISRI

SEQ ID NO: 604 - protein, 571 aa, Zea mays
MSEAVAAGESPVELLLRAAAMVPAERYALAAIIVVSVFLYRFLELHVIGDILRGFRGGRVELTFHPASEIYHRVASKCRLLHGRYLATPWLASPHLQTLFLGIYGTPPSFTYKRQLYTVRDGGTIALDWLFASDLEVADGFISKDASTPLVVVVPGLTSDSAAAYVKHLVYSMASKGWNVVVSNHRGLGGVSITSDCFYNGGWTEDVREVITHLHHRYPKTTLFCIGTSIGANIVVKYLGEEGENTPIAGAVSICSPWDLLIGDRFISRKLVQRIYDKALAIGLKGYAKLHQPVLARLANWEGIKKSRSIREFDHHATCVVSRYETVDTYYRRCSSASYVGNVSVPLLCINALDDPLCTREAIPWDECRANKNIVLATTPNGGHLAFFQGLTARRLWWVGATSEFLSALHDSSYMHRQKANDHVLLSSLESSIDKSPYVNLMEDGMVAAVTKDGPSNDGSPLNHAADEQLSNEAGGGQQNVVSALNHNENSIGVGNDSPAEPVKQQGDDIHSNKLHEIIAPVKRSMSQLTRYQGRSVWLLAYIAFVTSWPLLGSLAFITFRKKSRNPLRAK

SEQ ID NO: 605 - protein, 427 aa, Zea mays
MRALVRIHLPTAISTGSFLHTSSTAASKTLVPNPNLVPLRLVRHFPAMAATAADEFVKGRVFPNGVAVITLDRPKALNAMNLEMDVRYKALLDEWETNPSVKCILVESSSSRAFSAGMDIKGVAVEIQKDKKTPLVQKVFTVEYSLICKIHEYAKPYICLMDGVTMGFGIGLSGHGRYRIITERTLLAMPENGIGLFPDVGFAYIGAKAPGGGAVGVYLGITGKRISSPADAMFIGLGTHYVPSANLGSLKESLLSANFTNDPHRDVESVLTGYKKEPESEPQLKKLLPYIISSFSPDKSVAESVEELKKCSRSGDAAVAEWANEALAGIEKGAPFSLCLTQKHFSQVASAYGTSEHYLSKLAGVMKLEYRIALRSSIRNDFVEGVRAVLVDKDQNPKWNPATLEEVNMAEVESVFEPLGAEAELSV

SEQ ID NO: 606 - protein, 595 aa, Zea mays
MAEVGSRVRGFLRNRWLVFVAAMWMQSCAGVGYLFGSLSPVIKASLGYNQRQVAGLGVAKDLGDSVGFLAGTLCAVLPLWAALLVGAAQNLVGYGWVWLAVTRRVPVPPLWAMCILIFIGNNGETYFNTAALVSCVQNFPKSRGPIVGILKGFAGLSGAILTQIYAIVHSPDDAALIFMVAVGPTMVVIALMFIVRPVGGHRQVRPSDGTSFTFVYSVCLLLASYLMGVMLLEDLVDLSQSVTVVLTVILIMFLLVPIVIPVLLSFFSDDDETLYALLLPSPRKEEASASTSSEEQHEVILSEVEDEKPKDVDLLPASERQRRIAELQTRLFQAAAVGAVRVKRRKGPRRGEDFTLMQALIKADFWLLFFSLLLGSGSGLTVIDNLGQMSQSLGYEETHIFVSMISIWNFLGRIGGGYFSEIIVKDYAYPRAIALAIAQVLMAIGHFNFAMAWPGTMYIGTLLVGVGYGAHWAIVPAAASELFGVKNFGALYNFLTVANPAGSLVFSGVIASGIYDSEAAKQAQQRHNSTSLAMSGRVAGMVSGAAPSLKCEGAVCFFLSSLIMSGFCIIAFGLSLILVYRTKIVYTSLYGKPRT

SEQ ID NO: 607 - protein, 406 aa, Zea mays
MLRQSSSRNQRSRGLKLKKALQISLLLLVSVWLLYQVKHSYEKKAAYSEGEVNDLHKDDKGQGEAVRLGRKDVPPKMEADSSTLDERVEDEENDEVEQEMKHDENDEDPIDEQDLEKDEDLPEPGEHSSEKDEDVGVFEDEERKERSQEDQEKSFHGDDVSSAVTHDPQSSEQDELFHHAQDTVLFVDDASTAVPNENHVAGNDEEEVQRARERSFRGDDVSSSVDHDAKVAKPLPEEQLNSMDKIFEGTTNLSNGISFRAPGINGSYAGMDNVATVPTNSPSQKNAGTPSNDIESKTHPSPANLTGPEQSNSTLKDHPDQQVNSTAVLGNQVQPLTNQTPWPELDSPNGTLALVTDVQKSTSGAGDDGSSTVDKRTDGRDGPKEDVDVSTKIMNRAISEDEVVPE

SEQ ID NO: 608 - protein, 218 aa, Zea mays
MVRLAKFYLVCYNSLQSLGWFVALLRLLPCLVPPFPVHSAYVVAGDLICFLQTCAILETVHAAIGLVPTAPLLAFLQWGGRIHFILAVVRQIPEVQSSPSVFITFIAWSISEVIRYSHYALTTLKVCPAWLTYLRYTAFIPLYPIGVGPGEMWTMYQALPFVKKRDLYSGFFEKFSMSYRSFLVGVLVLYPFLWLKLYQHVFKQRKSKLGKGSRKKRA

SEQ ID NO: 609 - protein, 124 aa, Zea mays
MATSTAAATALLRPRPAVPAKLAQRRCLHAVAGWTTMRRRGAAGVVRAFFNPLGDERILREAIKEPVAFMGGVFAGLLRLDLNEDPLKEWISRTVEASGIAEENSSEESSEADQNDAPQQIEIE

SEQ ID NO: 610 - protein, 154 aa, Zea mays
MASSSTLDLAMGPGALLPRSAVPYASFAPGRGRSASGTRSRNLALSASSSNGAAVPSLTTDSEKKGPVIMEIPLDQIRRPLMRTRANDPVKVQELMDSIRVIGLQVPIDVLEVDGVYYGFSGCHRYEAHQRLGLPTIRCKVRRGTKETLRHHMR

SEQ ID NO: 611 - protein, 139 aa, Zea mays
MAAPATSSLLSTLLQLPLAPFSGKSSPPSVVHVARRAPTAVVAAKGFNVQILVDENEGEESIFRRFRREVMRAGVLQEIKRRRRYESKTDEKKRKAREAGRRNRRRRMMDEPRFPEEDADATSKARDEDNDNWEVDGIL

SEQ ID NO: 612 - protein, 120 aa, Zea mays
MAPSSDLTQVATVAPLGAFPAPQVSCLAELALHSAHGARPPARPYPLLGARAAPLPSPRAPPCFQVVARPWHQLGARPAASLTLLPVALAGRLLDPSSGSSPTPSLRTAVPPAPARFRPE

SEQ ID NO: 613 - protein, 1508 aa, Zea mays
MESAMEKVWESGRRMSRSIGRGMGMEAWGVDDAFVPQHGSRSRGGGGGGGDDDEEALRWAAIERLPTYSRVRTAILSTENAAVVDDDDDKTRRPPPPQQQHFKEVDVRKLGVGERQEFIERVFRVAEEDNQRFLQKLRNRIDRVGIELPTVEVRFERLTVEARCHVGSRALPTLLNTARNVAEAALGLCGVRLGGRQARLTILRDVSGAVRPSRMTLLLGPPSSGKTTLLLALAGKLDPALVVAGGGEVSYNGFRLGEFVPQKTAAYISQTDVHVGEMTVKETLDFSARCQGVGTKYDLMTELARREKGAGIRPEPEVDLFMKATSMEGVENSLQTDYTLRILGLDICADTIVGDQMQRGISGGQKKRVTTGEMIVGPTKVLFMDEISTGLDSSTTFQIVKCLQQIVHLGEATILMSLLQPAPETFDLFDDIILLSEGQIVYQGPREYVLEFFDSCGFCCPERKGTADFLQEVTSRKDQEQYWADKQMPYRYVSVPEFAQRFKRFHVGLQLENHLSLPFDKSRCHQAALVFSKHSVSTTELLKASFDKEWLLIKRNSFVYIFKTIQLIIVALIASTVFLRTHMHTTNLDDGFVYIGALLFTLIVNMFNGFAELSLTITRLPVFYKHRDLLFYPAWVFTVPNVILRIPFSIIESIVWVLVTYYTIGFAPDADRFFKHLLLVFLIQQMAGGLFRATAGLCRSMIIAQTGGALFLLIFFVLGGFVLPKVFIPNWWIWGYWISPLMYGYNALAVNEFYAPRWMNKFVLDQNGVPKRLGIAMLEGANIFVDKNWYWIGAAGLLGFTIFFNVLFTLSLMYLNPLGKPQAVISEETAKEAEGNGHSKGAIRNGSTKPKDGSHNKEMKEMRLSARLSNCSSNGVSRLMSIGSNEAAPTRGMVLPFNPLAMSFDNVNYYVDMPAEMKHQGVQDDRLQLLREVTGSFRPGVLTALMGVSGAGKTTLMDVLAGRKTGGYIEGDIRIAGYPKNQATFARISGYCEQNDIHSPQVTVRESLIYSAFLRLPGKIGDQEITDDIKMQFVDEVMELVELDNLRDALVGLPGITGLSTEQRKRLTIAVELVANPSIIFMDEPTSGLDARAAAIVMRTVRNTVDTGRTVVCTIHQPSIDIFESFDELLLLKRGGQVIYSGKLGRNSQKMVEYFEAIPGVPKIKDKYNPATWMLEVSSVATEVRLKMDFAKYYETSDLYKQNKVLVNQLSQPEPGTSDLYFPTEYSQSTIGQFKACLWKQWLTYWRSPDYNLVRYSFTLLVALLLGSIFWRIGTNMEDATTLGMVIGAMYTAVMFIGINNCSTVQPVVSIERTVFYRERAAGMYSAMPYAIAQVVIEIPYVFVQTTYYTLIVYAMMSFQWTAVKFFWFFFISYFSFLYFTYYGMMAVSISPNHEVASIFAAAFFSLFNLFSGFFIPRPRIPGWWIWYYWICPLAWTVYGLIVTQYGDLEDLISVPGESEQTISYYVTHHFGYHRDFLPVIAPVLVLFAVFFAFLYAVCIKKLNFQQR

SEQ ID NO: 614 - protein, 1315 aa, Zea mays
GCGACVVLIAKYNPKTDEVTEFTASSCLTLLYTINFCSVITTEGLGDSQYGFHAVQERMSGFHASQCGFCTPGMCMSIFTSLIKADKSKRPEPPKGFSKLKVSEAGKAFSGNLCRCTGYRPIVDACKSFASDVDLEDLGLNIFWKKGDRNPDVSELPSYTLGGGVCTFPDFLKTELKSSLDHLNNPCIAASGEGWYHPKSIKEYYELINSCLFSDSVKVVVGNTSSGVPGYKDQDIYSKYIDIGGIPELSNIVRMGSGIEIGVATSISRTIEILEEECESISSPNGSVVFRKLANHMSKVATPFVRNTASIGGNIVLAQKFPFPSDIATILLGAGATVCLQVVAERRQITLEEFLEQPPIDATTLLLSIFIPNWISDSGANISLLFETYRAAPRPLGNAVSYVNCAFLGHASLDEQSDTLVLSNLRLAFGAYGTEHAIRATRVEEFLTGKSLTASVVLGAIQLLRETVVPMEGTSHPEYRVSAAVGFLFSFLSPFSKCIPEPGKSLASSSTDSADTDDVRNLPLSTRRETFSSDEYKPVGEPIKKYGVELQASGEAVYVDDIPAPKNCLYGEFIYSTQPLAYVKSIKFKSSLASEKIISFVSAKDIPSGGLNIGSSSTFGDEPLFGDPIAEYAGQALGIVIAETQRYADMAAKQVVIEYDTEDLSPPIITVEQAVEKSSYFDVPPEFYPKEVGDVSKGMAEADHKIPSTEVKLASEYYFYMETQTALAVPDEDNTLVVYSSSQYPELAQSVIARCLGIPFSNVRVITRRVGGGFGGKAFRSFQVATAAALCAYKLRRPVRMYLNRNTDMVMVGGRHPVKAHYTVGFKNDGNVTALHLDLLINAGISPDASPIIPGTIISSVKKYNWGALSFDIKLCRTNNSSKSVMRAPGDTQGSLIADAVIEHVASVLSLDANSVREKNFHTYGTLQSFYPDSAGEASTYTLHSIFDRLVSTSSYLDRAESIKEFNSNSKWRKRGISCVPLIFKVEPRAAPGRVSVLKDGSVVVEVGGIEIGQGLWTKVQQMTAFALGRLWPDADGGGECLLGRVRVLQADTLNLVQGGLTAGSTASESSCAATLQACNTLYDRLKLVLDRLQQRSENVSWDTLVSQAYEDDVDLSASAYWVPGQASNKYLNYGAGISEVEIDLLTGAITIIRGDLVYDCGKSLNPAVDLGQIEGSFVQGIGFFVYEEYTTNSDGLMISNSTWDYKIPSVDIIPRQFNAEVLNTGYHKNRVLSSKASGEPALVLASSVHCALREAIRAARVEFADSTVSSGHSPLEFQMGVPAPMTLVKELCGLDIVDRYLEGLSTCERAAGGA

SEQ ID NO: 615 - protein, 316 aa, Zea mays
MSAPSAPPRTVICVGDVHGYITKLESLWSNLQAALPADAFATALVIFLGDYNDRGPHTRRVLDFLLALPTRYPAQRHVFLCGNHDLAFAAFVGALPPPPDGSPFSATWDEYIHNEEHEGWFRGPGFEGMHVQGRRWGGVIKERWNPKKGLPYKGSIYDAQPTFESYGVAHGSSDLAKAVPEEHKRFLHDLVWIHEEENVPVDMDGGQIICNLIAVHAGLERTIDLNEQLRVLRTRDTRVPKVQMLSGRQDVWDTPKGLAGKQTIIVSGHHGKLHIDGLRFIIDEGGGYEDKPIAAIVFPSKTLIRSTEEAGTTSER

SEQ ID NO: 616 - protein, 68 aa, Zea mays
MASAGEAPSTLLRFLYFVGAGVICTKAINTYRDYEHKKESTAALAAAESALAAAAAAEPAPATAAAKP

SEQ ID NO: 617 - protein, 98 aa, Zea mays
MGPQQGRRSNGGAAARSKQEEEGGAKVVRYRECQRNHAASLGGHAVDGCREFMAAGADGTAAALACAACGCHRSFHRREVEQPAADCDCDCSSTTSGA

SEQ ID NO: 618 - protein, 340 aa, Zea mays
MSNAADVEAGAQARAAPATTGIKPPPGRYNNMTSNGPYTPPSPFYYDPAAAHGRHHWSWLVPLVVIANVLMFVLVMFYNNCPRSGGDCVGRGFLRRFSFQPLKENPLLGPTAATLQRYGALDWYKVVHGNQAWRLESCTWLHAGLIHLLANMISLIFIGVRLEQQFGFWKVGLVYLVSGFGGSVLSVFFIRKGVSVGASGALFGLLGAMLSELITNWSIYTNRFAAMLNLIIIAAINLALGILPHVDNFAHIGGFATGFLLGFVLLIQPQFGWLEQPFGAKTKSKYKAYQIILLLAALVLLAAGFAVGLVMVFRGENGNDHCSWCHYLTCVPTSSWKCDN

SEQ ID NO: 619 - protein, 80 aa, Zea mays
MRCKRRPRLGMGWLRSVLSPLRKLWCRVNAVQRKKRGIYILYDDVKSCQCEDVHVLWAILVESHGLPTPTPTPPLLSLKR

SEQ ID NO: 620 - protein, 124 aa, Zea mays
MMKPSCVLLLSSLLVATLAATSSSSPPYSVGKHPGWLLVLGRKGRELGQSSGYHYYQHQSKQPELQGVAMEVKKPEEEATARRTADQSGDAETGLIYSADYSSVAMHAASPPTAKPKHRHPTRP

SEQ ID NO: 621 - protein, 372 aa, Zea mays
MAGTDVAGSARGSDAALGKTGEPPAAARSGAAKKVTLALLASFSALLYSQIQPPPSKIPGTPGGPPVTAPRTRLKDGRHLAYLESGVPKEKAKYKIIFVHGFDCCRYDVLNVSQGLLEELGIYLLSFDRPGYAESDAHPARTEKSVALDIAELADNLQLGPKFHLIGFSMGGEIMWSCLKYIPHRLAGVAILAPVGNYWWSGFPPDVFKEAWRVQFPQDQRAVWVAHHLPWLTHWWNTQKLFRGSSVKDGDPAMLSKEDRLVADKFEKRTYEKQVRQQGEHDSLHRDMMVGFGKWDWSPLEMENPFAGGQDEVKVYLWHGVEDLYVPVQLSRYISERLPWVIYHELPTAGHLFPVADGMPDAIVRSLLLGDE

SEQ ID NO: 622 - protein, 370 aa, Zea mays
MAAEHATAAVGEPPPATSQPAEGVTAAAGQRSVPTPFLSKTYQLVDDPAVDDIISWNDDGSAFIVWRPAEFARDLLPKYFKHNNFSSFVRQLNTYGFRKIVPDRWEFANDCFRRGEKRLLCDIHRRKVSPATGAVTVAAAAAAIPMALPVGSPVYSGEEQVLSSSSPEPPSLQQHPPAPSGSGSGGVVSGDVGEENERLRRENARLARELGQMKKLCNNILLLMSKYAATQQPDAAKEAAAGNCTGESSDAAAAPPLPSILELLPSCRADPAPAAAGTDHEDDEKAGARLFGVSIGRKRMRDESDHHAGVCAAEVKAEPVDARPDQQRQRNATEPQSWPIYRPRPVYHPLRACNGSGSAGSDHDGSNDSR

SEQ ID NO: 623 - protein, 550 aa, Zea mays
MVGTVSLAAGYGSDGVYRSPRLVAAIASDPGLSVTDLVLRRAAACPSAPALVDAATGRALTFGALRSAVLVAAAALSSRAGVRRGDAVLLLAPNCVLYPVCFLAVTALGAVATTANPLYTPREIAKQAADARARLVVTVSDLLPKISGLRLPIVLLDGDGAPVPSGCPSSNVTLYSDLVAGVQEAEYRHTPIGQGDTAALFYSSGTTGESKGVVLTHRNFIAAATMVTSDQDELGEGHNVFLCFLPMFHIFGMSVITLGQLQRGNAVVVMARFDVDAVLAAIERHRVTYLFCAPPAMIALAKHSRGGRYDLSSLRCIGSGAAPLGKDVMVAMADRFPGVDIIQGYGMTETCGIISLEYVQKGCARQFGSTGALVTGVEAKIVNAKTMKHLPPSQLGEICVRGPNIMEGYFNNVQATESTIKNGWLHTGDLGYFDERGQLHVVDRLKELIKYKGFQIAPAELEGLLLSHPEILDAAVIPYPDAEAGEVPIAYVVLSPKSSLAEADVQKFIEKQVAHYKRLRKVTFVGSVPKSAAGKILRRELIAQVRLSKL

SEQ ID NO: 624 - protein, 131 aa, Zea mays
MRPASDAHQSRLLYELCALLLTVLRASPDDGAVARPLLPRHVTPAGVASMLLGASMALMLCGSVTFMLGFFLMPWVVGLGFLFLFVGFITNLSGIWRDIILWPSVACSASDSPKEAPSPWHMFSKPSSMST

SEQ ID NO: 625 - protein, 446 aa, Zea mays
MAGSSMDTEAAGKELKQGSGGGGGYTMPATAHAVDTDSWQQVGLLLVIGFNCAYVLSFSNLMMVPLGWAWGVACLLLVGAAAWYANWLLAGLHFVDGQRFIRYRDLMGFIFGRNMYYITWFLQFATLLLCNMGFILLGARALKAINTEFTHTPARLQWFITATGIVYFAFAYFVPTISAMRNWLATSAALTLAYDVALLAILIRDGKSNKQKDYDVHAGSQAEKVFNALGAVAAILVCNTSGLLPEIQSTVREPAVRGMRRALLLQYTAGAAGYYGISVAGYWAYGSAVSEYLPNELGGPRWAAVLINATAFLQSIVSQHLFTVPIHEAMDTRLQRLDEGMFSRYNLTRRVCARGLVFGFNVFVTALFPFMGDFVNLVGSLALVPLTFTFPSMAVLKIKGKSGGRCNRLWHWGIIVLSSALCVATTAAAVRLIFNNARIYHFFADM

SEQ ID NO: 626 - protein, 1448 aa, Zea mays
MRKAGAKEGSIGSKGAIDVNSLSVSTEIAGRPSDLMIKSCTCTGRLSSSSAHNLTDTYISMTCKSCTGESTEDRGGPSCSGKLNNMGLELPRPIDLEVKWMTVKKRQRDTRRARASFGEDTSRDGIGSFCLSGCATNQEMAQDAPVSESEKFGVSILGRRFSDPMENVPIKKRRFHMDFSPSPPFTPLLVDPYEKIPGSSSKAVRSYEKHYKLKTQQIEYKVGNKGRFGDDDFSGIDILASAACESEMSGGILDGECSTLAHLPEERKLENTTGSSKLSLLHNMEDTLNIPGTSHCIYDMPLGSSRSAPDMKSLFVATPTILENLVESASAPKVNCSLYSALNNANEIEIVSDAKSTSVAIANSSDNPEKTIGCLKDTVVQTNHANATNAKSTSVAIANSSDNPEKTIGCSQDTVVQTNHANATRDSRLHWDLNVAMEAWGTDCGAVEDPLVATVSDHDDARNDMNKPGTSHHFESRDGSVVDHSVDTHMDDALKHVSANTKDTCDSPADSPSHPSRNLQLLESGYVGSDALAETMDLPDQKNSRFASAMDSHIRSDPEPALIMEHFASASHVEKINGSHPEPVQCDGLSNMSSVNVHIGSNSLQTSELGTTLKPLASILVSEESKNLPTVGTSHKKVTDFGWSDNKLEEASEQSISESKNQELLDVDSETSKKGEHDTGIFYANERTKYAENLIHPEDNHGSSNCDMAHVHEENGAVAMINSKDSLITCANSSTVETYYISDAAPQVPVPSSECHKLECFTDAGSTVDSKSAAHSYQNGCENELGKVISNVRSDQCYETDTSHISKNLAGVEKVYVEEDDSQYEDGELRESGDCYWVDDGYEDVKHANWHYQVSDYKNEEATPGLTSLHTDSVANNVVIPVANDNGPQSRKEDIAVSPVSSKCSWLTNCLDGGSIADGKSQSIHLRGDTNMYGSNPSRVAVRSATTVSQSERCNDALGDMLNIRMKNTGWDMMPEDQKHSQHDARDVTDSSNRCVLSSDAARDDDSLQKKGLLNRDLQGVERQKSFDRPQRNELSRSDDGYGSGSKSGRAMDSHGSHDMYGTSRHVQTSARVEWVESSKRPRSTRHKSPEYYNYGTSGPRNAAEAAVAKMQSSGFVVARDGTLVRAVDAANAGQMPRRMRNPLSSSCHLISGWGSPVDRDEACGMSRGPVHARKASPERHFGANSNRSSRYGSEMEKNHTTDANLSSVHCSLSSRQRGTPTSRASLNLSRAHSRSPSGSRSRSPHDWAPRNRGKIMANGGSTLWKHSRSPPNHMTKGEIGRMASPRRQPGYDDRAMCYSPLSRNNTYSKNASTWVDGRNGSAVDISDDHNKRYSRRSSPLRITSRNDRFDVMDSQGRPRSGEFYRPTQGRLLYGYNRENKHGRNGEDGRECTDRYANNSVKRYDRSGAVKQFRNDTGDKFRTRISAPRSPDLQRGVSPRRFDRSFER

SEQ ID NO: 627 - protein, 245 aa, Zea mays
MPLATTAPTPAPPCPPPSPAAAPVRTQLLSSVAKLALTAALVCGSGGPAAVVVVPAAAQAVPFVRPPPPPLQGRPFASSTPYAQSQKLQLGLDKLGKIRPCPSTNPGCVSTNPLGSSGSFASPLLIPESSAGEKTVASLRQAIEKTQRNVEFKVDEDTPYGHYIEAEMDGGVGRDVMEFLVKKDAGVVAYRCMATKVTFVYPFTTAVGDSKGQKQRIAAISQELGWYAPDIQSSMDSVDDVNYVP

SEQ ID NO: 628 - protein, 368 aa, Zea mays
MADDQQPPAQRYWFPYWTAPAPRPVARPQLSRRETRPAPSPPATASPSRRPSHPQQAATPASRGAGGGVPDPPAQPQPTRLSSRPSPSPSRAQPLSPIREPNASPAPVAKEHKQPSPLHHTEHGVPKQKDITVPQEKTIHEPLVASKTQTKTPEKEKDKEKGKEKEKEGSQLHKEKDKEKKDKEKEKEKDKEKEDHKDKKDKDHKEKKEKNKEKEGSQLHKELKAGVADMVHTLSSSAPSSGGGHERAGSAAAGTTIITLAGENKGTSMKVDSSAVAYGTADAAGSKERRGHKLDGSVIVSGKEQAGAGKGLTAFVNSNVQVINNSLLLQSSCHGGDLGVHLKLSTKAKKKDGKEAGGNSGSAAAPKK

SEQ ID NO: 629 - protein, 384 aa, Zea mays
MDLMLPVTVKEEWPPEEEEEEDVDADADAPRPMEGLHEVGPPPFLTKTFDLVADPATDEVISWGRAGNSFVVWDPHVFAAVLLPRFFKHNNFSSFVRQLNTYGFRKIDPDSWEFANEGFLRGQRHLLRLIKRRRPAPPPPYLQASQSQGSCLEVGRFGGLDGEMERLRRDKSILLAEVVKLRQEQQSTRAGMRAMEERLRHAEHKQVQMMGFLARAVQSPDLFQLLAQQQARRRELEGAALLSAASRKRRRPIGAAPANGGLQQQEEEQQQGDDDDPTATRALFAELDERGTTSELENLALNIQGLGKRRQDGSEKQGGRARSQQQGGFETAELTDDFWEELLNEGMKGGAEAETLPPERRRPAWYVDALAQKLSSMSNNTTAK

SEQ ID NO: 630 - protein, 245 aa, Unknown
  Sequence found in Organisms: Zea mays, Saccharum officinarum
MATRIQFENNCEIGVFSKLTNAYCLVAIGGSENFYSAFEAELADAIPVVKTSIGGTRIIGRLCVGNKNGLLLPHTTTDQELQHLRNCLPDQVVVQRIDERLSALGNCIACNDHVALTHPDLDKETEEFIADVLGVEVFRQTIAGNILVGSYCAFSNRGGLVHPHTSVEDLDELSTLLQVPLVAGTVNRGSEVIAAGMTVNDWTAFCGSDTTATELSVIESVFKLREGQPTAIVEDMRKSLIDSYV

SEQ ID NO: 631 - protein, 560 aa, Zea mays
MDPAGPRVATDPAGSGAAPPREELDRRGGACSGAAAAEGSASRLAGAGLGDPRAGILESSGQAEAYLHTCTMDVSQLTAEGVTQCGARVSLLPQIGALQSETPCLTLGRDSSAESMEKLHGSESLPCCKENIGTVRQPKPDPEHVDNRMSVARLGLDLNTVDSSDAAELNPFFPYKKLGQSKVSDPSECGSTTAATAESESHRKWREMKRNGFLSSSHGNAVVPRPRGRPPKRKKDDEFKRSTSTQHGQANKSVKVAAPSGLLSGLNPGIINHVRNSKQVYSIIKAMVHSERLENEKQPAFTSQTGGRGREASEGIQDEKYGAGFKKCHMLMKDNNAVFHQALPTTSQFLAQDGDRLKLQLSSAVTMSSDRACSTSADDPATNHDYMTVLSVKAASVASQWLELLHQDIRGRLAALKRSRKRVRNALHTELPYLISTEFSSNQENESSIANTCDAGCTEKAVSEAHVARWRSLFVQMDRALQEEGKQLENRLKQVQEMQSNCDKGLKHMSCEAPLLGPIPELWKLKNPDISESEWAVQAAAASIYSTCNMAMRTENVPCF

SEQ ID NO: 632 - protein, 527 aa, Zea mays
MSKPWGSVGAGAWALDAERAEEEEREQALTFPAPEPPLPAGGAASFPSLREAAAAGGGGKSKKKNKGTTLSLSEFTTYGAAAAQRRAAPVEPKGLTHDEMLLLPTGPRERSAEELDRSRGFRSYGGGSGFGGPGGERRGGFDDEDRRGPGRSSDLDMPSRADEADDWGATKKFTPAPTDSGRRDRFGGPSPLGRADDIDDWSRGKKPLPARYPSLGSGGGFRDSPAFRDSPAASDSDRWVRGATPLPHNGEGAGERPRIVLNPPKRDPLVASTPPAEVARNRPSPFGAARPREDVLAEKGVDWRKFENEIEHKTSRPTSSHSSRPNSAHSSRPGSPGSQVSAVGSEGAPRARPKVNPFGEAKPREVVLQEKGKDWRKIDIELEHRAINRPESDEERNLKEEINLLKVDLKEIERNMSNGSDQTSVDAKGLSEKISQLESQLEQLSRELDDKIRFGQRPRSGAGRVTALAPTSLGEEPHATVVDRPRSRGGMEPPPRQEERWGFQGSRERGSFGASRNSDRPMARQRW

SEQ ID NO: 633 - protein, 1135 aa, Zea mays
MSLPSNNRRTCSRSSSARSKHSARVVAQTPVDAQLHAEFEGSQRHFDYSSSVGAANRPSASTSTVSTYLQNMQRGRYIQPFGCLLAVHPDTFALLAYSENAPEMLDLTPHAVPTIDQRDALGIGVDVRTLFRSQSSVALHKAAAFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFYEDEHGEVISECRRSDLEPYLGLHYPATDIPQASRFLFMKNKVRMICDCCATPVKVIQDDSLAQPLSLCGSTLRASHGCHAQYMANMGSVASLAMSVTINEDEEEDGDTGSDQQPKGRKLWGLVVCHHTSPRFVPFPLRYACEFLLQVFGIQLNKEVELAAQAKERHILRTQTLLCDMLLRDAPVGIFTRSPNVMDLVKCDGAALYYQNQLLVLGSTPSESEIKSIATWLQDNHDGSTGLSTDSLVEAGYPGAVALREVVCGMAAIKISSKDFIFWFRSHTTKEIKWGGAKHEPVDADDDGRRMHPRSSFKAFLEVVKWRSVPWEDVEMDAIHSLQLILRGSLPDEDANRNNVRSIVKAPSDDMKKIQGLLELRTVTNEMVRLIETATAPVLAVDIAGNINGWNNKAAELTGLPVMEAIGRPLIDLVVTDSIEVVKQILDSALQGIEEQNMEIKLKTFHEHECNGPVILKVNSCCSRDLSEKVIGVCFVAQDLTRQKMIMDKYTRIQGDYVAIVKNPTELIPPIFMINDLGSCLEWNKAMQKITGIKREDAINKLLIGEVFTLHDYGCRVKDHATLTKLSILMNAVISGQDPEKLFFGFFDTDGKYIESLLTVNKRTDAEGKITGALCFLHVASPELQHALQVQKMSEQAATNSFKELTYIRQELRNPLNGMQFTCNLLKPSELTEEQRQLLSSNVLCQDQLKKILHDTDLESIEQCYMEMNTVEFNLEQALNTVLMQGIPLGKEKQISIERNWPVEVSCMYLYGDNLRLQQILADYLACALQFTQTAEGPIVLQVMSKKENIGSGMQIAHLEFRIVHPAPGVPEALIQEMFQHNPGVSREGLGLYISQKLVKTMSGTVQYLREADTSSFIILMEFPVAQLSSKRSKPSTSKF

SEQ ID NO: 634 - protein, 533 aa, Zea mays
MGGGDADAGGEPADAQATLHIRCTNGSKFTVRTDLGATVGAFKAIVAHSCDVPAPQQRLIYKGRILKDEQTLASYGVETDHTIHMVRGAVLSPTSTAPAANQEPTTAAPASSPATGLGGLLQSLGTTGAAANSEGLFGSAPPGLDQMQQQLAENPNLMREMMNMPLMQNLMNNPELIRSIIMNNPQMRELIDRNPDLAHVLNDPSIMRQTFEAVRNPELMREMMRNTDRAMSNIESSPEGFNMLRRMYETVQEPFLNATTMGSEGDRNSNPFSALLGNQGSNQARDSAANGTTRASDPTSGSPAPNTNPLPNPWGSNAGSAQGAARSSPASNVRSTTASGLGGLGSADLGSTHGASGGGSDATLLTQVLQNPTMMQMMQNIMSNPQSMNQLLNMNPNVRNMMESNTQMREMIQNPEFLRQLTSPETLQQLISFQQSLMSQLGQQQAGQERTQSGSGAGNVNLNTLMNMFSGLGAGGGLGVPNAPNVPPEELYATQLAQLQEMGFFDTQENIRALAATAGNVHAAVERLLGNMG

SEQ ID NO: 635 - protein, 1039 aa, Zea mays
MVAAQVTPAPLLRRHGSAPPWLSSSPPFLLRRRASSPFSLHRRASPPLAISGCRRQDYSHCSDMAVRGSSAFKLRFYPNLEVQNIAQEWVKESRRLFYLRTANNVTNNIYKGNTPLWTGMVQNELSEDCRGLNYTYLNNLRERVSSKSIVNRHGNNRELIGHSTINQHVKSVPAPVRVVNDSVKCFSMPRASKVEIPWPAYSPAEDPLLDKSNTEVILELEDKVHDGDDKKKKTVVKKVVSPFPTKAAFSEESLKAREALASIYDKVLVVDDIESARNIVKLLTTKYKSFIHACDTEVANINAKEETPVGHGEVICFSIYSANSDVQAADFGNGKTCIWVDVLDGGRGVLMEFAPFFEDSSIKKVWHNYSFDSHVIENYGIKIAGFHADTMHLARLWDSSRKIDGGYSLEGLTNDRRVMDTVPEDLPKPGKTSMKTIFGRKNIRKDGSEGKVVSVEPVKKLQREDRELWICYSSLDSMSTLRLYDSLKSKLTTRRWILDGCPRGTMYDFYEQYWRPFGALLVKMETEGMLVDRGYLSEIEKAAIAERKLAADKFRKWASKYCPDAKYMNVNSDIQIRQLLFGGIENRHKSGETWPHSKTFKVLNEESVATEGKKTSKYRTIKLCSIVEDLKIDMFTPSGWPTVSGDALRSLAGKIPTEYIYTIDDIQDDDEYTSGSENPDGNSSYGTAYEAFGGGKNGKEACHAIAALCEICSIDSLISNFILPLQGDHISCAEGRIHCSLNINTETGRLSARTPNLQNQPALEKDRYRIRQAFVAAPGNSLIVPDYGQLELRILAHLTNCKSMLHAFKAGGDFHSRTAMNMYQHIRDAVQEKKVLLEWHPQPGQEKPPVPLLKDAFGAERRKAKMLNFSIAYGKTAVGLSRDWKVSVKEARDTLKLWYRDRKEVLAWQKSQKKLASEKGEVYTLLGRSRHFPYLTQYGPGQRGHIERAAINAPVQGSAADVAMCAMLEIERNVRLKELGWRLLLQVHDEVILEGPSESAEVAKAIVVECMSKPFYGTNILNVDLAVDAKCAKSWYAAK

SEQ ID NO: 636 - protein, 197 aa, Zea mays
MDDIAWERGRNADDSSRAVLTPPRGPGLLSPSSPSGSGPIPSAAVLALPASATSQSAGLLASSRLAGDMDGGGETLLVRRSKGKKRPQPAAPAEEGSGSGGRFRAIWRDYHDLLQETEAKRKRLASTKRRSLALLAEVKFLRRKYQSFLRGGSQQTHYRLKKQARYMPSPLGSNKAAALADHGAGDPSAFYQQKLKT

SEQ ID NO: 637 - protein, 627 aa, Oryza sativa
MGMEVVGTEAAPAEVKVTDGEVNLFQENESKATAKEREEAVLFGSDNSTATANGAANGADLAPPKDAEEDWPEARKTHSFFFVKIRLLEDPKLKMKIDQAEKDFQKKIQARSQIFEAIKAKKNERFGIISELKPLAAENKQYNEAVSEKLKAIEPLRNRLGKFRDENNAIRAQGAGICSSIEELEKSIKRLNDRISHESIPLDEEKRLIKQIRELEKTRPKVISTSANRAQIQDTVVERDAIQDQVKIIGEGIDGVKKERQAVRSKIKVLEDELKAIDMEMGSLQEDLTAANARKDKAHESLVQLRHARDAYNASFHQNRQLLSKARDLASRSELAQVQELYKTQVDKFVAEWCNSKAFREDYEKRILSSLNSRQLSRDGRMRNPDEKPIFIETEAAAPPVEQEPIQSKMPAKQAKEAPAPQAEVSPKDESRVKAIAKPSKAKSSLDADDDYEAESPKEKPKPKEVDVAKLKEIKRQEEMEKNRLALERKKKLAEKQAAKAAARAQKEAEKKLKREEMRARRRAGAADTEASTESDNRSDGAAEAQAEDDSAPASAPVMREQRESVRYSRNVVTKSKAPLPKAILRRKKAQSYWSWAGPAAAVAAALVALLAVLGYYQYYLPASASN

SEQ ID NO: 638 - protein, 410 aa, Oryza sativa
MLRQSSSRNHRSKGLKLKKALQITLLVLVSVWLIYQVKHSYEKKAYHENEPNDLHKDDDQNQGEIRLGRKDLPTKLEADSSTLDERIEDEENEEMEQEMKHDENDEDPIDEPDLDKDDDLPEPGEHSADKDERSEDVGVFEDEERKERSQEDQEKTFHGDNVSSAVSHDPPSAEQDELLRHAQDKILYVDDASTAVPHDNQEAERREEEARKAREMTFRGDDVSSSVDHDAQVTKPLPEEQLKSMDSIFEGTTNLSNGITFRGPGVNESTAARELGAIPADASSHPNTSTVSESNTDTAPVNLDGNHTGSDQANSTSLKGQQEQQANSTDVLNNQIKLFIDLTSAAELNYRPNGTLASASTDAENATSVDRGHDGNTGTNKAEEGDTGKDLDLSTKIMNKAISEDEVVLE

SEQ ID NO: 639 - protein, 69 aa, Oryza sativa
MASRGAVLVAVAAAVAVMFASVASAQVDGGVPPAPAPVTGAAAGGAASAALAVACSAVLSILVAGGIMH

SEQ ID NO: 640 - protein, 186 aa, Oryza sativa
MAALVISKQRSHQQQSSDRRRKPSSHFASPQSMRGFNAVNCRAFHSSVSIGILPSPPPPPARTYSSPEPKTPKSQPHHGKKRSRAISISPSTSPPSRPELWAGPAFSNSPPPSSLPIPKFSLHQKRSVSLELPPAGRSDDVVVPLHAKSAPSSPTAGSGVSFFSDSDTAIATENLRRILHLKIADH

SEQ ID NO: 641 - protein, 117 aa, Oryza sativa
MAKSLLAASALLLALLLAVAGGAAAAGEVPLAWELGVGGGGGGGEEDSFGFSSEDAAADGAAVVRRVLQGQGYISYGALRRDTTPCSVRGASYYNCRPGGQANPYSRGCSAITRCRG

SEQ ID NO: 642 - protein, 209 aa, Oryza sativa
MMMMMMSAASSPSCLLLLPRPTKPTPPLLPSTSSCRRPPRCRIRSLRPENPAPPAAGVARAVASSSSPMEMEAAQTQACGGGEGQQEAMRLLFVEMGVGYDQHGQDVTAAAVRACRDAITSNSIPAFRSGSIPGVNTEQMKLQIKLGVPRPTQHLLDVERVKAVFPYGKIISFEVVDGGMICSSGVCLEAMGDKNDDCYIVNAAVYVGY

SEQ ID NO: 643 - protein, 428 aa, Oryza sativa
MDAASRPAVVIDNGTGYTKMGFAGNVEPCFITPTVVAVNDTFAGQTRANTTKGNWMAQHSAGVMADLDFFIGEDALARSRSSNTYNLSYPIHNGQVENWDTMERFWQQCIFNYLRCDPEDHYFLLTESPLTPPETREYTGEIMFETFNVPGLYIACQPVLALAAGYTTTKCEMTGVVVDVGDGATHIVPVADGYVIGSSIRSIPITGKDVTQFIQQLLKERGEHIPPEESFDVARRVKEMYCYTCSDIVKEFNKHDREPNKYIKHWSGIKPKTGAKYTCDIGYERFLGPEIFFHPEIYNNDFTTPLHVVIDKCIQSSPIDTRRALYKNIVLSGGSTMFKDFHRRLQRDLKKIVDARVLASNARLGGDAKAQPIEVNVVSHPIQRYAVWFGGSVLASTAEFYEACHTKAEYEEYGASICRTNPVFKGMY

SEQ ID NO: 644 - protein, 111 aa, Sorghum bicolor
MRPLLVSLALIFVVAGVAHGAGECGRASADRVALRLAPCVSAADDPQSTPTSSCCSAVHAIGQSPSCLCAVMLSGTARAAGIKPEVAITIPKRCNMADRPVGYKCGDYTLP

SEQ ID NO: 645 - protein, 152 aa, Unknown
  Sequence found in Organisms: Zea mays, Sorghum bicolor
MSLIAGEDFQHILRLLNTNVDGKQKIMFAMTSIKGVGRRFSNIVCKKADIDMNKRAGELTPEELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 646 - protein, 206 aa, Sorghum bicolor
MGSSEAEKPLRRIAASFEELAAVAKQQPPASMDAGAFSRACSNVSVLFGCLGIAFKFAEMDYVAKVDDLVEASKSILTLPSMVELDIQTDTVRKPGSHTRNLLRVKRGIDMVKVLFEQILVTEGNSLRDAASVAYAQVFAPHHGWAIRKAVAAGMYALPSKSQLLKKLNEDEESAKVQMQNFVRSSAPVICYVDDLFTSRNLGIDW

SEQ ID NO: 647 - protein, 175 aa, Sorghum bicolor
MATAAGSIQQGHGARFAAACDVLSRYVKAAAAATTTTPVEQPRPLPGTVVGVVLPLMPGADLSTQAEELAEAADQAGPAPRAQQLMTISYGGRVVVLDDVPADTAAELLRLAAAAAAPRVLRAPDDLPMARKASLRHFMEKRKGRVAKRASPYSRPGDAGAAAASSFPDHLALSL

SEQ ID NO: 648 - protein, 371 aa, Sorghum bicolor
MGAGKGGDGGGGGGEAAAAAPEAAQPVVLKMELHCAGCAHKVKKAIKRVPGVESIVTDVAANRVVVAGTADAGALKARLEAKTSKPVEVVSAGGAPKKPAAAAEHAGAGEKKGDKGVSPKEEEKEKDKEKKQQASEEKKPKQVGTRQPQETVLLKIRLHCDGCADRIRRRIYKIKGVKDVVLDGNAKDEVKVMGTMDIPNMLSYLKEKLNRDVEAVAPPAKKDGGGEGKDDKKDSGSGGDKNKGAAEAGGDDKKDKGKGIDVSAGPSTAAAAAFMAAPAGASTYHVAPPYGYVAYQQAPPPPPASYYPYPYYGNGDGMGHANPSYYHQQPQQQPDVNQQPQMAYPPYPYRFDMAPPPQLFSDENPNACSVM

SEQ ID NO: 649 - protein, 532 aa, Sorghum bicolor
MAEHGNRALARWRRWVLANLGSFSALFTNTNFGSAWLILAPVVSLVATYAPRRLFLTYFNLFLRRRARRLLNAVDPYVTIDISEPGGEVRYSRYGPVSDSDTTYEEVKAYLSGAACSQDARELRAEGAREGNGLVVSMRDGQDVADEFRGVSLWWSSVIVRDVQGQRKGDRRFQRLTFHLRHRGVVVDEYLPHVRRQGREILFSNRRRRLYTNSKSRDPYSYEYKSWSYIDFDHPTTFDTLAMDGAKKRDIMDDLDTFRNSRDFYRRAGKPWKRGYLLYGPPGTGKSTMVAAMANYLDYDIYDVELTVVHTNSDLRRLLIETTSKSIIVIEDIDCTLDVTGDRASSSRPRRREAADEKPPPPPPRDTVTLSGLLNFIDGLWSACGGERIVVFTTNHVEKLDPALIRRGRMDMHIEMSYCRFEAFQTLAKNYLDVDDHELFGAVEEFLREEDLTPADVAECLMVARRAGSGEPSRCLEISIDELKKRAAEKAKAEAEAKARAEAEAMAWAAEAEARAAVEANAAAARDRGNSR

SEQ ID NO: 650 - protein, 145 aa, Sorghum bicolor
MSVEIVDGRTVQSFVEDERAFNSCVDARFAALDADRDGRLSYAEMTGELMALRVREAHFGADAPAPDAELAGLYGALFARFDRDGDGAVDRHEFRAEMREVMLAVASGLGVLPVQMVVEEGSLLKRAVDRELLATTTPTTTTLAA

SEQ ID NO: 651 - protein, 439 aa, Sorghum bicolor
MGSDADMEDYGFEYSDEEPEEQDVDIENQYYNSKGLVETDPEGALAGFDQVVTMEPEKAEWGFKALKQTVKLYYKLGKYKEMMDAYREMLTYIKSAVTRNYSEKCINNIMDFVSGSASQNFSLLQEFYQTTLKALEEAKNERLWFKTNLKLCKIWFDMGEYGRMSKILKELHKSCQREDGSDDQKKGTQLLEVYAIEIQMYTETKNNKKLKELYQRALSIKSAIPHPRIMGIIRECGGKMHMAERQWAEAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQELNFPEKDVEQLLVSLILDNRIQGHIDQVNKLLERGERSKGMRKYSAIDKWNTQLKSIYQTLSNRVG

SEQ ID NO: 652 - protein, 1194 aa, Sorghum bicolor
MDTRRRLPILLALLLAFFSAVAASDEIHGCGGFVEASSGLAKSRKASDSKLDYSDITVELCTVDGLVKESTQCAPNGYYFIPVYDKGSFMVRVKGPKGWSWKPETVPVIIDHNGCNGNADINFQFTGFMISGKVVGAVGGKSCSKGGGPAGVKVELMTDSDELIASASTSSSGEYSFTNIIPGRYRLRASHPDYKIELRGSPEVDLRFGNVVADDVFFVSGYDIYGTVVAQGNPIVGVHLYLYSNDVTEVPCPQGFSDAPKEGALCHAISGADGKFTFRSLPCGSYELLPYYKGENTVFDISPSSLPVSVEHSHLTIPQKFQVTGFSVGGRVIDGYGAGVESANVIVDGQSRAITDSLGYYRLDQVTSKKYTITAEKDHYKFNRLENFMILPNLASIDDIRSVRYDVCGIVRTVTPNSKAMVTLTHGPENVKPQRKLVGENGQFCFEVPAGEYELSALPVDSERSSSLMFSPGSISINVNSPLLDLEFSQSQVNVHGKVSCKEQCNQNILVSLVRLAGGVEQEKKTTTLEQDNVSFVFKKVFPGKYRVEVKNSLPEGSAKDDWCWDQSTLNIDVGTDDVRDIVFVQKGYWIELVSTHDTKAYIQQPDSSRLDLSIKKGSQRICVETSGQHEIHLTNPCISFGSSSVLFDTAKSMPIHISAKKYLVKGEIHVDMSSLQENIDSKDMVVDVLKSDDSFIEKISTSPVIGKDNQNDFTAFEYSIWADLGEDFIFVPHDSSTGRNKVLFYPARQQYSVSMNGCQDTVPLITAKTGLYLEGSVLPATSDVDIKIVAAGKSNYAHLNKGDVATETKTDSEGSFFAGPLYDDIVYKVEASKDGYHLKQTGPYTFSCQKLGQISVRIYGENSELLPSVLLSLSGEEGYRNNSISSSGGTFTFDNLFPGSFYLRPLLKEYKFNPSAVAIDLNSGESREAEFRATRVAYSAMGSVTLLTGHPKEGVFVEARSESTGFYEEATTDAFGRFRLRGLVPGSTYSIRVVAKDNLRFAAVERASPEYLSVNVGREDITGIDFVVFEHPEVTILSGHVEGDGIDTLQPHLSVEIRSAADPSRVESVLPVPLSYYFEVRDLPKGKHLVQLRSGLPSHTHRFESELVEVDLEKEPQIHVGPLKYKTEERHQKQELTPAPVFPLIVGVSVVALVISMPRLNDLYQSAVGMTSLGSGMAPIKKEPRKNIIRKRV

SEQ ID NO: 653 - protein, 406 aa, Sorghum bicolor
MGLISNDAWHKRFFSVAPPAALVFFFVLIFVAGAIVTLDHKESLSILQLQPKGVIAAVEMRPPATSELRSSATTEPRAEPAEEPDICENKCRPPGSEPLPRGIVQDKSNFEMESLGGNPERKENGNGRQPKSLLAIPVGIKQKAIVDKLVSKFPEAKFTVMLFHYDGEVDGWRDLEWSRRAIHVAVRDQTKWWFAKRFLHPDLVAEYDYVFLWDEDIEVDSFDPLRYLRIVRKEGLEISQPALDRRSQIHHRLTARARSGDVHRRYYKTNGHDRCYGNSTGPPCTGWVEMMVPVFSRAAWRCAWHMIQNDLVYAWGMDYKLGYCAQGDRSRNVGVVDSEYVFHRGIPTLGDDGKATVSASSLGRDRLAVRQRSYTELQVFNRRWKKAVAEDGCWTDPYPKSAATTA

SEQ ID NO: 654 - protein, 300 aa, Sorghum bicolor
MEASVGVRAPARGRAWAGIEKPHGAYSVRVPPVRLTADRLRLPPPRRLVLGADPWRTAGPALRPAKLRVSCSAKSAGTGKVHYSTDEALILQQKAQDVLPYLDGRCVYLVGMMGSGKTTVGKILAEVLGYSFFDSDKLVEKAVGISSVAEIFQLHSEAFFRDNESEVLRDLSSMHRLVVATGGGAVIRPINWSYMKKGLTVWLDVPLDALARRIAAVGTASRPLLHQESGDPYAKAYAKLTSLFEQRMDSYANADARVSLEHIALKQGHNDVTILTPSAIAIEALLKMESFLTEKTMVRN

SEQ ID NO: 655 - protein, 79 aa, Sorghum bicolor
MCCCGDGDECRPLGWLLGLPFALLAVLVSIVGAIIWIIGLPISCICPCCLCVTVVLEAAVELIKAPLHVMTWFTSKIPC

SEQ ID NO: 656 - protein, 157 aa, Sorghum bicolor
MEVETMLEDDVFFAELSKRISLLITDDDEGGADFAAAAKFIPASAAATPLPGFATSRGAHVPSQQQQQQDWGASLLAPPAYALYHHGASYGGAAAAWQQLQQQCGSKGTGVFIPRSTPGSAHPKKKGKNRGAAAAAAKAAARAAQAAGAGAPTKKRA

SEQ ID NO: 657 - protein, 573 aa, Sorghum bicolor
MASHIILPPDDADENHNHQAEEEEREELGRDEDADDEEHGHGHPPALPPKAALPFSATCVRISRDSYPNLRALRNASSVSLADAAYVKISEGDYGYVLDDVPHFTDYLPDIPTYPNPLQDHPAYSTVKQYFVNEDDTVPQKVVVQKNSRRGVHFRRAGPRQRIYFGTDEVKACIVTCGGLCPGLNTVIRELVCGLSHMYNVSSIFGIQNGYKGFYSSNYLPLTPKSVNDIHKRGGTVLGTSRGGHDTKKIVDNIQDRGINQVYIIGGDGTQKGAYEIFKEIRKRGLKVSVAGVPKTIDNDIAIIDKSFGFDTAVEEAQRAIDSAHVEACSAENGIGLVKLMGRYSGFIAMYATLASRDVDCCLIPESPFYLDGEGGLLQYVEKRLKENKHMVIVVAEGAGQDLIAKSIATSDQQDASGNKLLLDIGLWLTHKIKDYFKSKKMEMTIKYIDPTYMIRAIPSNASDNVYCTLLAHSAIHGAMAGYSFTVGMVNGRHTYIPFYRVTSTRNKVKVTDRMWARLLSSTNQPSFLSQKDIDEASEADRLANRPPLPTGASSRVARSFDQSSSCSSNGEI

SEQ ID NO: 658 - protein, 1050 aa, Sorghum bicolor
MARRGHDDDDEIEEEEDEEEAYDLDEEEEEDEEDDYEEEARRGKASRSGGAGGGKGGGGGRKRSREDNFIDDSAIEDDDEEDDDDDGGGRPRKKGGGGVRGFFDEEAQVDEDEEEEDEGEGEDDFINDAGADLPDEDVVRGSRRHSIPMRDEEEDIDEIERQVRERYARSTHIEYGEEAAEVEQQALLPSVKDPKLWMVKCAIGHERETAICLMQKYIDRGDLQIKSVVALDHLKNYIYVEAEKEAHVKEACKGLRNIYASAKITLVPIKEMADVLSVESKSVDLSRDSWVRMKLGIYKGDLAKVVDVDNVRQRVDVKLIPRIDLQALASKLEGREAVKKKAFVPPPRFFNIDEAREMHIRVERRRDKESGEYFEWVDNLKFKDGFLYKSVSTKSIHTNNIQPTFDELEKFKKPGEDMNGDMASLSTLFANRKKGHFMKGDAVIVVKGDLKNLEGWVEKVEDETVHIRPKISDLPKTLAFNEKELCKYFKPGDHVKVISGVQEGATGMVVKVEGHVLIILSDTTKEHIRVFADHVVESSEITTGITRIGDYELHDLVLLDNLSFGVIIRVEAEAFQVLKGVPDRPEVVLVKLREIKSKIDRRSSAKDRSNNIISAKDVVRVIEGACKGKQGPVEHIHKGILFIYDRHHLEHAGFICAKAQSCLLVGGSAGGRRGNGMDTADARLGALRSSASILQSPGRLPPRGPNMNYGGRFGGGRGGRGHDALVGKCIKIKSGPYKGYRGRVKEVTGALVRVELDSLMKIVTVKRDDIADTPTVATPFREPRYSLGGETPMHPSRTPHHAYQTPMRDPGATPIHDGMRTPMRSRAWAPMSPPRDNWEDGNPATWGSSPAYQPGTPQARPYEAPTPGSGWANTPGVSFNDAPTPRDNYANAPSPYVPSTPVGQPMTPNSAAYLPGTPGGQPMTPGTVGLDAMSPILGGEGDGTWLLPDVMVNVLRGGDDGPGVVREVLGDGSCRVALGSSGNGDMVTVLPNEVEVIRPKKSDKIKILNGNFRGYTGKLIGIDGSDGIVRLDDTYEVKILDMVILAKLAT

SEQ ID NO: 659 - protein, 948 aa, Sorghum bicolor
MADALFVVLRKLADSLGERALERIGTELVQAAPVSTDYEHSMKQIEAELLILQAFIAQAGAKVGDKAFDAWLDQVRDVAHEVEDTIDEYAYLAVQAVDTGSFFKRKFRQIKKFAAWQKFHSQISQVEARIQRLGEIRNRYGILAGEIDRSNKLRKPNQLFMSDSSYLTDSSEIVGYVDEIGRLTQWLLEDKQERTLIAIFGMGGLGKTTIASSVYKNQNITRTFNCHAWVTVSQTYQVEELLREIINQLIDQRASMASGFMTMNHMRLVEVIQSYLLDKKYLIVLDDVWDKDAWLFLNHAFVRNNCGSKVLITTRRKDVSCLAVDHYRIELKTLQYAESWELFCKKAFVALKDSQCPENLRFFAEKIVARCQGLPLAIVTIGSTLSYREFEEQGWESFYSQLSWQLANNPELNWISNVLNMSLNDLPCYLRSCFLYCSLYPEDYKIRRNVISKLWIAEGFVEDRDDGTTMEEVANYYLVELTQRCLLRVTESNACGRPRTFVMHDLVREATSVIAKREKFGIAYGDASTTQVPHEVRHLCIQRGAQTLNFIASSRLRSFILFDTEVPCSWIDDILSRFRLLRVLCLRFANIEQVPGVVTELYNLRYIDFSYTKVKIIPASFGKLVNLQVLDLRFTYVEELPLEITMLTNLRYLQVFVVHDLLQRSLDCFSATKIPGNICLLKNLQALHTVSASKDLVSQLGNLMLLRSLAIMKVRQSYIAELWSSLTKMPNFSRLLIFAIDMDEILDLKMLKPLPNLKFLWLAGKLDAGVLPSMFSKFEKLAWLKVDWSGLKKDPIISFSNMLNLVDLRLYGAYDGEQLTFCAGWFPKLIRLELGDMEHLDWIEIEDGTMIGLHDLELVGLGNVMAVPAGIQYLRTLHQMFLTDMSKGFIQRLQGSDNYIVQHIPNIHIFYSSDSQAVNNLHLVPWLVKKYGPGAAKHAPTYWDSSGT

SEQ ID NO: 660 - protein, 108 aa, Glycine max
MDISNPAALVNAELLHFYVGRRVRIVVQVVRSDGGVVIGKSTDEKQLVVKGSPPPAAPLTTFVEVYGLVNSDKSIGAEIWTNFGDAIDMDSYNKLCQLANGEFKHLFL

SEQ ID NO: 661 - protein, 135 aa, Glycine max
MDLLELWAIFGPGVAGAVFGAGWWIWLDAVVCSLVTVPFLHYLPGIFASFAALMFNCVRKEDIDYSPYDEGEWRLKLWLFIAYVVSFVSLAGSAGLLIQDSLDKSAPSVWTGVAGVLQCVFVLISGLVYWTSHPE

SEQ ID NO: 662 - protein, 109 aa, Glycine max
MAGLQRSEVSFRRQGSSGLVWDDKLLSGELNKNEDPKGAHGGDLNLNLNVRTTPPIQRSRSNGGYRTGKVSPAIEPPSPKLSACGFCSAFGKTGEKGRRAKPRAKHRSR

SEQ ID NO: 663 - protein, 288 aa, Glycine max
MRKRTVYAWLVALLCFLVLMIVTPSIPQSQEYHDFADHRTFLGIPNALNVISNFPFLVIGLVGLVLCYHGNYFRLSLQGELWGWTCFYVGVAAVAVGSSFYHLKPDDARLVWDRLPMTVAFTSIMAIFIIERIDERKGTVSIIPLVLAGIISIVYWRFFDDLRPYALVQFVPCIVIPLMAILLPPMYTHSTYWLWAAGSYLLAKVLEATDDVIYEWTRHIVSGHTLKHLVAAMVPVFLTFMLAKRSVEPERQSLLKTWRVSWTKFREGNSNTESYSYSYTNVQAVEPQ

SEQ ID NO: 664 - protein, 206 aa, Glycine max
MVLSEEEIGRLYRIRKTVMQMLRDRNFLVGDFEINMSKHEFKSKYGEHMKREDLVINKSKKDNSGDQIYVFFPDEPKVGVKTMKTYTNRMNSENVYRAILVTQTNLTPFARTCISEISSKFHLEVFQEAELLVNIKEHELVPEHQVLTDAEKKTLLERYTVKETQLPRIQVTDPVARYYGLKRGQVVKIIRPSETAGRYVTYRFVV

SEQ ID NO: 665 - protein, 736 aa, Glycine max
MKMLPPPTAGGASHSGAGDRTVVVGMKMDSHSTELLTWALFKVAQPGDVVLALHVLGNDEIVNREGKSSLFSLVKAFDSILAVYEGFCNLKQVDLKFKICRGSSVRRILVREANAYSATHIIVGSSQGLHIIRPCISVARYCAKKLPKDCWVLAVDNGKIVFKREGSPATRAELKGLDQDHKTRLLGSIHRTISKGSKVLDDDGTGIHEKGCGNGEYSDHSLAKAFLDSKEFVEKKRCSICASEEESCGDASDENNPLAIVPVQTNDAASKPGWPLLRKTIASDKKCSEKSLLRQISVVQWAMQLPSRDLSYAAHQDHKANNCDQNKDQFLALDSKSGALVPVDAEIGTASSPERNSRSIPKELEGLHEKYSSTCRLFEYQELVLATSNFLPENLIGKGGSSQVYRGCLPDGKELAVKILKPSDDVLKEFVLEIEIITTLNHKNIISLLGFCFEDGNLLLVYDFLSRGSLEENLHGNKKNPLVFGWTERYKVAMGVAEALEYLHNNEGQSVIHRDVKSSNVLLSEDFEPQLSDFGLAKWASTSSSHIICTDVAGTFGYMAPEYFMYGKVNDKIDVYAFGVVLLELLSGRKPISGDYPKGQESLVMWASPILNSGKVLQMLDPSLGENYDHEEMERMVLAATLCIRRAPRARPLMSLISKLLGGDPDVIKWARLEANALEAPEMLDGEACPPSNLQSHLNLALLDVEDDSLSMCSVEQNVSLEDYLRGRWSRSSSFD

SEQ ID NO: 666 - protein, 1812 aa, Glycine max
MGTPDKKISDFVDVVRSWIPRRAEPLNVSRDFWMPDQSCRVCYECDSQFTIFNRRHHCRICGRVFCAKCTANSVPVPSDEANTGREDWERIRVCNYCFKQWEQVTTVDNNGSADPSATPCLSPSPSTTSLVSTKSSCTCHSSSSTAGSVPYTTGPYQRVPYSPHQSSQMNQITDDQENLNSGRSTNPSEAVGNVPSNQFGHCFSRSDDEDDDYGVYHSDTESRHYSHAHDYDDPVNIHGVDHVYGPHQMHPDEDNIQEKNLSCLTQAQNLDPEGVGGIQVPGKEDDEHDHADGCETSPYHEESNYAEPVDFESNGLLWIPPEPEDEEDDREAVLYDDDEDEGTTGGGEWGYLRSSTSFGSGECRSRDKTSEDHRKAMKTVVERHFRALVAQLLQVENLNTCDEDGKESWLDIITALSWEAATLLKPDTSRGGGMDPGGYVKVKCIACGHQNESMVVKGVVCKKNVAHRRMTAKIDKPRFLILGGALEYQRVSNQLSSVDTLLQQEMDHLKMAVARIDAHHPNVLLVEKSVSRYAQEYLLAKDISLVLNIKKPLLERIARCTGAQIVPSIDHLTSQKLGYCETFHVDKFFEEHGSAGQGGKKSTKTLMFFEGCPKPLGCTILLKGANGDELKKVKHVIQYGIFAAYHLALETSFLADEGASPLEFPLKSPITVALPDKPSSIVRSISTIPGFSVLTARESQGAKAFKEEPQSNDIYKTERSPSSCCESTERSLVGDSIHMHEVSGGITQSAQDMPSSNCNSFLSNTSSKEDDKKCPMEFFQYRLDERRETMLNNDLISDSFGTFESSQQDGNSHLRAAALSAYQGANPEPPYIKHDTNNYNNNNNHDDMIHSKEDFPPSTSDHQSILVFLSTRVWKGTVCERSHLVRIKYYGSSDKPLGRFLRDQLLDPSYTCCSCELPSEAHVHCYTHQQGSLTISVKKSEFALPGEREGKIWMWHRCLKCPRIHGFPRATRRVVMSDAAWGLSFGKFLELSFSNHAAASRVASCGHSLHRDCLRFYGFGKMVACFRYASIHLHSVYLPPPKLEFNYDSQDWLQKEANELHNKAEILFSEVCNVLHQISEKVSGPVLQEGGNRVSDFRNLVAELKGMLLYEKEEFEDSLQRLLHKEGKVGQPVIDILELNKLCRHIHIHSYVWDQRLIYASNLSKIILQENLKSLNHREKLLGSREKVIEADVATRPARGHSSCDSFLLGTKPDGNLNLENTSHLSHPVVKSEDKGKDTNHDKVDLSLSGGANINDKSDSVEFGGAVRRALSEGESPFVANLSDTLDAAWTGEGHPTNLSLKENGCLPPDAAAVAVHSPVANIVTSKSNSDIYSANIGGIEAGCTNYSKLLSKGLDTKWKGIPFANVFGSFNKTSSFNTEKLVEYNPVHILSFRELERQTGARLLLPASTNDTIVPVYDDEPTSVIAYVLVSMDYHMQMLEYDRPKESGDSSISLPLFDSTSLLSLNSFDETITNTYRSLGSFDENVLPTSGSRSLPAGDPFSYTKDLHARVSFTDDGSLGKVKYTVTCYYAKRFEALRRTCCPSELDFVRSLSRCKKWGAQGGKSNVFFAKTLDDRFIIKQVTKTELESFTKFAPAYFKYLSESISTGSPTCLAKILGIYQVTSKHLKGGKETKMDVLVMENLLYRRNIRRLYDLKGSSRSRYNPDTSGSNKVLLDQNLIEAMPTSPIFVGNKAKRLLERAVWNDTAFLASIYVMDYSLLVGVDEEKHELVLGIIDFMRQYTWDKHLETWVKTSGILGGPKNTSPTVISPQQYKKRFRKAMSLYFLMVPDQWSPPELHPSGSQSDICDENA

SEQ ID NO: 667 - protein, 311 aa, Glycine max
MSEPPKTRAVICVGDIHGFITKLQSLWKNLEGSLDRSEFETATLIFLGDYCDRGPATRQVIDFLISLPSRYPRQKHVFLCGNHDLAFAAFLRLLPAPADGCGFSEGWREYEASEEREGWFKGEGYEDMHLQGRRWSGKIKVKFNTVKGTEYQGSIYDAGPTFESYGVPHGSADLVKAVPDDHKKFLADLVWVHEEDDVFVNTDDGVKCCKLIAVHAGLEKGKDVKEQLKLLKARDTRVPKVEALSGRKSVWDIPEELTASPAIVVSGHHAKLHVEGLRLIIDEGGGYKDRPVAAIILPSMKIIRDTDELAK

SEQ ID NO: 668 - protein, 540 aa, Glycine max
MQRSGYGSDGIYRSLRPSIVFPKNSNLSLVSHLFNRVAAFPSKPALIDADSSETLSFAELKLLTVRVAHGLLRLGVTKNDVVLFLAPNDIRYIVCFLAVASLGAAVTTVNPAYTAAEVSKQANDSKPKLLVTVAELWDKLEHLKLPAVFLRCSNAPHAPSSATSFDALVQLAGSVTEFPEIKIKQSDTAALLYSSGTTGLSKGVVLTHGNFVAASLMIGFDDDLAGVLHSVFLCVLPMFHVFGLMVISYGQLQRGSAVVSLKKFEFELVLKTIEKFKVTHLWVVPPIILALAKHGLVDKYDLSSLKHIGSGAAPLGKELMKECAKRFPHAIVSQGYGMTETCGIVSVENARMGIRNSGSTGMLVAGMEAQVVSVDTLKPLPPGQLGEIWVRGPNMMQGYHNNPQATRLTMDKKGWVHTGDLGYFDEDGQLFVVDRIKELIKYKGFQVAPAELEGLLVSHAEILDAVVIPYPDAEAGEVPVAYVVRSPNSSLTEEDVQKFIAKQVAPFKRIRRVTFINAVPKTASGKILRRELIEKVRSKI

SEQ ID NO: 669 - protein, 1025 aa, Glycine max
MAWFRAGASIAKHAIRRTLSKGGSTHLVSRARVLPSIPSSHSRSFHSSVFKEQAAPVPRAVPLSKLTDSFLDGTSSVYLEELQRAWEADPNSVDESWDNFFRNFVGQATTSPGISGQTIHESMRLLLLVRAYQVNGHMKAKLDPLNLEPREIPEDLDPALYGFTEADLDREFFLGVWRMAGFLSENRPVQTLRSILTRLEQAYCGSIGYEYMHIADRHKCNWLRDRIETPTPTQFNRERREAIFDRLAWSSLFENFLATKWTSAKRFGLEGGETLIPGMKEMFDRASDLGVESIVIGMAHRGRLNVLGNVVRKPLRQIFCEFSGGLQPEGEVGLYTGTGDVKYHLGTSYDRPTRGGKRIHLSLVANPSHLEAVNPVVVGKTRAKQYYSNDVDRTKNMGVLIHGDGSFAGQGVVYETLHLSALPNYTTGGTIHIVFNNQVAFTTDPTSGRSSQYCTDVAKALDAPIFHVNGDDVEAVVHACELAAEWRQTFHSDVVVDLVCYRRFGHNEIDEPSFTQPKMYKVIRSHPSTLEIYEKKLLESGELTQEEIDRIHKKVTSILNEEFLASKEYIPKRRDWLSAYWLGFKSPEQLSRIRNTGVKPEILKNVGKAITTIPENFTPHRAVKRIYEQRAQMIETGEDIDWGFAEALAYATLLIEGNHVRLSGQDVERGTFSHRHAVVHDQTTGEKYCPLDNVIMNQDEEMFTVSNSSLSEFGVLGFELGYSMENPNSLIIWEAQFGDFANGAHVIFDNFLASGEAKWLRQTGLVVLLPHGYDGQGPEHSSARLERFLQMADDNPHVIPEMDPTLRKQIQECNLQIVNVTTPANFFHVLRRQVHREFRKPLIVMSPKNLLRSKACRSNLSEFDDVQGHPGFDKQGTRFKRLIKDQNEHKDVEEGIRRLVLCSGKVYYELDEHRTKVDAKDVAICRVEQLCPFPYDLVQRELKRYPNAEVVWCQEEPMNMGGYTYILPRLISSMKAVNRGGYDDVKYVGRAPSAATATGFLKVHQKEQTEIAEKALQQEPIDFPF

SEQ ID NO: 670 - protein, 326 aa, Glycine max
MKSMVTPLTRVLPFRHPNGHNTLPFSLTRYPSSPNFSFSPLTLTLSMAASPQSSAPTVSPGDVNIDKDGVFQLIQAHQEKAARLPPVEEIRTVLDRSVRGMLSTFSKKFDGYPSGSMVDFACDSNGYPILAVSDLAVHSKDLTANPKCSLLVARDPEDRTDLVITVHGDAISVPENEREAVRAAYLARHPNAFWVDFGDFQFLRIEPKVVRFVSGVATALLGSGEFSGDEYKSAKVDPIAQFSKPVASHMNKDHAEDNKVIVQHWTSVPVDFAFILDLDSLGFNVKAGYQGDTFKLRVPFPRCAEDRKDVKTLIVEMLQAARPKVD

SEQ ID NO: 671 - protein, 265 aa, Glycine max
MKFEDLAEGCMAKILSYTTRADVCRLSLVSKAFHSAAEANTVWDCFLPSDLSSIISPSSSVPPFRSIKDLYLYLSDRPTIIDQGIKSFQLEKRTGNKCYMLSARDLSIIWGDTTHYWEWTTLPESRFEEVARLRAVCWFDITGRMNTRVLSPNTNYAAFLVFKMIDAGGFHYDPAVLSVGILGGNSSTKNVCLDPNLVDNRLDDRFHGLQRPTVRSDGWLEIEMGEFFNPGLEEDELQIKVSETTSNWWKRGFILEGIEVRPKHV

SEQ ID NO: 672 - protein, 138 aa, Solanum lycopersicum
MSGEEEENAAELKIGDEFLKAKCLMNCEVALILEHKYEQIQQMSDDPTNQISQVFEKSLQYVKRFSRYKNPDAVRQAREILSRYPLAEFELCVLGNLCPETVEEGIAMVPSIKNRGRALDEEAIEKMLTDLSLIKKFE

SEQ ID NO: 673 - protein, 144 aa, Solanum lycopersicum
MADDDYDMDGGYVDEPMDPEPDEGAEIEEDNGNNDDIPDPLMGEGEEKTEQQEPVERPRKTSKFMTKYERARILGTRALQISMNAPVMVELEGETDPLEIAMKELRERKIPFTIRRYLPDGSYEDWGVDELIVEDSWKRQVGGT

SEQ ID NO: 674 - protein, 177 aa, Solanum lycopersicum
MELNASVSTKRTMNPRKTDIGGKPFILIICGSLVYYHCAYRNSSLVSLISDVFIVLLCSLAILGLLFRQMNISVPVDPLEWQISQDAANMFFACLANTVGAAESVLRVASTGHDKRLFLKVVAALYVLSSLGRIASGVTIAYAGLCFLCLYMLAENLQLISSRYPRRRDSTDTVQDD

SEQ ID NO: 675 - protein, 215 aa, Solanum lycopersicum
MLGKSFATPVLTFNSASCFSSPGCDSVSTTANTLVGYVNCSSSITFNVTRGSWTSNYPFKKWTLHSTATDNIVLTEEEKKTWNDSRQALSALKFSPEEEDKILGKAFGHIHSPYWYEERKKEVPRLEVVNEILDYLRSLSLTDDDLTKLVKKFPEVLGCSLEDEMKTNVEILEKQWGIEGKTLRNLLLRNPKVLGYNVDCKGDCVAKCTRCWARF

SEQ ID NO: 676 - protein, 200 aa, Solanum lycopersicum
MASLLNPPLTLPQNKLNPGGVLSVSTSGIPNKIFQPSSTRWSHRRRLMTRAKPSVEMDMLAKDSVGTDAVDDKDFGVVCMHHVGILCENLERSLDFYQNILGLEINEARPHDKLPYRGAWLWVGSEMIHLMELPNPDPYTGRPEHGGRDRHTCIAIRDVSKLKAILDKAGIPYTLSRSGRPAIFTRDPDTNALEFTQVDA

SEQ ID NO: 677 - protein, 84 aa, Solanum lycopersicum
MASGWGITGNKGRCYDFWMDFSECMSRCREPKDCVLLREDYFECLHHSKEYQRRNRIYKEEQRQLRAASQKKKEGVDGGGGGHH

SEQ ID NO: 678 - protein, 882 aa, Hordeum vulgare
MASRSYSNLMELAAGGDRDQPTLPSLGQRRVPRVVTASGIVPGLHCFDDDAGTASVASDQPNQAPRERTIIVANQLPIRATRGADGAWEFSWDEDSLLRQLKESMRGHQGRVDMDFVYIGSLRDDIPAEEQEKVAAELYDRFRCVPAFLAADLRSRFYHGFCKQQLWPLFHYMLPLSPELGGRFDRTLWQAYVSVNKIFADKILEVINPEEDFVWVHDYHLMVLPTFLRKRFNRVRLGFFLHSPFPSSEIYKTLPVREELLRALLNADLIGFHTFDYARHFLSCCSRMLGLKYESQRGYIALDYYGRTVTIKILPVGIHLVQLQSVLNLPETGLKVAELMKQFCGRGRILMLGVDDMDIFKGISLKLLAFEQLLVQHPEWRGKLVLVQIANPARGRGKDVKDVQDESYAMVRRINEAFGQPDYQPVILIDRPLHFYERMAYYVVAECCLVTAVRDGMNLIPYEYIIARQGNDKIDRILGLSPSTKKKSMLVVSEFIGCSPSLSGAIRVNPWNIDSVTEAMEKALSISDCEKVLRHEKHHKFVSTHDVGYWANSFLQDLLRSCQDHNKRRCWGIGFGLRFRVVALDTSFKKLAAEQLVSAYRKATTRAILLDYDGTLMPQTSFGKNPGSKTIDMLNSLCRDEKNMVLIASTKTRATLSEWFSPCEDLGLAAEHGYFLRLKRDAEWETCGIATDCSWKQIAEPVMKTYTETTDGSVIEDKETAIVWCYKDADPDFGSCQAKELHEHLESVLSNEPVSVKADVNHVEVKPQGVSKGLVAKRMLSAMQARGLLPDFILCIGDDRSDEDMFEVITTAVDGPYLNPEAKVFACTVGRKPSKAKYYLDDTADIVRLIQALANVSDEVQGGPPSYFFACAGTSTDDRALN

SEQ ID NO: 679 - protein, 263 aa, Brachypodium distachyon
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGSQIFSEGGLDYLGNPNLVHAQSILAIWACQVVLMGFIEGYRVGGGPLGEGLDKIYPGGAFDPLGLADDPDTAAELKVKELKNGRLAMFSMFGFFVQAIVTGKGPVENLFDHVADPVNNNAWAFATNFAPGS

SEQ ID NO: 680 - protein, 365 aa, Brachypodium distachyon
MDVEAPKEPLPVGGAARGTSSNNKAMHWLMVALNCGMLTLGTTGGPLLSRLYYSKGGQRQWLSAWLETGGWPLLLFPVSFSYLARRARDGPGAPLVLTRPRTLMAAAALGLATGADDFIYAYGLSYLPVSTSAILISTQLAFTVFFAFLVVRQRLTAFSVNAVALLTVGAVVLGLHASSDRPAGVTRGQYWLGFFLSLGAAALYGLVLPLIELAYKHAAGGGREVTYALVLEMQLVMGFFATAFCTVGMVVNNDFQAISREARAFELGETRYYVVLVSCAVLWQFFFLGAVGVIFCVHTLFAGILIAVFIPVTEVLGVIFLHEKFSSEKGVALVLSLWGLASYSYGEYSDAKAKKKKAALQAQDP

SEQ ID NO: 681 - protein, 597 aa, Brachypodium distachyon
MDVESSAAHEVSVDWRGRPCEPRRHGGMRAAVFVLGIQAFEIMAIAAVGNNLITYVFGEMHFPLSEAANVVTNFVGTIFLLSLVGGFLSDSYLGCFWTILTFGFVELSGFILLSVQAHLPQLKPAPCNMASMDGSCEQARGFKSSIFFVALYLVALGSGCLKPNMIAHGADQFAAGAGVDNAKRLSTYFNSAYFSFCLGELFALTALVWVQTHSGMDVGFGISAAAMAAGLACLVSGAAFYRNKPPQGSIFTPIARVFVAAFNKRKQICPASPANVGVCEPARLDGNFRHGNKFRFLDKACIRENAGQQQGQDGNTKPESPWRLCTVAEVQQAKTLLAVTPIFACTIVFNTVLAQLQTFSVQQGSAMDTALGGHGSFRVPPASLQAIPYAMLLFLVPCYELLLVPLMKRLTGTRSGITPLTRIGVGLCTVAFSMVAAATVERRRRDLALSPGGAQQKMSVLWIVPQFLVFGVSEMFTAVGLIEFFYKQAAASGAGIGMQSFLTALTYCSYAFGFYLSSVLVKLVNMVTAGHGGAGGWLGDNDLNKDRLDLFYWMLAVLSVLNFFCYLVCARWYNSGADGLDAASAQIAAEGDGKEIS

SEQ ID NO: 682 - protein, 292 aa, Sorghum bicolor
MLHEQQAPPSPPPEVEAAPPPVPSAPSPARNHHHHDGDGDVHDVEVTTFRDIHPLTPDVPTPPARTRSWDTASHRSFSSEEQFMTMSREFTAMVAAGATMQTGGGANGNGGYDGDQLTSIGEDELEETNPLAIVPDSHPIATPARSRASAAASASGLEVVPAPTPTPQQPPAHVEASQVKKEEVETKVSAWQTNEVAKINNRFKREEVVINGWETEQVEKASAWLKKIERKLDEQRAKAVEKTQNDIAKARRKAEEKRASAEAKRGLKLAKVLELANFMKAVGRVPTKRSFF

SEQ ID NO: 683 - protein, 302 aa, Solanum lycopersicum
MDGMNSYWQFGDELRGQSKVSEDHTWTTGTVKLAEQLRSKGERVNNLDLSKSSAESRFRVYLGLQEDNKWENQYLNMLNFDTKITDNTTKSSFSNDIHNVNSVCPKSNVNSLGNMSFSKFSSNHTNDASSYGNNKNTESINGNNAVDKRFKTLPAAETLPRNEVLGGYIFVCNNDTMQEDLKRQLFGLPPRYKDSVRAITPGLPLFLYNYTTHQLHGIFEATSFGGSNIDPTAWEDKKCKGESRFPAQVKIRIRKLGRALEEDAFRPVLHHYDGPKFRLELSVPETLDLMDLFENTSVFAPV

SEQ ID NO: 684 - protein, 299 aa, Triticum aestivum
MEAPLLLPVSTAASSSTSITVDDDSHGTAHNVSPSRASPSGRSIAARYLAVALVAAVSLFAQHEASKGFRIDVVRGGGTAGAAGRRFDLLFVANGRAERVLHRASRRVEETLFPDPSFPRRRVARVTVRLMAGGNLTADDATVDAVTDVEYVISLSPRLLSPSSGGSSSAGAADAVASAVRRAVARMWLWDGRGAAPARVTESMVEYLATAVPDESSSPAEEHASASNTHCISPRFLKHLERRRAGFVARLNRAMRDRWSDAAVDAALGAPARPVCAAYLAAATETGGQRPVVGSAVAV

SEQ ID NO: 685 - protein, 208 aa, Zea mays
MWSAATAAAARAVSVSPVPAPSLLSGRRGGSRGGRGSVSVRSTVWDFVGGDLVRPDLGKWLDDVEKHKALAIYPPHEGGYEGRYLNRLRYQGYYFLDLSARGLGDPETTLTKVHPVCPPSLGRQPVARWYFPPEVDYRLSLLHPDAKGLVVWIIEAKVLSKAELQFLAMLPDIRPKVRVIAECGNWRSFVWKPLKQIAGLEPDPDAEE

SEQ ID NO: 686 - protein, 525 aa, Zea mays
MGPPAMAFQALTLTPLPFSLHSSSRRVRVLAVAADQTPPPAPPSEPANSPSRLLRELAQRKKAVSPKKKHPPRRFILKPPLDDERLTRRFLSSPQLSLKALPLLSSCLPSAPLSTADRTWMDEYLLEAKQALGYPLAPSETLGEGDDCPARHFDVLFYLAFQHLDPSSERTRMRHVRNGHSRLWFLGQYVLELAFCEFFLQRYPRESPGPMRERVFALIGKKVLPRWLKAASLHNLVFPYDDLDKMIRKDREPPSKAVFWAIFGAIYLCFGMPEVYRVLFEAFGMDPDDESCQPKLRRQLEDVDYVSVEFEKRQLTWQDVAAYRPPPDALFAHPRLFRACVPPGMHRFRGNIWDFDSRPKVMTTLGYPLPMNDRIPEITEARNIELGLGLQLCFLHPSKHKFEHPRFCYERLEYVGQKIQDLVMAERLLMKHLDAPGRWLAEKHRRTLMNKYCGRYLRDKHLQHYIIYGETVQDRFEHNRRLRNPSTTSVQQALHGLAYCVYGKPDVRRLMFEVFDFEQVQPKAV

SEQ ID NO: 687 - protein, 682 aa, Oryza sativa
MSAYSDKGEGDLEIGLASPEAEGGGPGGPALDLSPPRAVRRPGLVMSHSGKRLDQSPAASPSPSRPVLVMSHSSNRLDQSPARPVLVMSRSSNRLDQSPASSPASSRGPVLVMSGSGNRLDSSGPSPSPSPTAAAAAAPVLVLSNSGKRMDQAGRKKYVKQVTGRHNDTELHLAAQRGDLEAVRQIIAEINAQMTGTGEEFDSEVAEIRAAVVNEPNEVEETALLIAAEKGFLDIVVELLKHSDKESLTRKNKSGFDVLHVAAKEGHRDIVKVLLDHDPSLGKTFGQSNVTPLITAAIRGHIEVVNLLLERVSGLVELSKGNGKNALHFAGRQGHVEIVKALLDADPQLARRTDKKGQTALHMAVKGTSAAVVRALVNADPAIVMLPDRNGNLALHVATRKKRSEIVNELLLLPDMNVNALTRDRKTAFDIAEGLPLSEESAEIKDCLSRAGAVRANDLNQPRDELRKTVTEIKKDVHTQLEQARKTNKNVSGIAKELRKLHREGINNATNSVTVVAVLFATVAFAAIFTVPGGNDNNGVAIAVHAVSFKIFFIFNAIALFTSLAVVVVQITLVRGETKAERRVVEIINKLMWLASVCTTVAFISSAYIVVGKHFQWAALLVTLIGGVIMAGVLGTMTYYVVRSKRTRSIRKKVKSTRRSGSNSWQQNSEFSDSEIDRIYAI

SEQ ID NO: 688 - protein, 329 aa, Oryza sativa
MPSAAAGDGKGKRRLVGMPPARAAAADFAMGGAAAVVAKTGAAPVERVKLLLQNQAEMLRRGSLTRPYRGIADAFGRVLREEGVAALWRGNQANVIRYFPTQAFNFAFKGYFKSIFGYDKEKDGKWKWLAGNVASGSAAGATTSSLLYHLDYARTRLATDAIESQGSKRQFSGLLDVYKKTLKTDGIRGLYRGFSVSIVGITLYRGLYFGIYDTMKPLILVGPLQENFFASFALGWAITTFSGACAYPFDTLRRRMMLTSGQPLKYKNAFHAAKQIVSTEGFFTLFRGVGANILSGMAGAGVLAGYDQLHRFAGQHGYNFESKMKGALK

SEQ ID NO: 689 - protein, 481 aa, Zea mays
MEHVIGGKYKLGRKIGSGSFGELYLGVNIQNGEEVGIKLEPVKTKHPQLHYESKVYMLLQGGNGIPHLKWYGVEGEYNVMVIDLLGPSLEDLFNSCNRKFSMKTVLMLADQLINRVEYMHSKGFIHRDIKPDNFLIGLGRKANQVYIIDYGLAKKYKDLQTHKHIPYRENKNLTGTARYASVNTHLGIEQSRRDDLESVGYLLLYFLRGSLPWQGLKAGTKKQKYDKISEKKMLTSAEILCKSYPPEFVSYFHYCRSLRFEDRPDYSSMKKLFRDVFIREGYQFDYVFDWTALKYPQMGSNNKLVQQPSARMAGVGPSVERTDKASMGQEIRDRFTGAVEAFARRNPGSGRPADHSSHSRHKSFADSFGTSNEAVADSSEKTRILSRGGSSSKMPAAPSTRPTSSGDCSDQNRRWVSGSSGGSGRPSPAQRLHHSGGAENSRSSPRSPVARNAAGRGGSASRDNTTFRSLERLTITTSRRK

SEQ ID NO: 690 - protein, 342 aa, Sorghum bicolor
MDSRCPHLLLLLLAALLPPPSSGAAAAAAGVIRLPTGGRAGAVACAPPDPALYDRPVIGIVSHPGDGAGGRISNTTATSYIGASYVKFVEAAGARVIPLVYNEPEERLLEKLSLLNGVLFTGGSEKQGVYFETIKKVFQYVLDKNDAGEPFPLFAQCLGFELISMIVSKDNNILETFDAQNQASTLQFPSYALEGSVFQRFDPALIKKVSTSCLVMQNHRYGISPRRYRENDALSSFFKILTTSPDENGKVYVSTVQAYNYPITSTQWHPEKAIFEWRKPMIPHSEDAVQVTQHFANHFISQARKSPNRPPADKVLDNLIYNYSPTFSGKKSKSFEEVYIFA

SEQ ID NO: 691 - protein, 268 aa, Sorghum bicolor
MDAPAAAEGSGNGGKHIVLVHGACLGGWSWFKVATPLRAAGYRVDTPDLAASGVDPRPLREVPTFRDYTQPLLDLLASLPEGHRVVLVGHSLGGVNVALAAETFPDKVAAVVFLCAFMPDCTARPSHVMEKFVEGKWLDWMDTEMKPQDAEGKLPMSMMFGPRIIREKFFQLCEPEDITLAASLMRVSSMFVEDLVLQQPYTKERYGSVRKVYIVCREDHAIVEKFQRWMVENNPVDEVKEIVADHVVMLSRPDELVRCLTDIANKYA

SEQ ID NO: 692 - protein, 1363 aa, Sorghum bicolor
MATAAAPVAATVNGMAVDRVVFALNGQRYEVAGVDPSTRLLEFIRTQTPFRGPKLGCGEGGCGACVVLIAKYNPETDEVTEFTASSCLTLLYNINFCSIITTEGLGNSRDGFHSVQERMSGFHASQCGFCTPGMCMSIFTSLINADKSKRPEPPNGFSKLKVSEAEKAFSGNLCRCTGYRPIIDACKSFASDVDLEDLGLNIFWKKGDRKPDVSDLPHYTLGGGVCTFPDFLKAELKSSLDHLNNPCIADSREGWYHPRSIKEYYELINSCFFSDSVKVVVGNTSSGVPGYKDQDLYNKYIDIGGIPELSNIVRRESGFEIGAATPIARTIEILEEECESISSPNGSVVFRKLANHMSKVATPFVRNTASIGGNIVLAQKYPFPSDIATILLGAGATVCLQVVAERRQITLEEFLEQPPIEATTLLLSIFIPHWIPDSGTKTSLLFETYRAAPRPLGNAVSYVNCAFLGHASVDEQSDTLVLSNLRLAFGAYGTEHAIRAKKVEDFLTGKSLTASVVLGAIQLLRETVVPMEGTSHPEYRVSAAIGFLFSFLSPLSKGIPEPGKSLTSSSADSAVTDDVCNMPLSTRRETVFSDEYKPVGEPIKKYGVELQASGEAVYVDDIPAPKNCLYGEFIYSTQPLAYVKSIKFKSSLASEKIVSFVSAKDIPSGGQNIGSSFSYGDEPLFGDPVAEYAGQALGIVIAETQRYADMAAKQVIIEYDTKDLGPPIITVEQAVENSSYFEIPPEMYPKEVGDVSKGMAEADHRIPSTEVKLASEYYFYMETQTALAVPDEDNTLVVYSSSQYPELAQSVIARCLGIPFSSVRVITRRVGGGFGGKAYRSFQVATAAALCAYKLRRPVRMYLNRNTDMVMVGGRHPVKAHYSVGFKSDGKITALHLDLLINAGISPDASPIIPDAIISSVKKYNWGALSFDIKLCKTNISSKSVMRAPGDTQGSLIADAVIEHVASALSLDANSVREKNFHTYGTLQLFYPDSAGEASTYTLHSIFDRLISTSSYLDRAESIKEFNSNNKWRKRGISCVPLIFKVDPRAAPGRVSVLNDGSIVVEVGGIEIGQGLWTKVQQMTAFALGKLWPDGGESLLERVRVLQADTLNLIQGGLTAGSTSSESSCAATLQACNMLIGRLKPVFDRLQQQSENVSWDTLISQASKDNVNLSASTYWVPGKVSNKYLNYGAGISEVEIDLLTGAITLLRGDLVYDCGKSMNPAVDLGQIEGSFIKGIGFFVYEEYLTNSDGLMISNSTWDYKIPTVDIIPKQFNAEVLNTGYNKNRVLSSKAAGEPALVLASSVHCALREAIRAARMEFANSTVSGRSPLEFKMDVPAPMTLVKQLCGLDIVEKYLESLST

SEQ ID NO: 693 - protein, 256 aa, Hordeum vulgare
RPAMSHSSAFLLPSSATPAGSGDAYAVVVLNQRLPRFAPLLWDRAQVRVCADGGANRVFDGMPELLPGHAPDDVRSRYKPDVIKGDMDSVRPEVKEYYSNLGTKIVDQSHDQDTTDLHKCVAFITDKSPGPDKSNLCILVLGALGGRFDHEMGNINVLHLFPNIKIVLLSDDCLIFLLPRTHSHNIHIERSVEGPHCGLIPIGTPSTSTTTTGLRWNLDNAHMSFGGLISTSNIVDEDQVMVTSDSDLIWTISLRH

SEQ ID NO: 694 - protein, 105 aa, Hordeum vulgare
PDIRGFIRGIYEIEERKESAHFIEKIRLEFPKVPQQNGEECGIYVLYFINCFLQNGKLAEVLQNKTLEEDFKQLFDDGTFDPEELENFRKDVHAFQVERSTETGQ

SEQ ID NO: 695 - protein, 105 aa, Hordeum vulgare
ASGDLLWSYDAGDPITASAFVDEVLASTPSGSSERFICICTSSGKIRVLGIRTDAEQEKDGYSVQEFTAMDLPGDIFSSPLMVGGRIFVGCRDDRLHCLSIASHP

SEQ ID NO: 696 - protein, 1115 aa, Hordeum vulgare
MSDDTQVVEDSEDDAGGFAGQTQAVEEEEEDGGSTEDEAGDGVVEDSEDDAGGVAGQTQVVEEVEEEDGGSTEDEASDGDRTQLVEECEVEDGGSGETQLAEECQEEERENDSSDDEAAVQRGTTQLVEDSDKEMGGDGDDELSQGTQVQSDDEGLPNNEGDVKDYAEDSVDSDASTEEEGATVKSLEQGKRHASTNGTFLRTEIVDNSTSCNASFGDCPGRRIDDGSFGYVQSHEKDGSKSKGRCSTAKKLFADTTNEQKEIKSRCFSGLSYLGSQEPGELSQANALDVVEGLISIHGGISSQEPSPKKLEKAKPPVSVKMGTLLLAEKVDRRRSSSGKAEVFAWVDSREDDGGGDFFRKNKDILLHQSAGRGKSKIPRPKKCSTKIAPPDKKIIEGRKRRTRSKLCEKTETLPSSDSRLLKSEVKSKRASGKRTEKKLLKDLDDHLSTAKPIERQQEKVSVDLHDVGQDTQMAVEAIEALAQSSPAENLSARVEPPVKRDLRVGSKVEKGNPKSGPPRKRTSSVQEGVTTRSKRIKVTEMNHKPQKGQGGIEMRHNLEDCATKTKHKQAKPVPQKNKVANIVDGNSYDSTPVVRRTRHTGRNNLYESPELCSNKNLKKATVADVRNNHSEHGLERPVISERTAEYGSDSMFKENTEIACANNAQGLQPSTDASIQHTSANVAQNLEPLRDEPTTHVFRREPSSHPKQRRTPTAVVQAKAPAVTEAATGHDMQPEVTRPSKKRRIFIRSSELLTYARRERSDCRSNCLLSSILTQSSAASPVLDSSSGVNSKTSGVSSSDQRQKKPSGVKDAGNSPKCNSPVPCSGLKTPSKVVSKLSPTFSPLNPSKASSRSLLKPSIARELLELDPENALPSRYRKDSRRKDMTSCSIIFSHHLDEDVIKRQKKILARLGAHEAYSVADATHFVADGFYRTKNMLEAVTRGKLVVTSMWLESCGAAGCFVNDKKYILRDAKKEKEMGFSMPISLASACKSPLLLGKRVFVTQNVKPSREVVTSLVSASSGQPLERMGRSIRKEKEAADDLLVISCEEDYQTCAPLVEKGIDVFDVELLLNGIVTQKLDYERHRLFLDRVKQTRSTRWLKDGAHGQFVPVSKS

SEQ ID NO: 697 - protein, 208 aa, Hordeum vulgare
AAKIRLLPYHVVADYEAEEDDRILDSDATGQIPSRLQQWDHNILVKIAEFTTTFEKQVLAYNIMTKKRAIGEFRSEERLMLEQALLQEEKQASMELRAEIESREKAGREAAEAKMRMAMVEHARVEAQPHPEVIGHGPLRANSAASQGDDGPSHDMAQEHVEDGWENTQRDDDDPSEDFLNDENEPDNGNSDMQEEWRRSGEFDLNSR

SEQ ID NO: 698 - protein, 1143 aa, Brachypodium distachyon
MEGTTAAVVGGDGAAGDAQIKGGKENGQQALQLQRPLQPSGGSEALEMPPTPLPIARDLDWSEHFSFFNSAGGFTDGARGLASTGLSNSVSRPDSVTQCCLEGTDERVEELTVGNCISSDAQPHASAGGSSSGGERPAVVRGLWGNFTRMAWRSSDVASRENLAAGRGDIANLRTGDVASRETLAVNLGNNMISQNNLRTGNSIDASGKEMPFSRGDNANSEFNMSFGNQQQPIPSSRLNQTEQRFERENGLKVSSFSNRIIDQMRNKTATPSSGVQGFPFKTASKGKGVTYQSAREEIQAQANVRPRVPMDRISKIPSSTHNSMARLDGAFFNGGGNASESQNEGTSLRELIRPTGQVTSKFEKMQLFKQILDHVDKSHARGLTLQHVRPSYFIVSPPNQVKYTGSYATQDLSAPAKPDIATDDMFNRKRRFDQKNAHQEFNGNGNPNSILKYQKVGDQGSVAVRRPTHTFRTDHRGGNQSEDVDPGASGQGNSSCTVRGRFNFGEPYYGNGNNASYAQRLSNYGNQESVLDLRLLEDSWYRSPEELSQLKGTFPSNIYSLGVILFELFCCCETWELHCAAMSDLRHRILPPNFLSESPREAGFCLWLLHPDPRSRPKARDILGCDLINEGRDLSLLDNKVPAAVNEEDTESGLLLNFLSQLKEEKEMQASKLSADLAGLQTDIAEVERRHSLRNGFSLEDMGVLASSNDLPGTSSDALRGGSLSGLLPPICRSSIYEQRVMRNLEQLENAYYSMRSTIDTSETNVIKRSDNDALRVRDNFYQLHGDTDAMNEQTDRLGCFFDGLCKYARHSRFEVRGILKNADILNSPNVICSLSFDRDEEYFAAAGVSKKIKIFEFDALLNDRVDIHYPLIEMPSKSKLSCVCWNSYIKNYLASTDYDGTVQLWDASTGQGFTQFTEHRKRAWSVSFSEVDPTKLASGSDDCCVKVWSINQKNCVDTIRNVANVCCVQFSPYSSRMLAFGSADYKTYCYDLRHTRIPWCTISGHGKAVSYVRFLDPETLISASTDNTLKIWDLNRTNSSGLSSSACSLTLSGHTNEKNFVGLSVHDGYITCGSENNEVYSYYKTFPMPITSHKFGSIDPITGQETNDDNQQFVSSVCWRGRSNMVVAANSSGSIKVLELV

SEQ ID NO: 699 - protein, 1438 aa, Brachypodium distachyon
MEFEPEEPQLLTRLHAGAFVAIWKLIQRPEFNMDDTSASGEQRLGFISARNPWFGRSRMFRHCLDLRHLCRLPNQIVTLPNYRPKHAPSAAVYRGVSSPLTEEFVDEVGSRSRIIHFYRKPFLQESETEELLRKVQAKVSCNVIDIKTEQCFNVELERALASEKLATLQWLLAETYEPDNLQTRSFLEEEVASGPYSVLVEVGPRMTFSTAFSTNAVSICKALSLMEVTRLERSRRYLLCLQPGGGALDESQLNSFAALIHDRMTECVYPSKLTSFWSDVVPEPVSVIPVIEKGREALEEINMRMGLAFDEQDIKYYTHLFRDDIKRNPTTVELFDIAQSNSEHSRHWFFNGKLVIDGETMASTLFQLVKSPLKANPNNSVIGFKDNSSAIRGHTVNHLRPALPGSTSPLSLMMRELDILFTAETHNFPCAVAPYPGAETGAGGRIRDTHATGRGSFVVASTAGYCVGNLQMEESYAPWEDSSFAYPSNLASPLQILIDASDGASDYGNKFGEPLIQGFTRSFGMRLPNGERREWLKPIMFSGAIGQIDHAHITKGDPEIGMLVVKIGGPAYRIGMGGGAASSMVSGQNDAELDFNAVQRGDAEMSHKLYRVIRACIEMGEKNPIISIHDQGAGGNCNVVKEIIYPKGAEIDIRSIVVGDHTLSVLEIWGAEYQEQDALLVKPDSRSLLEALCERERVSMAVLGEIDGSGKIVLIDSAAVEHAKSYGLLPPRPVVDLQLEKVLGDMPQKTFEFNRVSRLGEPLDIAPEVTLMDILKRVLKLPSVCSKRFLTTKVDRCVTGLVAQQQTVGPLQLPLADVAVIAQTYTDLTGGACAIGEQPMKGLLNPQAMARLAVGEALTNLVWAKVSSLSDVKASGNWMYAAKLDGEGADMYDAAVALADCMIELGIAIDGGKDSLSMAAQCDGEVVKAPGNLVISAYVTCPDITLTVTPDLKLGKDGVLLHIDLAKGKRRLGCSALTQVFDQIGNDCPDIEDVPYLKIVFETVQELLSERLISAGHDISDGGLIVTIFEMAFAGNCGVNLNIDLKGNSLLQALFAEELGLVVEVHSDDLDSVKQKLQAAGVSVHVIGEVNATSEIELVVDGEVRLKESILDLRDLWEETSFQLEELQRLKSCVNLEKEGLKSRTSPSWHLSFAPKFTNKKLLTASSKPKVAIIREEGSNSDREMSAAFLAAGFEPWDISMSDLLNQEASLTEFHGIAFVGGFSYADILDSAKGWAASIRFNQPLIQQFQEFYNRPDTFSLGVCNGCQLMALLGWVPGPDIGGSLGKGGDISQPRFIHNESGRFECRFTSVAIGDSPSIMFRGMEGSTLGIWAAHGEGRALFPDENVLSGVINSNLAPLRYCDDANNATEVYPFNPNGSPLGIAALCSPNGRHLAMMPHPERTFMMWQYPWYPKEWQVERGGPSPWLRMFQNAREWCS

SEQ ID NO: 700 - protein, 468 aa, Setaria italica
MISLLRRTVSSSAPAAARWRRPLLAALLSPPPAPPGPTRRAPALEPPRRAFHGSRAPLGFRATPASWAGPGPGAGVAAGEDGGLEIARLGISGRIVEKLAARGITRLFPIQRAVLEPAMQGKDMIGRARTGTGKTLAFGIPIMDRIISYNEKNGSGRNPLAIVLAPTRELARQVEKEFRESAPLDTLCVYGGVPINQQMRVLNYGVDIVVGTPGRVIDLLRRGVLNLSEIQFVVLDEADQMLAVGFDEDVEVIMEQLPQNRQSMLFSATMPSWIRKISNKYLKDPVIIDLVGDSDQKLPEGISLYSIASDNFGKPSILGPLIKEHANGGKCIVFTQTKREADRLAYVMGRSYPCQALHGDISQNQRERTLSGFRDGRFNILVATDVAARGLDIPNVDLVVHYEIPNTSELFVHRSGRTARAGKKGSAILIYTYEQTRAVRVIEQDIGCRFTELPKMAVADEAQTCLMS

SEQ ID NO: 701 - protein, 375 aa, Setaria italica
MRLRQHLASSPIYTSAIARIGNSRAPHRLLPVAPPQKHRPTSTTNKPLLLILLLLCFFFLFLIPTVLLPPARVMSSSSSASDAAAAAVPFEKPRAVVKKLLAESQPEGQGATVRRSIGRHELRNLDPFLMLDEFSVSKPAGFPDHPHRGFETVTYMLEGAFTHQDFAGHKGTIRAGDVQWMTAGRGIVHSEMPAGDGVQKGLQLWINLSSKDKMIEPRYQELQSKDISRAEKDGVEVRIIAGEAFGVRSPVYTRTPTMYMDFTMRPGSQLHQPVPEGWNAFVYIIDGEGVFGREKSAPVSAHHCIVLGDGDGISVWNKSGAPLRFALVAGQPLGEPVVQHGPFVMNSRAEIQQAMEDYYYGKNGFERASQWSSSA

SEQ ID NO: 702 - protein, 96 aa, Zea mays
MASLSRTAAAAVVALRSAVRSAPLTGRVLGAPLPSFASPSATRSARILRRSAAAASAGLETLMPLHSAVAAARLRSCIAVDSSCWCSLSQGYALPL

SEQ ID NO: 703 - protein, 618 aa, Zea mays
MAAAAAATSLLIRHNRNPHLLLLRAAISSSRALSQQPELSPDPTTGAPDPAGAAPLPPNPSTGSPLYSQNWRNPAAANPPSSLLPTVAAGSSFGAQHRMAAFYDKPDAAGLKETFAKYMAEQRWEDMKLLFDHWVRSLDAATGKPNHPDVDLFNHYLRANLMTGAVPHEMLDLADHMREFELEPNSASYNLVLKSMVADKESYGAEKLIERMLQTGTVPDEESYNLVVGLLIRQNLVDSSLKYLDLMLKSGYTPSLTVFTDYIQACVRSGRLDTLTSIIQKCKTADKIKVLCPQWAWCIDISEAAFEANNSKLALFALEFLARWIVRGENVKPPVQLSVNEGLVISALSAAGRTFSTDLLNAAWSLLRKSLRQKRAPTPETYLAKIYAHSSIGQLQRAFGTLHEFENAYGNSKDVDLELFSPFTSLHPLVVACCKDGFSTLDLVYVQLENLSHADPPYKSVAALNCVILGCANIWDINRAYETFVAIKEKFELSPDIHSYNALLCAFGKLKQTGEACNVFQHVLTLGVKPNATTYSLLVDAHLANKDPKAALAIIDEMVDAGFTPSKDTLMKVRRRCSRESDFDSDEKVQSLAKQFNYRMGGENRREMLYSIEYNPVY

SEQ ID NO: 704 - protein, 180 aa, Unknown
  Sequence found in Organisms: Zea mays, Saccharum officinarum
MASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRDKLGDRPVFVLVEADA

SEQ ID NO: 705 - protein, 1490 aa, Zea mays
MESAMEKVWESGRRMSRSIGRGMGMEAWGVDDAFVPQHGSRSRGGGGGGGDDDEEALRWAAIERLPTYSRVRTAILSTENAAVVDDDDDKTRRPPPPQQQHFKEVDVRKLGVGERQEFIERVFRVAEEDNQRFLQKLRNRIDRVGIELPTVEVRFERLTVEARCHVGSRALPTLLNTARNVAEAALGLCGVRLGGRQARLTILRDVSGAVRPSRMTLLLGPPSSGKTTLLLALAGKLDPALVVAGGGEVSYNGFRLGEFVPQKTAAYISQTDVHVGEMTVKETLDFSARCQGVGTKYDLMTELARREKGAGIRPEPEVDLFMKILGLDICADTIVGDQMQRGISGGQKKRVTTGEMIVGPTKVLFMDEISTGLDSSTTFQIVKCLQQIVHLGEATILMSLLQPAPETFDLFDDIILLSEGQIVYQGPREYVLEFFDSCGFCCPERKGTADFLQEVTSRKDQEQYWADKQMPYRYVSVPEFAQRFKRFHVGLQLENHLSLPFDKSRCHQAALVFSKHSVSTTELLKASFDKEWLLIKRNSFVYIFKTIQLIIVALIASTVFLRTHMHTTNLDDGFVYIGALLFTLIVNMFNGFAELSLTITRLPVFYKHRDLLFYPAWVFTVPNVILRIPFSIIESIVWVLVTYYTIGFAPDADRFFKHLLLVFLIQQMAGGLFRATAGLCRSMIIAQTGGALFLLIFFVLGGFVLPKVFIPNWWIWGYWISPLMYGYNALAVNEFYAPRWMNKFVLDQNGVPKRLGIAMLEGANIFVDKNWYWIGAAGLLGFTIFFNVLFTLSLMYLNPLGKPQAVISEETAKEAEGNGHSKGAIRNGSTKPKDGSHNKEMKEMRLSARLSNCSSNGVSRLMSIGSNEAAPTRGMVLPFNPLAMSFDNVNYYVDMPAEMKHQGVQDDRLQLLREVTGSFRPGVLTALMGVSGAGKTTLMDVLAGRKTGGYIEGDIRIAGYPKNQATFARISGYCEQNDIHSPQVTVRESLIYSAFLRLPGKIGDQEITDDIKMQFVDEVMELVELDNLRDALVGLPGITGLSTEQRKRLTIAVELVANPSIIFMDEPTSGLDARAAAIVMRTVRNTVDTGRTVVCTIHQPSIDIFESFDELLLLKRGGQVIYSGKLGRNSQKMVEYFEAIPGVPKIKDKYNPATWMLEVSSVATEVRLKMDFAKYYETSDLYKQNKVLVNQLSQPEPGTSDLYFPTEYSQSTIGQFKACLWKQWLTYWRSPDYNLVRYSFTLLVALLLGSIFWRIGTNMEDATTLGMVIGAMYTAVMFIGINNCSTVQPVVSIERTVFYRERAAGMYSAMPYAIAQVVIEIPYVFVQTTYYTLIVYAMMSFQWTAVKFFWFFFISYFSFLYFTYYGMMAVSISPNHEVASIFAAAFFSLFNLFSGFFIPRPRIPGWWIWYYWICPLAWTVYGLIVTQYGDLEDLISVPGESEQTISYYVTHHFGYHRDFLPVIAPVLVLFAVFFAFLYAVCIKKLNFQQR

SEQ ID NO: 706 - protein, 1388 aa, Zea mays
MTCKSCTGESTEDRGGPSCSGKLNNMGLELPRPIDLEVKWMTVKKRQRDTRRARASFGEDTSRDGIGSFCLSGCATNQEMAQDAPVSESEKFGVSILGRRFSDPMENVPIKKRRFHMDFSPSPPFTPLLVDPYEKIPGSSSKAVRSYEKHYKLKTQQIEYKVGNKGRFGDDDFSGIDILASAACESEMSGGILDGECSTLAHLPEERKLENTTGSSKLSLLHNMEDTLNIPGTSHCIYDMPLGSSRSAPDMKSLFVATPTILENLVESASAPKVNCSLYSALNNANEIEIVSDAKSTSVAIANSSDNPEKTIGCLKDTVVQTNHANATNAKSTSVAIANSSDNPEKTIGCSQDTVVQTNHANATRDSRLHWDLNVAMEAWGTDCGAVEDPLVATVSDHDDARNDMNKPGTSHHFESRDGSVVDHSVDTHMDDALKHVSANTKDTCDSPADSPSHPSRNLQLLESGYVGSDALAETMDLPDQKNSRFASAMDSHIRSDPEPALIMEHFASASHVEKINGSHPEPVQCDGLSNMSSVNVHIGSNSLQTSELGTTLKPLASILVSEESKNLPTVGTSHKKVTDFGWSDNKLEEASEQSISESKNQELLDVDSETSKKGEHDTGIFYANERTKYAENLIHPEDNHGSSNCDMAHVHEENGAVAMINSKDSLITCANSSTVETYYISDAAPQVPVPSSECHKLECFTDAGSTVDSKSAAHSYQNGCENELGKVISNVRSDQCYETDTSHISKNLAGVEKVYVEEDDSQYEDGELRESGDCYWVDDGYEDVKHANWHYQVSDYKNEEATPGLTSLHTDSVANNVVIPVANDNGPQSRKEDIAVSPVSSKCSWLTNCLDGGSIADGKSQSIHLRGDTNMYGSNPSRVAVRSATTVSQSERCNDALGDMLNIRMKNTGWDMMPEDQKHSQHDARDVTDSSNRCVLSSDAARDDDSLQKKGLLNRDLQGVERQKSFDRPQRNELSRSDDGYGSGSKSGRAMDSHGSHDMYGTSRHVQTSARVEWVESSKRPRSTRHKSPEYYNYGTSGPRNAAEAAVAKMQSSGFVVARDGTLVRAVDAANAGQMPRRMRNPLSSSCHLISGWGSPVDRDEACGMSRGPVHARKASPERHFGANSNRSSRYGSEMEKNHTTDANLSSVHCSLSSRQRGTPTSRASLNLSRAHSRSPSGSRSRSPHDWAPRNRGKIMANGGSTLWKHSRSPPNHMTKGEIGRMASPRRQPGYDDRAMCYSPLSRNNTYSKNASTWVDGRNGSAVDISDDHNKRYSRRSSPLRITSRNDRFDVMDSQGRPRSGEFYRPTQGRLLYGYNRENKHGRNGEDGRECTDRYANNSVKRYDRSGAVKQFRNDTGDKFRTRISAPRSPDLQRGVSPRRFDRSFER

SEQ ID NO: 707 - protein, 743 aa, Zea mays
QVANINAKEETPVGHGEVICFSIYSANSDVQAADFGNGKTCIWVDVLDGGRGVLMEFAPFFEDSSIKKVWHNYSFDSHVIENYGIKIAGFHADTMHLARLWDSSRKIDGGYSLEGLTNDRRVMDTVPEDLPKPGKTSMKTIFGRKNIRKDGSEGKVVSVEPVKKLQREDRELWICYSSLDSMSTLRLYDSLKSKLTTRRWILDGCPRGTMYDFYEQYWRPFGALLVKMETEGMLVDRGYLSEIEKAAIAERKLAADKFRKWASKYCPDAKYMNVNSDIQIRQLLFGGIENRHKSGETWPHSKTFKVLNEESVATEGKKTSKYRTIKLCSIVEDLKIDMFTPSGWPTVSGDALRSLAGKIPTEYIYTIDDIQDDDEYTSGSENPDGNSSYGTAYEAFGGGKNGKEACHAIAALCEICSIDSLISNFILPLQGDHISCAEGRIHCSLNINTETGRLSARTPNLQNQPALEKDRYRIRQAFVAAPGNSLIVPDYGQLELRILAHLTNCKSMLHAFKAGGDFHSRTAMNMYQHIRDAVQEKKVLLEWHPQPGQEKPPVPLLKDAFGAERRKAKMLNFSIAYGKTAVGLSRDWKVSVKEARDTLKLWYRDRKEVLAWQKSQKKLASEKGEVYTLLGRSRHFPYLTQYGPGQRGHIERAAINAPVQGSAADVAMCAMLEIERNVRLKELGWRLLLQVHDEVILEGPSESAEVAKAIVVECMSKPFYGTNILNVDLAVDAKCAKSWYAAK

SEQ ID NO: 708 - protein, 1159 aa, Sorghum bicolor
MDTRRRLPILLALLLAFFSAVAASDEIHGCGGFVEASSGLAKSRKASDSKLDYSDITLWCLLDTNYAGGDLNAQTQNPIMYRTDELRVSFMCLEVELCTVDGLVKESTQCAPNGYYFIPVYDKVPVIIDHNGCNGNADINFQFTGFMISGKVVGAVGGKSCSKGGGPAGVKVELMTDSDELIASASTSSSGEYSFTNIIPGRYRLRASHPDYKIELRGSPEVDLRFGNVVADDVFFVSGYDIYGTVVAQGNPIVGVHLYLYSNDVTEVPCPQGFSDAPKEGALCHAISGADGKFTFRSLPCGSYELLPYYKGENTVFDISPSSLPVSVEHSHLTIPQKFQVTGFSVGGRVIDGYGAGVESANVIVDGQSRAITDSLGYYRLDQVTSKKYTITAEKDHYKFNRLENFMILPNLASIDDIRSVRYDVCGIVRTVTPNSKAMVTLTHGPENVKPQRKLVGENGQFCFEVPAGEYELSALPVDSERSSSLMFSPGSISINVNSPLLDLEFSQSQVNVHGKVSCKEQCNQNILVSLVRLAGGVEQEKKTTTLEQDNVSFVFKKVFPGKYRVEVKNSLPEGSAKDDWCWDQSTLNIDVGTDDKGSQRICVETSGQHEIHLTNPCISFGSSSVLFDTAKSMPIHISAKKYLVKGEIHVDMSSLQENIDSKDMVVDVLKSDDSFIEKISTSPVIGKDNQNDFTAFEYSIWADLGEDFIFVPHDSSTGRNKVLFYPARQQYSVSMNGCQDTVPLITAKTGLYLEGSVLPATSDVDIKIVAAGKSNYAHLNKGDVATETKTDSEGSFFADGYHLKQTGPYTFSCQKLGQISVRIYGENSELLPSVLLSLSGEEGYRNNSISSSGGTFTFDNLFPGSFYLRPLLKEYKFNPSAVAIDLNSGESREAEFRATRVAYSAMGSVTLLTGHPKEGVFVEARSESTGFYEEATTDAFGRFRLRGLVPGSTYSIRVVAKDNLRFAAVERASPEYLSVNVGREDITGIDFVVFEHPEVTILSGHVEGDGIDTLQPHLSVEIRSAADPSRVESVLPVPLSYYFEVRDLPKGKHLVQLRSGLPSHTHRFESELVEVDLEKEPQIHVGPLKYKTEERHQKQELTPAPVFPLIVGVSVVALVISMPRLNDLYQSAVGMTSLGSGMAPIKKEPRKNIIRKRV

SEQ ID NO: 709 - protein, 1025 aa, Sorghum bicolor
MARRGHDDDDEIEEEEDEEEAYDLDEEEEEDEEDDYEEEARRGKASRSGGAGGGKGGGGGRKRSREDNFIDDSAIEDDDEEDDDDDGGGRPRKKGGGGVRGFFDEEAQVDEDEEEEDEGEGEDDFINDAGADLPDEDVVRGSRRHSIPMRDEEEDIDEIERQVRERYARSTHIEYGEEAAEVEQQALLPSVKDPKLWMVKCAIGHERETAICLMQKYIDRGDLQIKSVVALDHLKNYIYVEAEKEAHVKEACKGLRNIYASAKITLVPIKEMADVLSVESKSVDLSRDSWVRMKLGIYKGDLAKVVDVDNVRQRVDVKLIPRIDLQALASKLMHIRVERRRDKESGEYFEWVDNLKFKDGFLYKSVSTKSIHTNNIQPTFDELEKFKKPGEDMNGDMASLSTLFANRKKGHFMKGDAVIVVKGDLKNLEGWVEKVEDETVHIRPKISDLPKTLAFNEKELCKYFKPGDHVKVISGVQEGATGMVVKVEGHVLIILSDTTKEHIRVFADHVVESSEITTGITRIGDYELHDLVLLDNLSFGVIIRVEAEAFQVLKGVPDRPEVVLVKLREIKSKIDRRSSAKDRSNNIISAKDVVRVIEGACKGKQGPVEHIHKGILFIYDRHHLEHAGFICAKAQSCLLVGGSAGGRRGNGMDTADARLGALRSSASILQSPGRLPPRGPNMNYGGRFGGGRGGRGHDALVGKCIKIKSGPYKGYRGRVKEVTGALVRVELDSLMKIVTVKRDDIADTPTVATPFREPRYSLGGETPMHPSRTPHHAYQTPMRDPGATPIHDGMRTPMRSRAWAPMSPPRDNWEDGNPATWGSSPAYQPGTPQARPYEAPTPGSGWANTPGVSFNDAPTPRDNYANAPSPYVPSTPVGQPMTPNSAAYLPGTPGGQPMTPGTVGLDAMSPILGGEGDGTWLLPDVMVNVLRGGDDGPGVVREVLGDGSCRVALGSSGNGDMVTVLPNEVEVIRPKKSDKIKILNGNFRGYTGKLIGIDGSDGIVRLDDTYEVKILDMVILAKLAT

SEQ ID NO: 710 - protein, 929 aa, Sorghum bicolor
MADALFVVLRKLADSLGERALERIGTELVQAAPVSTDYEHSMKQIEAELLILQAFIAQAGAKVGDKAFDAWLDQVRDVAHEVEDTIDEYAYLAVQAVDTGSFFKRKFRQIKKFAAWQKFHSQISQVEARIQRLGEIRNRYGILAGEIDRSNKLRKPNQLFMSDSSYLTDSSEIVGYVDEIGRLTQWLLEDKQERTLIAIFGMGGLGKTTIASSVYKNQNITRTFNCHAWVTVSQTYQVEELLREIINQLIDQRASMASGFMTMNHMRLVEVIQSYLLDKKYLIVLDDVWDKDAWLFLNHAFVRNNCGSKVLITTRRKDVSCLAVDHYRIELKTLQYAESWELFCKKAFVALKDSQCPENLRFFAEKIVARCQGLPLAIVTIGSTLSYREFEEQGWESFYSQLSWQLANNPELNWISNVLNMSLNDLPCYLRSCFLYCSLYPEDYKIRRNVISKLWIAEGFVEDRDDGTTMEEVANYYLVELTQRCLLRVTESNACGRPRTFVMHDLVREATSVIAKREKFGIAYGDASTTQVPHEVRHLCIQRGAQTLNFIASSRLRSFILFDTEVPCSWIDDILSRFRLLRVLCLRFANIEQVPGVVTELYNLRYIDFSYTKVKIIPASFGKLVNLQVLDLRFTYVEELPLEITMLTNLRYLQVFVVHDLLQRSLDCFSATKIPGNICLLKNLQALHTVSASKDLVSQLGNLMLLRSLAIMKVRQSYIAELWSSLTKMPNFSRLLIFAIDMDEILDLKMLKPLPNLKFLWLAGKLDAGVLPSMFSKFEKLAWLKVDWSGLKKDPIISFSNMLNLVDLRLYGAYDGEQLTFCAGWFPKLIRLELGDMEHLDWIEIEDGTMIGLHDLELVGLGNVMAVPAGIQYLRTLHQMFLTDMSKGFIQRLQGSDNYIVQHIPNIHIFYSSDSQAGNFHVLCQLLDE

SEQ ID NO: 711 - protein, 691 aa, Glycine max
MKMLPPPTAGGASHSGAGDRTVVVGMKMDSHSTELLTWALFKVAQPGDVVLALHVLGNDEIVNREGKSSLFSLVKAFDSILAVYEGFCNLKQVDLKFKICRGSSVRRILVREANAYSATHIIVGSSQGLHIIRPCISVARYCAKKLPKDCWVLAVDNGKIVFKREGKNNLLIFILASSLDQPYIAGLDQDHKTRLLGSIHRTISKEFVEKKRCSICASEEESCGDASDENNPLAIVPVQTNDAASKPGWPLLRKTIASDKKCSEKSLLRQISVVQWAMQLPSRDLSYAAHQDHKANNLDAEIGTASSPERNSRSIPKELEGLHEKYSSTCRLFEYQELVLATSNFLPENLIGKGGSSQVYRGCLPDGKELAVKILKPSDDVLKEFVLEIEIITTLNHKNIISLLGFCFEDGNLLLVYDFLSRGSLEENLHGNKKNPLVFGWTERYKVAMGVAEALEYLHNNEGQSVIHRDVKSSNVLLSEDFEPQLSDFGLAKWASTSSSHIICTDVAGTFGYMAPEYFMYGKVNDKIDVYAFGVVLLELLSGRKPISGDYPKGQESLVMWASPILNSGKVLQMLDPSLGENYDHEEMERMVLAATLCIRRAPRARPLMSLISKLLGGDPDVIKWARLEANALEAPEMLDGEACPPSNLQSHLNLALLDVEDDSLSMCSVEQNVSLEDYLRGRWSRSSSFD

SEQ ID NO: 712 - protein, 1079 aa, Glycine max
MGTPDKKISDFVDVVRSWIPRRAEPLNVSRDFWMPDQSCRVCYECDSQFTIFNRRHHCRICGRVFCAKCTANSVPVPSDEANTGREDWERIRVCNYCFKQWEQVTTVDNNGSADPSATPCLSPSPSTTSLVSTKSSCTCHSSSSTAGSVPYTTGPYQRVPYSPHQSSQMNQITDDQENLNSGRSTNPSEAVGNVPSNQFGHCFSRSDDEDDDYGVYHSDTESRHYSHAHDYDDPVNIHGVDHVYGPHQMHPDEDNIQEKNLSCLTQAQNLDPEGVGGIQVPGKEDDEHDHADGCETSPYHEESNYAEPVDFESNGLLWIPPEPEDEEDDREAVLYDDDEDEGTTGGGEWGYLRSSTSFGSGECRSRDKTSEDHRKAMKTVVERHFRALVAQLLQVENLNTCDEDGKESWLDIITALSWEAATLLKPDTSRGGGMDPGGYVKVKCIACGHQNESMVVKGVVCKKNVAHRRMTAKIDKPRFLILGGALEYQRVSNQLSSVDTLLQQEMDHLKMAVARIDAHHPNVLLVEKSVSRYAQEYLLAKDISLVLNIKKPLLERIARCTGAQIVPSIDHLTSQKLGYCETFHVDKFFEEHGSAGQGGKKSTKTLMFFEGCPKPLGCTILLKGANGDELKKVKHVIQYGIFAAYHLALETSFLADEGASPLEFPLKSPITVALPDKPSSIVRSISTIPGFSVLTARESQGAKAFKEEPQSNDIYKTERSPSSCCESTERSLVGDSIHMHEVSGGITQSAQDMPSSNCNSFLSNTSSKEDDKKCPMEFFQYRLDERRETMLNNDLISDSFGTFESSQQDGNSHLRAAALSAYQGANPEPPYIKHDTNNYNNNNNHDDMIHSKEDFPPSTSDHQSILVFLSTRVWKGTVCERSHLVRIKYYGSSDKPLGRFLRDQLLDPSYTCCSCELPSEAHVHCYTHQQGSLTISVKKSEFALPGEREGKIWMWHRCLKCPRIHGFPRATRRVVMSDAAWGLSFGKFLELSFSNHAAASRVASCGHSLHRDCLRFYGFGKMVACFRYASIHLHSVYLPPPKLEFNYDSQDWLQKEANERRFQVLCCRRVEIGCQILGI

SEQ ID NO: 713 - protein, 882 aa, Hordeum vulgare
MASRSYSNLMELAAGGDREQPTLPSLGQRRVPRVVTASGIVPGLHCFDDDAGTASVASDQPNQAPRERTIIVANQLPIRATRGADGAWEFSWDEDSLLRQLKESMRGHQGRVDMDFVYIGSLRDDIPAEEQEKVAAELYDRFRCVPAFLAADLRSRFYHGFCKQQLWPLFHYMLPLSPELGGRFDRTLWQAYVSVNKIFADKILEVINPEEDFVWVHDYHLMVLPTFLRKRFNRVRLGFFLHSPFPSSEIYKTLPVREELLRALLNADLIGFHTFDYARHFLSCCSRMLGLKYESQRGYIALDYYGRTVTIKILPVGIHLVQLQSVLNLPETGLKVAELMKQFCGRGRILMLGVDDMDIFKGISLKLLAFEQLLVQHPEWRGKLVLVQIANPARGRGKDVKDVQDESYAMVRRINEAFGQPDYQPVILIDRPLHFYERMAYYVVAECCLVTAVRDGMNLIPYEYIIARQGNDKIDRILGLSPSTKKKSMLVVSEFIGCSPSLSGAIRVNPWNIDSVTEAMEKALSISDCEKVLRHEKHHKFVSTHDVGYWANSFLQDLLRSCQDHNKRRCWGIGFGLRFRVVALDTSFKKLAAEQLVSAYRKATTRAILLDYDGTLMPQTSFGKNPGSKTIDMLNSLCRDEKNMVLIASTKTRATLSEWFSPCEDLGLAAEHGYFLRLKRDAEWETCGIATDCSWKQIAEPVMKTYTETTDGSVIEDKETAIVWCYKDADPDFGSCQAKELHEHLESVLSNEPVSVKADVNHVEVKPQGVSKGLVAKRMLSAMQARGLLPDFILCIGDDRSDEDMFEVITTAVDGPYLNPEAKVFACTVGRKPSKAKYYLDDTADIVRLIQALANVSDEVQGGPPSYFFACAGTSTDDRALN

SEQ ID NO: 714 - protein, 637 aa, Oryza sativa
MSHSGKRLDQSPAASPSPSRPVLVMSHSSNRLDQSPARPVLVMSRSSNRLDQSPASSPASSRGPVLVMSGSGNRLDSSGPSPSPSPTAAAAAAPVLVLSNSGKRMDQAGRKKYVKQVTGRHNDTELHLAAQRGDLEAVRQIIAEINAQMTGTGEEFDSEVAEIRAAVVNEPNEVEETALLIAAEKGFLDIVVELLKHSDKESLTRKNKSGFDVLHVAAKEGHRDIVKVLLDHDPSLGKTFGQSNVTPLITAAIRGHIEVVNLLLERVSGLVELSKGNGKNALHFAGRQGHVEIVKALLDADPQLARRTDKKGQTALHMAVKGTSAAVVRALVNADPAIVMLPDRNGNLALHVATRKKRSEIVNELLLLPDMNVNALTRDRKTAFDIAEGLPLSEESAEIKDCLSRAGAVRANDLNQPRDELRKTVTEIKKDVHTQLEQARKTNKNVSGIAKELRKLHREGINNATNSVTVVAVLFATVAFAAIFTVPGGNDNNGVAIAVHAVSFKIFFIFNAIALFTSLAVVVVQITLVRGETKAERRVVEIINKLMWLASVCTTVAFISSAYIVVGKHFQWAALLVTLIGGVIMAGVLGTMTYYVVRSKRTRSIRKKVKSTRRSGSNSWQQNSEFSDSEIDRIYAI

SEQ ID NO: 715 - protein, 367 aa, Hordeum vulgare
MSAASRDAPVPPAMPDLVRDHLYFGDINDAIAALTASLPDGTDITHVLSVVSSASISFFTDYRPGLCLPTEEVRRVVAGEDGTPSVVAPGRLVRVVERTGEGLRVTRMAVPLKDTEEENLLDHLEPCLDFIDEGRKAGSVLVHCFAGVSRSATIITAYLMRTEQKSLEEALQSLKEINESVCPNDGFLDQLKLFEEMGFKVDTSSPLYRRFRLKLLGQSYRVGEKIGNHVFEDDPGVARQPNPTEELSGKGKTPKTAYRCKKCRRIVAAQDNVIGHTPGEGNSSFEWHDKRKGHTHNKEQQDCSSLYVEPLKWMTPVEDGALEGKLSCIHCGARLGYFNWSGIQCNCGSWITPAFQISKSKVDVSTI

SEQ ID NO: 716 - protein, 437 aa, Hordeum vulgare
MDEGLVSVDKFSGGSQVYFLTHLHLDHTRGLGASGGWRHGPLYCSPATARLLPIRFPGVDASLLRPVAAGASASLSLSSPNSGRPVSIHVTALPALHCPGSLMFLFRSDIGCMLYTGDFRWELGCDKARSAKKALLDALAGDTVDVLYLDNTYCHPSLNFPPRHVVAQQIVDIIHAHPDHEFILGIDTLGKEDLLLYIARALQTKIWVWPQRLLTIHLLGIDNNEEIFTTQTSLTRIRAVPRYALSIESLEALNTVCPTIGIMPSGSPWLWRNSEGKAKFSDKAPAKSSRCKGRGRGAGAIEMNYDPLSPPKLFEKDSYTLPYSDHACFLELEDFMQTVRPSAVVGIVRTSYCYVNPRGHFGHLCADEDEACTDNTPNGRHAGNSPPKRRPSALKTPRRRMVKISSPTLYRSRAIMMKRRHSCGAKIEEPEETIPVS

SEQ ID NO: 717 - protein, 580 aa, Hordeum vulgare
MYRAAAAAISRSSSSALRRHLARGGGGGEQRQWARGYAAKEVTFGVGARAAMLRGVNDLADAVKVTMGPKGRNVVIERPNRSPKVTKDGVTVAKSIEFEDSAKNVGASLVKQVADATNKAAGDGTTCATVLTQAILTEGCKAVAAGVNVMDLRNGINKAISAVTAHLKSKAWMIDSPDEINQVATISANGEKEIGDLISKAMGIVGKDGVITIADGKTLDNELEAVQGMKLTRGYISPYFVTDQKTQKCELKNPLILIHDKKNSSMNSLLPALQISIQNNRPLLIFAEDVEGEALSMLVLNKHRAGLKICAVKAPGFGENRRANLDDMAILTGGQVISEEQGLDLDKVELQMLGTAKKVTVSLDDTIILDGGGERQQIEERCQQLRESLENNTAMFDKEKAQERLSKLSGGVAVLKIGGASEAEVGEKKDRVTDALNAARAAVEEGIVPGGGVALLYAAKELDQISTSHEDERIGVQIIKNALKAPLMTIAANAGVDGAIVIGKLLEQDNLSLGYDAAKGEYVDMIKAGIIDPVKVIRTALQDAASVSLLMTTTEAAVAELPSTKARIASRMPDMSGMGF

SEQ ID NO: 718 - protein, 278 aa, Hordeum vulgare
MEPHHPRRAPTAAMDPPTPAGARPAMSHSSAFLLPSSATPAGSGDAYAVVVLNQRLPRFAPLLWDRAQVRVCADGGANRVFDGMPELLPGHAPDDVRSRYKPDVIKGDMDSVRPEVKEYYSNLGTKIVDQSHDQDTTDLHKCVAFITDKSPGPDKSNLCILVLGALGGRFDHEMGNINVLHLFPNIKIVLLSDDCLIFLLPRTHSHNIHIERSVEGPHCGLIPIGTPSTSTTTTGLRWNLDNAHMSFGGLISTSNIVDEDQVMVTSDSDLIWTISLRH

SEQ ID NO: 719 - protein, 1796 aa, Hordeum vulgare
MGSPEGRLVELLGTVKSRMPRRGEHSPPPAPKAAAADVPQPHDLSRDFWMPDQSCRVCYDCDAQFTILNRRHHCRHCGRVFCARCTANSVPRSLGDATREDIERIRVCNYCFKRWLEEEAVTPRDVAQPSGLSHSATSAGSEKSCSTGRSSTVTSDQMLSYANACCTDSASRSVGSEGNCGELDASLELQHAAMEGVEHVAYVDNSPDPFNFCLNRSDDEDDDYTIFRSDSEVHHLQNSGGPMCFDDHQVVCSDAAKGSVSPRKDTATLVNSEGMCKTGDHHIIDNAEDCNARSSSLYGMEVLENELVDFENNSSLWLPPEAEDEEDDHDGAPFDDDEGEDATGEWGYLRSNSFSGHCRSRDKSTEEHKKAMKDIVDGHFRALVAQLLQAEKVELADKIGNESWLDIVTSLSWEAASLLRPDTSKGGRMDPGGYVKVKCLACGRPSDSLVVRGVVCKKNVAHRRMSTKKEKPRILILGGALEYQRVSNLLSSFDTLLQQETDYLKMAVVKIKAHQPSVVLVEKSVSRYAQDLFLEKNISLVLNIKRPLLERISRCTGAHIVPSIDYLSSQKLGNCDLFHVEKYIEEHGTAGEGGKKMLKTLMFFEGCPKPLGFTILLKGANGDELKKVKHVVQYGVFAAYHLALETSFLVDEGATLPELPLKSPIIVALPDKPSSADRSISTIPILQMPTISSPNNNLQAFDIQKDDFTFSGFRIMDQTAAASFPDNKCCERLGVTQASSVQINDQTGNIGCLLGMNPQSYNDPLVQQLRISFCHCPACTRDVGSKMKFEELQPETNRHALANGLSVLPAHPANLVAAESDLSFAHNANNGAKVAAKPSAPLNLQVSYNNGSSNDGSIVKRDEIPASPADNQSILVSLSSRSVWKEAICERPHLLRIKYYGNFDKPLGRFLRDQLFDQSNRCLSCELAPEAHVYCYVHPQGSLTISVRKLIVKLPGEHDGKIWMWHRCLRCSRDKGLPPSTKRVVMSDAAWGLSFGKFLELSFSNHAAASRVASCGHSLHRDCLRFYGFGEMVACFRYASIKVHSVYLPPPKLDFTSQHQEWVEQEANEVVDSAELLFTEVLNALHQISEKRPITGSFDGNMKILELRQNIVELEDILQAEKVDFTESLKNLLKKEIRKGQLFIDILEVNKLRRQLLFLCYLWDQRLSFIATSGGKYCDALGGLRVGSNNSEINDRSADSDTNTKLVKNSKGTDSNALHADDEEINQHDQSNETNSRNTEELNGAEGTIAKLNHANSVNVNDHLDHQGSIIGVRRVSSEGQFRVATDISDKLDAKWRGEDRPAPDASLVKPLALLEGTAADVKKQAKAVPRHTSASVRSGDTVEDLLSCLKMPYMTFYNSLNTNSGTAPTFGTLADYNPVYISLFRDLSQQGGARLFLPTGANDVVIPVFDDEPTSIISYALVSPVYHFQMSVESNQNKDSGDSSLSLPVYDSGNFNLFHLFEDFGSSDDFASSISSSRGSFARDLLHSRVSFQDGGPLGKVKYTVTCYYAKNFEELRRSCCPSELDYLRSISRCKKWGAQGGKSNVFFAKSLDDRFIIKQVTKTELESFLQFGPDYFKYLSESVSTGSPTCLAKILGIYQVTIKHLKGGKESKMDLLVMENLLFGRNITRLYDLKGSSRSRYNADSSRNKVLLDQNLIEAMPTSPIFVGNKAKRLLERAVWNDTSFLAGIDVMDYSLLVGVDEEKHELVLGIIDFMRQYTWDKHLETWVKSSGILGGPKNAAPTVVSPMQYKKRFRKAMSAYFIVIPEQWMPAIINPDQSSSNICEDDSQNASPE

SEQ ID NO: 720 - protein, 500 aa, Hordeum vulgare
MASPPCPPSPLARVRLDDVAPHDGAAAPGYARAVGALAASLARRGAAVLELPAADAAVVRCALESARAFFRGRHAAYLYRAGRTLEDGELSPACMADAFRCLGKAARAALCAIARHLRLRTDVFNQLLDDTPLPVNEISSSELLVSYSHEQLQSGQALMGCPSRSSMPQVDRGFVMLVASDCPGIEVCDPNGHWYIADGVSGPNNLLLLTGRALNHVTAGLCPISHYRVTNENRASLTFRLVPHANAILDCSPILAAGHCIRQVYQPIPASQFMDDSCAEEHAVSSHLDEPSESQGNFVSDPSLRSVLSDPLSGSFLEDAMVLQCGHSFGGLMLKKVIEMARCTICNGEVDPSSLFPNLALRAVATVVKMEDDRRLFHNAALRKRRKDVTEHTDVPKRTGSSKDNNELALDAGSPVAFKGVQYPFVVGERVLIMGNKRTPDKFVGKEAVITSQCLNGWYLVKALDSGESTRLQYRSLKKVSELQLQTQARLQPLAFLGGR

SEQ ID NO: 721 - protein, 260 aa, Hordeum vulgare
MSSAGSARIPKRRRTTKASEAADRQLRERQFPDLNLLPVVEALNTGGSLSINEPVSHRQPPPMVVSLGYETTQVVVSSAAAGSNIGMNSFPINVEVIDDDVAIYTSGPPPQARQQSSRTGPITVIIDDDSETTAGPAGEALDEHVNTLLSLGMNPRHNPSRAQPNTDLVINIVDIPETNNTPPKVAQAAPEPVKEIPKETKFSCPVCMNELVNASSTICGHIFCQKCIKASIQAQKKCPTCRRKLTISNFHRVYLPMADN

SEQ ID NO: 722 - protein, 498 aa, Hordeum vulgare
MGKGNKVDRLSALPDDILVDILDRLNVPEAARTSILSRRWSQLCAKLSRLIISALDFLPEGVSRSSADISDDELVRINEAVVQATNSVLARRNPGEHTIDLLSTTFHLRDDLPISMGHAVGHAIATHSVKNAKFCVRTRKDDAAEIDDDEEMVIWAREFMLFFDACPIAFGGLTTLNIGNFRFGESDISSILTTCKRLKHMHLYNCDSGDCSTLQVEHANLSELCIMDCRLEQVKLNWLPQLTRIVFDGWIDFQDPLVLGLVPLLESVSLTNIAISVNKMVRLSWFLSSTSVRVLKLGFSSEKIWVQPECPTQGLASVFRQLRFVNLVKLPEGYDLTWTMFILEAAPLLKELYMTVWDDLCSMELDEEKRKNGSYSENKGVEWGSAAADFQHHSLVTLVIFGFESEDYAVNYVRRVMVAAVNLEDVFLYSRLELECGDCQDKKPTRFAWTKRQKISLKKRITAGIESFAIIHSNKTIRADHEAKLFYPQCSHFDTTSG

SEQ ID NO: 723 - protein, 1134 aa, Hordeum vulgare
MAAEEPCCISHAFDRAARRDPARLAVVHAVANGERRFACGDLLSAVSSLSRRISAALPRPSTDHRGCSDRHGGGAGATPRVVGLYASPSAEYVAAVLAVLRCGEAFLPLDPSWPEDRVRSAVSASNAALVVSAGVSNEDDVLKGCPCPVLRFSGEIRQGLYDGEVGIGGDGLAWPCERRRPWEFCYVMFTSGSTGRPKGVCGTEKGLLNRFLWMQRRNPLCSDDVLLFKTSVSFVDHLQEFLSAVLTSTTLVIPPIDWRANPTSWATLIKAYRISRMTIVPSLMEIILPTLEKNISCGYNSLKILVFSGEILSLVLWKRVREIMPETTIINLYGTTEVSGDCTFFDCKDLPAILEHEEITSVPIGFPIANCEVFLMTHAGMADEGEICVSGACLFNGYLAEFLRSNHTEGSEGSTYYKTGDYARRLKAGELVFLGRKDRTVKIYGQRFSLEEIESTLKEHPDVSDAAVTFQSKGSPNYKAYLVFRNNDEIVKGRPQYREVNSSQDIMASIRSWLIKKVPPAMIPSFFLPMKSLPLTSSGKVDYFKLSSLECALEPCEMEQIDSGSGPVNPHLEVIKKAFCDALLVDEVSEFDDFFTLGGNSISAAHAAHKLDIDMRLLYIYPTPSKLLHALVMEHNNSVSPTDEPHPKKGLNGSASIQRLFDSIAANTNDSFHEGKAQINGKRAHYHIAGSYGNGTDGQLSKYPFSPNDRYQASDLNLDTCLKDRNSVMGSQWILNFCLQKKWSIGRSNRFMHDYEGKLLLEDCCSYVSCNKRGYLQELWNIPLDSCVDASPLLVLNNGMMNIFIGSHSHLFLCIDGCNGSVRWSVKLEGRVECSAAITGDFSEVVVGCYKGNIYFHDMLTGKLSWTVQTDGEVKMQPVVDRTKNLIWCGSYDHHLYALNYKDRSCAYKVSCGGSIYGSPAVDMAQNMIYAGCTSGLVTAISLEVPSFRIVWQYEAGAPMFSSLAFDHQSGNVICCLVNGLVIALNSHGTVVWKATVGGPIFAGACVSSALPSQALIPSRDGSLYSFDTASGDLLWSYDAGDPITASAFVDEVLASTPSGSSERFICICTSSGKIRVLGIRTDAEQEKDGYSVQEFTAMDLPGDIFSSPLMVGGRIFVGCRDDRLHCLSIASHP

SEQ ID NO: 724 - protein, 307 aa, Hordeum vulgare
MEGSTPTITRIAVVTGGSKGIGLEACKQLAGSGITVVLTARDETRGTAAVEQIKRLGHSDVIFHQLDITDASSIARLADFLKTRFGKLDILVNNAATDGIEHVINPVYGLIPGDETFNGMDAGQRMDWMWTTCRQTYETAKQGLQTNYYGTKRVTEALLPLLRSSSDGRIVNVSSNFGLLSFFRNEELKKELNDVDSLTEERLDELLAMFLKDFEAGAVEAHGWPAEFSAYKVAKAAMNAYSRILAKRHPELRVNCAHPGYVKTDITRNSGILTPEEGARNITGVALLPEGGQTGKYFSEGEEASFV

SEQ ID NO: 725 - protein, 587 aa, Hordeum vulgare
MEPLTGFRASVWSCFKFLPFFCGLLLLGIIKGVLFGPWAWFIMAIGISALVLGLWPMHVIWTYYCIIRTKLVGPVVKLLLLISVSGVLVMWLIVGVLGSVLAGLAYGFLAPVMATFDALGEGKERPLVHCFVDGTWSTITGGCTVVRDMKDMLLHSYLAYMDDLRFHEPPGGKPFEIRVLDIPGAVLAAACGLLMDGIMFTVIALYKFPVMLFKGWKRLIEDLVGREGPFLETVCVPFAGLAILLWPFAVLGAFLASMISSVPLGAYAAIVVYQESSLFMGLSYAISSVSIFDEYTNDVLDMAPGSCFPRFVYRKNQASVESGPLSRPASFRDKQDGKKAPARITSFKSSFDEFNPFKLLDHLFEECQHRGEALVAEGVITPKDIEETKSGKGGSGVLNVGLPAYVILNALLRSAKADSNGLLLRDGCEITSDNRPKNTLFDWFFDPLMVIKDQIKAENFTEEEEAYLQKRVLLISDPKRLKATLPHLPSLNERKQAEIDAFARRLQGITKSISRYPTSKRRFDDLVKALSEELERAMGGSRSVRGSQFQKLKSGLVRMLSQRSMGKTTSIRGYDQEAQLNSDASAA

SEQ ID NO: 726 - protein, 1166 aa, Hordeum vulgare
MDGGETQVVDDGGTPPLGSPVSSGDTTQSGGEEDGNGLRLGSPVSSGDTTQSGGEEDGGVLYGETQPLDEDDEETEAVEEFEGEGEERMSDDTQVVEDSEDDAGGFAGQTQAVEEEEEDGGSTEDEAGDGDRTQLVEECEVEDGGSGETQLAEECQEEERENDSSDDEAAVQRGTTQLVEDSDKEMGGDGDDELSQGTQVQSDDEGLPNNEGDVKDYAEDSVDSDASTEEEGATVKSLEQGKRHASTNGTFLRTEIVDNSTSCNASFGDCPGRRIDDGSFGYVQSHEKDGSKSKGRCSTAKKLFADTTNEQKEIKSRCFSGLSYLGSQEPGELSQANALDVVEGLISIHGGISSQEPSPKKLEKAKPPVSVKMGTLLLAEKVDRRRSSSGKAEVFAWVDSREDDGGGDFFRKNKDILLHQSAGRGKSKIPRPKKCSTKIAPPDKKIIEGRKRRTRSKLCEKTETLPSSDSRLLKSEVKSKRASGKRTEKKLLKDLDDHLSTAKPIERQQEKVSVDLHDVGQDTQMAVEAIEALAQSSPAENLSARVEPPVKRDLRVGSKVEKGNPKSGPPRKRTSSVQEGVTTRSKRIKVTEMNHKPQKGQGGIEMRHNLEDCATKTKHKQAKPVPQKNKVANIVDGNSYDSTPVVRRTRHTGRNNLYESPELCSNKNLKKATVADVRNNHSEHGLERPVISERTAEYGSDSMFKENTEIACANNAQGLQPSTDASIQHTSANVAQNLEPLRDEPTTHVFRREPSSHPKQRRTPTAVVQAKAPAVTEAATGHDMQPEVTRPSKKRRIFIRSSELLTYARRERSDCRSNCLLSSILTQSSAASPVLDSSSGVNSKTSGVSSSDQRQKKPSGVKDAGNSPKCNSPVPCSGLKTPSKVVSKLSPTFSPLNPSKASSRSLLKPSIARELLELDPENALPSRYRKDSRRKDMTSCSIIFSHHLDEDVIKRQKKILARLGAHEAYSVADATHFVADGFYRTKNMLEAVTRGKLVVTSMWLESCGAAGCFVNDKKYILRDAKKEKEMGFSMPISLASACKSPLLLGKRVFVTQNVKPSREVVTSLVSASSGQPLERMGRSIRKEKEAADDLLVISCEEDYQTCAPLVEKGIDVFDVELLLNGIVTQKLDYERHRLFLDRVKQTRSTRWLKDGAHGQFVPVSKS

SEQ ID NO: 727 - protein, 883 aa, Hordeum vulgare
MGAIGGDESVQWDKMNGAEVVNGGGSGAGSLDRIQVLVRVRPLSDKEIARGEPAEWECINDTTIMFRSTFPDRPTAPTAYTFDRVFHSECSTKEVYQEGVKEVALSVVGGINSSVFAYGQTSSGKTYTMTGVTECTVADIYDYINKHEERAFVLKFSAIEIYNEVVRDLLSAENTPLRLWDDAEKGTYVENLTEVILRDWNHLKGLISVCEAQRRTGETFLNEKSSRSHQILKLTVESSAREFLGKDKSTTLVASVNFVDLAGSERASQAMSAGTRLKEGCHINKSLLSLGTVIRKLSMGSNAHIPYRDSKLTRILQPSLGGNARTAIICTLSPATSHIEQSRNTLFFGSCAKDVVTNAQVNVVMSDKTLVKHLQKEVARLESELRHPVSSNSSLEAQVKEKDNQIRKMEKEIKELKTQRDLAQSRLQDLLQVVGDRDPKHQVSGKRSIRSPPSVGMPPSASRDDSSQISHDDSEHYKEVRCIETIETGGNERLSLSAGESTSPQDSNRNSSMRGNDSNRNSSMRGNDSTASVNSRRLGETPITLEQHLENIRRPFITKDLGSSTRNPSSCRVIGRSRSCRSLTGSTLLDEMELEDCTPVNRSLVIFPGRPEEYQRRGSALNYDAGSETPSRAGSEISTLKGASKAGDAEFTGIGEFVAELKEMAQVHYQKQLGDQSANGKSVGLDPMMDALQSPSRWPLEFERKQQEIIELWHACSISLVHRTYFFLLFKGESADSIYMEVELRRLLFLRDTYSRGSTPSNVVVGSLSSSPVASAKKLQREREMLARQMQKRFSVEERNHMYTKWSVPLDSKKRKLQVARRLWTESRDLEHVRESASLVAKLIGLQEPGQVLREMFGLSFAPQQPPTRRSSNGWRYGIPSFG

SEQ ID NO: 728 - protein, 266 aa, Brachypodium distachyon
MGIGALQPAAAMAPAATASNAAPRIHHRPWTRAAAPRTLVCNAGSGSSNTGAPPQPRTTRGRFAATTAAGAAPDAVTYSSSIDTDMPLYEPPGVSFDEYLEDRPRVFRAMFPDEGRSQRLGDDHWRVRMLPLEFLLITVHPVVVMQLRNRGRALQLRITEWELRGLDSGYTPASFDLGVRGSLYADRSGGGSRLRGHLEISITAVLPPPLRLVPDGVLRGVAESVLSTLAEKMKRDVDVGLVADFRMFRMEKAASRATGTAVARAE

SEQ ID NO: 729 - protein, 1186 aa, Brachypodium distachyon
MEGTTAAAVVGGDGAAGDAQIKGGKENGQQALQLQRPLQPSGGSEALEMPPTPLPIARDLDWSEHFSFFNSAGGFTDGARGLASTGLSNSVSRPDSVTQCCLEGTDERVEELTVGNCISSDAQPHASAGGSSSGGERPAVVRGLWGNFTLAWRSSDVASRENLAAGRGDIANLRTGDVASRETLAVNLGNNMISQNNLRTGNVASRENLAANLANSIIAQNNLRTADMVSRENLAANLGNSMISQSIDASGKEMPFSRGDNANSEFNMSFGNQQQPIPSSRLNQTEQRFERENGLKVSSFSNRIIDQMRNKTATPSSGVQGFPFKTASKGKGVTYQSAREEIQAQANARPRVPMDRISKIPSSTHNSMARLDGAFFNGGGNASESQNEGTSLRELIRPTGQVTSKFEKMQLFKQILDHVDKSHARGLTLQHVRPSYFIVSPPNQVKYTGSYATQDLSAPAKPDIATDDMFNRKRRFDQKNAHQEFNGNGNPNSILKYQKVGDQGSVAVRRPTHTFRTDHRGGNQSEDVDPGASGQGNSSCTVRGRFNFGEPYYGNGNNASYAQRLSNYGNQESVLDLRLLEDSWYRSPEELSQLKGTFPSNIYSLGVILFELFCCCETWELHCAAMSDLRHRILPPNFLSESPREAGFCLWLLHPDPRSRPKARDILGCDLINEGRDLSLLDNKVPAAVNEEDTESGLLLNFLSQLKEEKEMQASKLSADLAGLQTDIAEVERRHSLRNGFSLEDMGVLASSNDLPGTSSDALRGGSLSGLLPPICRSSIYEQRVMRNLEQLENAYYSMRSTIDTSETNVIKRSDNDALRVRDNFYQLHGDTDAMNEQTDRLGCFFDGLCKYARHSRFEVRGILKNADILNSPNVICSLSFDRDEEYFAAAGVSKKIKIFEFDALLNDRVDIHYPLIEMPSKSKLSCVCWNSYIKNYLASTDYDGTVQLWDASTGQGFTQFTEHRKRAWSVSFSEVDPTKLASGSDDCCVKVWSINQKNCVDTIRNVANVCCVQFSPYSSRMLAFGSADYKTYCYDLRHTRIPWCTISGHGKAVSYVRFLDPETLISASTDNTLKIWDLNRTNSSGLSSSACSLTLSGHTNEKNFVGLSVHDGYITCGSENNEVYSYYKTFPMPITSHKFGSIDPITGQETNDDNQQFVSSVCWRGRSNMVVAANSSGSIKVLELV

SEQ ID NO: 730 - protein, 313 aa, Brachypodium distachyon
MARPRAGAHPSSLVALLLSALLLLLARDGAARGGGGRGSSVYPASVVYPHHSRQISWKPRVFLYQHFLSDDEANHLLSLARAELKRSAVADNTSGKSTLSEVRTSYGTFISKGKDPIVAGIEDKIAAWTFLPKENGEDMQVLRYKRGEKDEPQFDFFTDTVNTVRGGHRAATVLLYLTDVAEGGETVFPLAKDFTDTGLHDKDTTLSECAQKGIAVKPRKGDALLFFNLRPDAATDPLSLHGGCAVIKGEKWTATKWIRVASFDKVYHMPGNCSDNNDSCVRWAALGECIKNPPYMIGTAALPGHCRRSCNVC

SEQ ID NO: 731 - protein, 568 aa, Brachypodium distachyon
MEAVAGDETVGELLRAAAALVPAEHYAIAALVAFSVFAYRFLELHVIGDLLRGLRGGRVELVFHPASEIYHCVASKCRSLHGRYLATPWLASPHLQTLFLGISGRPPSFTYKRQLYTVRDGGTVALDWLLANLEDGIISQDASTPLVVVVPGLTSDSDAAYVKHLVHSMARKGWNVVVSNHRGLGGVSITSDYFYNGGWTEDVREIVNYLHQKYPEAPMFCVGTSIGANILVKYLGEEGENTPVAGAASICSPWDLVVCDRFISRKLVQRLYDKALAFGLKGYAELHQPIMARLANWEGIKKSRSIREFDHHATCVVAKYETVDTYYRRCSSASYVGNVSVPLLCVSALDDPLCTREAIPWDECRANKNIVLATTPNGGHLAFFQGLTAGRLWWVGAVSEFLCALHDSSCMHRQKAGDHVLQSSLESSIDKSPYVSIMGDGMVAPVTNDGSDNDEPPSNQIDNGLKLNNGVNDSQQDEKDHKSCISVDETPAKTPAGSAKQQGEEHYANKIHDAIDPVRRSINQLSRYQGKSVGLLAYIAFVTSWPLLGSLALIVLRKKFRKPLSAKL

SEQ ID NO: 732 - protein, 322 aa, Brachypodium distachyon
MDVRRQPNVAAAAAAAAAAATLGDLFPHQPAMDSGDNNTEWLSIYLEDCLSTHPVSAEQASQGAVKQKLPPPSSSNARRKKRSLASVIRDEEEHCFTVFVEPPLLLPDQKHWLAESELILPKKDKDQELVQQQEQEHEEEKKRNASAEMLFQQEQMLVCSYCLSNQTPQWWDGPSGVLCNACGLRLQAGNEFSSMERCGQEISKEQEQGKRQEKRRIKRPAYIDEELPQKKRTKKTTYVNEELPPEEPVQRCTHCMSHKTPQWRTGPLGPKTLCNACGVRYKSGRLLPEYRPANSPTFSSYMHSNSHKKVMQMRKSVEHSGQ

SEQ ID NO: 733 - protein, 262 aa, Setaria italica
MAASAMLLLFLLLASPAATRLASAACASEKFPAGRAYATCEDLPKLGASLHWTYDASKSSLSVAFVAAPAAPGGWVAWGLNPTGEGMAGAQALVALKGSGSGAPTVKTYNISGYGLGASSPLEFPATELAADAGGSGGKIRVYGKLQLRKGMKAVNQVWQVGSSVTGGAPDKHAFGADNLSAKAKLVLAGSKAAAAGSPSLSPVPAPEAGGPSASGSGTDSGAASSMAPSAGKSPNAAALTAAGVSAPALLMMALVGFLVTV

SEQ ID NO: 734 - protein, 721 aa, Setaria italica
MARTNWEADKMLDVYIYDYLVKRNLQATAKAFIAEGKVATDPVAIDAPGGFLFEWWSIFWDIFHSSTAKPASSSASGPPLHDINKSREHQMRLQLLHQHNAAQLHTRGPDVSAVLASKMMEDRIRNPNPADSDASQHLLDANRIALLKSPPNQTGPPPMQQQQIHPRNQQLDIKPDVAMPQRTVPADHSSLYASGMMHPKPPLLATGLNQAGGSVPLKGWPLTVTGIDQLRSNFGAQKQLVPSSNQFQLLSPQQQLIAQAQTPNDLTRMSSPAPSASPNVRSDDPDYLMKLKMAQMQQPSGYRPMELQQPQQQNTRKRKPTSSGAANSTGTGNTVGPSPPSTPSTHTPGGGVPVTSNANILQKSSMICGTDGTSGLASSSNQMDTLDSFVDFDENVDSFLSNDDGDGRDMFAALKKGSSEHNSESLKGLSLSEVGNKTSNNKVVCCHFSTDGKLLASAGHEKKVFLWNMDNFKMDTKIEDHTNFITDIRFKTNSTQLATSSSDGTVRLWNAADESGTLQTFHGHTSHVTSVDFHPRLTEVLCSCDDNGEIRFWKVGQTTWTHVLRAKQGGTGRVRFQPRSGQLLAVAGGSMVNIFDVEKQANLPSPAKGHNSEVNCVCWDESGEYLASVSQDTVKVWSVSSGACIHELRSHGNQYQSCVFHPRYPKVLIVGGYQTLELWSLSDNQRNPIQAHEGLVAALAHSPITGMIASASHDRYVKLWK

SEQ ID NO: 735 - protein, 351 aa, Setaria italica
MTTTMMRLRQHLASSPIYTSAIARIGNSRAPHRLLPVAPPQKHRPTTRVMSSSSSASDAAAAAVPFEKPRAVVKKLLAESQPEGQGATVRRSIGRHELRNLDPFLMLDEFSVSKPAGFPDHPHRGFETVTYMLEGAFTHQDFAGHKGTIRAGDVQWMTAGRGIVHSEMPAGDGVQKGLQLWINLSSKDKMIEPRYQELQSKDISRAEKDGVEVRIIAGEAFGVRSPVYTRTPTMYMDFTMRPGSQLHQPVPEGWNAFVYIIDGEGVFGREKSAPVSAHHCIVLGDGDGISVWNKSGAPLRFALVAGQPLGEPVVQHGPFVMNSRAEIQQAMEDYYYGKNGFERASQWSSSA

SEQ ID NO: 736 - protein, 249 aa, Setaria italica
MENVLLDRSSGSFEFPKRSLGRSRRGLAARPAAPGGAYSSFPTHQPPYSGAWTSAPALPYARPPIYSSPSLPLLPSNQPPLLPLPPTATKYATFPCLPAAAPPPSPPPAPRAAGRGSAGVTTAVPAAAAPAPARRERDRRRRPARPPPTPSTAEAPRAQKKKPLERATPLPPAPVVTEALDDLEREVARNFVQDLLHALAPPPSSLPLPRFSLVAKASPATSPRVVAPAAPSCNVEAAAADGIHGLLRL

SEQ ID NO: 737 - protein, 140 aa, Zea mays
MAHSLAASFSPAAARRQVTNVISSWSSVSFQSHRMTSVSIRSRPSSLRFKICCSAKKETVDKVCSIVKEQLALPDGTAITGESKFAELGADSLDTVEIVMGLEEAFNITVDETSAQDIATVQDAADLIEKLMLEAPPKVV

SEQ ID NO: 738 - protein, 170 aa, Zea mays
MLATTCSRPPCPCARSRRLPAATFGGTSSAKRRAPRRAAAAVRCGLLPVDPWAPTMDSQSVASQLFAVSLFPYLGFLYFMTRSKTAPGLTLFGFYFLLVFVGATIPAGIYAKVHYGTSLSNVDWLHGGAESLLTLTNLFIVLGLRGALRKLEEEGTDESVSEASQEKSSV

SEQ ID NO: 739 - protein, 225 aa, Zea mays
MLFLRCQPRVPSASASAPPFRPRVRVAAPLGVRVTGGRRGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELAELKGRDKLGDRAVFVLVEADA

SEQ ID NO: 740 - protein, 345 aa, Zea mays
MVLTKPYLSNSLLPVPSPPPSSPTLSSNHASPVAAPTCRRSRLRISATSTAAPAPSSAAAATASLSRVDVLSEALPFIQRFKGKTVVVKYGGAAMKSPELQASVIRDLVLLSCVGLRPVLVHGGGPEINSWLLRVGVEPQFRDGLRVTDALTMEVVEMVLVGKVNKNLVSLINIAGGTAIGLCGKDARLITARPSPNAAALGFVGEVSRVDATVLHPIIDAGHIPVIATVAADETGQAYNINADTAAGEIAAAVGAEKLLLLTDVSGILADRNDPGSLVKVIDIAGVRKMVADGKVAGGMIPKVECCVHALAQGVHTASIIDGRVPHSLLLEILTDEGTGTMITG

SEQ ID NO: 741 - protein, 218 aa, Zea mays
MVRLAKFYLVCYNSLQSLGWFVALLRLVPCLVPPFPVHSAYVVAGDLICFLQTCAILETVHAAIGLVPTAPLLAFLQWGGRIHFILAVVRQIREVQSSPSVFITFIAWSISEVIRYSHYALSTLKVCPAWLTYLRYTAFIPLYPIGVGPGEMWTMYQALPFVKKRDLYSGFFEKFSMSYRSFLVGVLVLYPFLWLKLYQHVFKQRKSKLGKGSRKKRA

SEQ ID NO: 742 - protein, 68 aa, Zea mays
MAAAGEAPSTLLRFLYFVGAGVICTKAINTYRDYEHKKESTAALAAAESALAAAAAAEPAPATAAAKP

SEQ ID NO: 743 - protein, 98 aa, Zea mays
MGPQQGRRSNGGAAARSKQEEEGGAKVVRYRECQRNHAASLGGHAVDGCREFMAAGADGTAAALACAACGCHRSFHRREVEQQPAADCCDCSSTTSGA

SEQ ID NO: 744 - protein, 123 aa, Zea mays
MMKPSCVLLVSSLLVATLAAASSSSPPYSVGKHPGWLLVLGRKGRELGQSSGYHYQHQSKQPELQGVAMEVKKPEEEATARRTADQSGDAEAGLIYSADYSSVAMHAASPPTAKPKHRHPTRP

SEQ ID NO: 745 - protein, 371 aa, Zea mays
MAAEHATAAVGEPPPATSQPAEGVTAAAGQRSVPTPFLSKTYQLVDDPAVDDIISWNDDGSAFIVWRPAEFARDLLPKYFKHNNFSSFVRQLNTYGFRKIVPDRWEFANDCFRRGEKRLLCDIHRRKVSPATGAVTVAAAAAAAIPMALPVGSPVYSGEEQVLSSSSPEPPSLQQHPPAPSGSGSGGVVSGDVGEENERLRRENARLARELGQMKKLCNNILLLMSKYAATQQPDAAKEAAAGNCTGESSDAAAAPPLPSILELLPSCRADPAPAAAGTDHEDDEKAGARLFGVSIGRKRMRDESDHHAGVCAAEVKAEPVDARPDQQRQRNATEPQSWPIYRPRPVYHPLRACNGSGSAGSDHDGSNDSR

SEQ ID NO: 746 - protein, 446 aa, Zea mays
MAGSSMDTEAAGKELKQGSGGGGGYTMPATAHAVDTDSWQQVGLLLVIGFNCAYVLSFSNLMMVPLGWAWGVACLLLVGAAAWYANWLLAGLHFVDGQRFIRYRDLMGFIFGRNMYYITWFLQFATLLLCNMGFILLGARALKAINTEFTHTPARLQWFITATGIVYFAFAYFVPTISAMRNWLATSAALTLAYDVALLAILIRDGKSNKQKDYDVHAGSQAEKVFNALGAVAAILVCNTSGLLPEIQSTVREPAVRGMRRALLLQYTAGAAGYYGISVAGYWAYGSAVSEYLPNELGGPRWAAVLINATAFLQSIVSQHLFTVPIHEAMDTRLQRLDEGMFSRYNLTRRVCARGLVFGFNVFVTALFPFMGDFVNLVGSLALVPLTFTFPSMAVLKIKGKSCGRCNRLWHWGIIVLSSALCVATTAAAVRLIFNNARIYHFFADM

SEQ ID NO: 747 - protein, 1448 aa, Zea mays
MRKAGAKEGSIGSKGAIDVNSLSVSTEIAGRPSDLMIKSCTCTGRLSSSSAHNLTDTYISMTCKSCTGESTEDRGGPSCSGKLNNMGLELPRPIDLEVKWMTVKKRQRDTRRARASFGEDTSRDGIGSFCLSGCATNQEMAQDAPVSESEKFGVSILGRRFSDPMENVPIKKRRFHMDFSPSPPFTPLLVDPYEKIPGSSSKAVRSYEKHYKLKTQQIEYKVGNKGRFGDDDFSGIDILASAACESEMSGGILDGECSTLAHLPEERKLENTTGSSKLSLLHNMEDTLNIPGTSHCIYDMPLGSSRSAPDMKSLFVATPTILENLGESASAPKVNCSLYSALNNANEIEIVSDAKSTSVAIANSSDNPEKTIGCLQDTVVQTNHANATNAKSTSVAIANSSDNPEKTIGCSQDTVVQTNHANATRDSRLHWDLNVAMEAWGTDCGAVEDPLVATVSDHDNARNDMNKPGTSHHFESRDGSVVDHSVDTHMDDALKHVSANTKDTCDSPADSPSHPSRNLQLLESGYVGSDALAETMDLPDQKNSRFASAMDSHIRSDPEPALIMEHFASASHVEKINGSHPEPVQCDGLSNMSSVNVHIGSNSLQTSELDTTLKPLASILVSEESKNLPTVGTSHKKVTDFGWSDNKLEEASEQSISESKNQELLDVDSETSKKGEHDTGIFYANERTKYAENLIHPEDNHGSSNCDMAHVHEENGAVAMINSKDSLITCANSSTVETYYISDAAPQVPVPSSECHKLECFTDAGSTVDSKSAAHSYQNGCENELGKVISNVRSDQCYETDTSHISKNLAGVEKVYVEEDDSQYEDGELRESGDCYWVDDGYEDVKHANWHYQVSDYKNEEATPGLTSLHTDSVANNVVIPVANDNGPQSRKEDIAVSPVSSKCSWLTNCLDGGSIADGKSQSIHLRGDTNMYGSNPSRVAVRSATTVSQSERCNDALGDMLNIRMKNTGWDMMPEDQKHSQHDARDVTDSSNRCVLSSDAARDDDSLQKKGLSNRDLQGVERQKSFDRPQRNELSRSDDGYGSGSKSGRAMDSHGSHDMYGTSRHVQTSARVEWVESSKRPRSTRHKSPEYYNYGTSGPRNAAEAAVAKMQSSGFVVARDGTLVRAVDAANAGQMPRRMRNPLSSSCHLISGWGSPVDRDEACGMSRGPVHARKASPERHFGANSNRSSRYGSEMEKNHTTDANLSSVHCSLSSRQRGTPTSRASLNLSRAHSRSPSGSRSRSPHDWAPRNRGKIMANGGSTLWKHSRSPPNHMTKGEIGRMASPRRQPGYDDRAMCYSPLSRNNTYSKNASTWVDGRNGSAVDISDDHNKRYSRRSSPLRITSRNDRFDVMDSQGRPRSGEFYRPTQGRLLYGYDRENKHGRNGEDGRECTDRYANNSVKRYDRSGAVKQFRNDTGDKFRTRISAPRSPDLQRGVSPRRFDRSFER

SEQ ID NO: 748 - protein, 1135 aa, Zea mays
MSLPSNNRRTCSRSSSARSKHSARVVAQTPVDAQLHAEFEGSQRHFDYSSSVGAANRPSASTSTVSTYLQNMQRGRYIQPFGCLLAVHPDTFALLAYSENAPEMLDLTPHAVPTIDQRDALGIGVDVRTLFRSQSSVALHKAAAFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFYEDEHGEVISECRRSDLEPYLGLHYPATDIPQASRFLFMKNKVRMICDCCATPVKVIQDDSLAQPLSLCGSTLRASHGCHAQYMANMGSVASLAMSVTINEDEEEDGDTGSDQQPKGRKLWGLVVCHHTSPRFVPFPLRYACEFLLQVFGIQLNKEVELAAQAKERHILRTQTLLCDMLLRDAPVGIFTRSPNVMDLVKCDGAALYYQNQLLVLGSTPSESEIKSIATWLQDNHDGSTGLSTDSLVEAGYPGAVALREVVCGMAAIKISSKDFIFWFRSHTTKEIKWGGAKHEPVDADDDGRRMHPRSSFKAFLEVVKWRSVPWEDVEMDAIHSLQLILRGSLPDEDANRNNVRSIVKAPSDDMKKIQGLLELRTVTNEMVRLIETATAPVLAVDIAGNINGWNNKAAELTGLPVMEAIGRPLIDLVVTDSIEVVKQILDSALQGIEEQNMEIKLKTFHEHECNGPVILKVNSCCSRDLSEKVIGVCFVAQDLTRQKMIMDKYTRIQGDYVAIVKNPSELIPPIFMINDLGSCLEWNKAMQKITGIKREDAINKLLIGEVFTLHDYGCRVKDHATLTKLSILMNAVISGQDPEKLFFGFFDTDGKYIESLLTVNKRTDAEGKITGALCFLHVASPELQHALQVQKMSEQAATNSFKELTYIRQELRNPLNGMQFTCNLLKPSELTEEQRQLLSSNVLCQDQLKKILHDTDLESIEQCYMEMNTVEFNLEQALNTVLMQGIPLGKEKQISIERNWPVEVSCMYLYGDNLRLQQILADYLACALQFTQTAEGPIVLQVMSKKENIGSGMQIAHLEFRIVHPAPGVPEALIQEMFQHNPGVSREGLGLYISQKLVKTMSGTVQYLREADTSSFIILMEFPVAQLSSKRSKPSTSKF

SEQ ID NO: 749 - protein, 535 aa, Zea mays
MGGGDADAGGEPADAQATLHIRCTNASKFTVRADLGATVGAFKAIVADSCDVPAPQQRLIYKGRILKDEQTLASYGVETDHTIHMVRGAVPSPTSTAPAANQEPTTAAPASSPATGLGGLLQSLGTTGAAANSEGLGLFGSAPPGLDQMQQQLAENPNLMREMMNMPLMQNLMNNPELIRSIIMNNPQMRELIDRNPDLAHVLNDPSIMRQTFEAVRNPELMREMMRNTDRAMSNIESSPEGFNMLRRMYETVQEPFLNATTMGSEGDRNSNPFSALLGNQGSNQARDSAANGTTRASDPTSGSPAPNTNPLPNPWGSNAGSAQGAARSSPASNVRSTTASGLGGLGSADLGSTHGASGGGSDATLLTQVLQNPTMMQMMQNIMSNPQSMNQLLNMNPNVRNMMESNTQMREMIQNPEFLRQLTSPETLQQLISFQQSLMSQLGQQQAGQERTQSGSGAGNVNLNTLMNMFSGLGAGGGLGVPNAPNVPPEELYATQLAQLQEMGFFDTQENIRALAATAGNVHAAVERLLGNMG

SEQ ID NO: 750 - protein, 1039 aa, Zea mays
MVAAQVTPAPLLRRHGSAPPWLSSSPPFLLRRRASSPFSLHRRASPPLAISGCRRQDYSHCSDMAVRGSSAFKLRFYPNLEVQNIAQEWVKESRRLFYLRTANNVTNNIYKGNTPLWTGMVQNELSEDCRGLNYTYLNNLRERVSSKSIVNRHGNNRELIGHSTINQHVKSVPAPVRVVNDSVKCFSMPRASKVEIPWPAYSPAEDPLLDKSNTEVILELEDKVHDGDDKKKKTVVKKVVSPFPTKAAFSEESLKAREALASIYDKVLVVDDIESARNIVKLLTTKYKSFIHACDTEVANINAKEETPVGHGEVICFSIYSANSDVQAADFGNGKTCIWVDVLDGGRGVLMEFAPFFEDSSIKKVWHNYSFDSHVIENYGIKIAGFHADTMHLARLWDSSRKIDGGYSLEGLTNDRRVMDTVPEDLPKPGKTSMKTIFGRKNIRKDGSEGKVVSVEPVKKLQREDRELWICYSSLDSMSTLRLYDSLKSKLTTRRWILDGCPRGTMYDFYEQYWRPFGALLVKMETEGMLVDRGYLSEIEKAAIAERKLAADKFRKWASKYCPDAKYMNVNSDIQIRQLLFGGIENRHKSGETWPHSKTFKVLNEESVATEGKKTSKYRTIKLCSIVEDLKIDMFTPSGWPTVSGDALRSLAGKIPTEYIYTIDDIQDDDEYTSGSENPDGNSSYGTAYEAFGGGKNGKEACHAIAALCEICSIDSLISNFILPLQGDHISCAEGRIHCSLNINTETGRLSARTPNLQNQPALEKDRYRIRQAFVAAPGNSLIVADYGQLELRILAHLTNCKSMLHAFKAGGDFHSRTAMNMYQHIRDAVQEKKVLLEWHPQPGQEKPPVPLLKDAFGAERRKAKMLNFSIAYGKTAVGLSRDWKVSVKEARDTLKLWYRDRKEVLAWQKSQKKLASEKGEVYTLLGRSRHFPYLTQYGPGQRGHIERAAINAPVQGSAADVAMCAMLEIERNVRLKELGWRLLLQVHDEVILEGPSESAEVAKAIVVECMSKPFYGTNILNVDLAVDAKCAKSWYAAK

SEQ ID NO: 751 - protein, 197 aa, Zea mays
MDDIAWERGRNADDSSRAVLTPPRGPGLLSPSSPSGSGPIPSAAVLALPASATSQSAGLLASSRLAGDMDGGGETLLVRRSKGKKRPQPAAPAEEGSGSGGRFRAIWRDYHDLLQETEAKRKRLASTKRRSLALLAEVKFLRRKYQSFLRGGSQQTHYRLKKQARYMPSPLGSNKAAALADHGAGDRSAFYQQKLKT

SEQ ID NO: 752 - protein, 175 aa, Sorghum bicolor
MATAAGSIQQGHGARFAAACDVLSRYVKAAAAATTPTPVEQPRPLPGTVVGVVLPLMPGADLSTQAEELAEAADQAGPAPRAQQLMTISYGGRVVVLDDVPADTAAELLRLAAAAAAPRVLRAPDDLPMARKASLRHFMEKRKGRVAKRASPYSRPGDAGAAAASSFPDHLALSL

SEQ ID NO: 753 - protein, 364 aa, Sorghum bicolor
MGAGKGGDGGGGGGEAAAAAPEAAQPVVLKMELHCAGCAHKVKKAIKRVPGVESIVTDVAANRVVVAGTADAGALKARLEAKTSKPVEVVSAGGAPKKPAAAAEHAGAGEKKGDKGVSPKEEEKEKDKEKKQQASEEKKPKQETVLLKIRLHCDGCADRIRRRIYKIKGVKDVVLDGNAKDEVKVMGTMDIPNMLSYLKEKLNRDVEAVAPPAKKDGGGEGKDDKKDSGSGGDKNKGAAEAGGDDKKDKGKGIDVSAGPSTAAAAAFMAAPAGASTYHVAPPYGYVAYQQAPPPPPASYYPYPYYGNGDGMGHANPSYYHQQPQQQPDVNQQPQMAYPPYPYRFDMAPPPQLFSDENPNACSVM

SEQ ID NO: 754 - protein, 532 aa, Sorghum bicolor
MAEHGNRALTRWRRWALANLGSFSALFTNTNFGSAWLILAPLVSLVATYAPRRLFLTYFNLFLRRRARRLLNAVDPYVTIDISEPGGEVRYSRYGPVSDSDTTYEEVKAYLSGAACSQDARELRAEGAREGNGLVVSMRDGQDVADEFRGVSLWWSSVIVRDVQGQRKGDRRFQRLTFHLRHRGVVVDEYLPHVRRQGREILFSNRRRRLYTNSKSRDPYSYEYKSWSYIDFDHPTTFDTLAMDGAKKRDIMDDLDTFRNSRDFYRRAGKPWKRGYLLYGPPGTGKSTMVAAMANYLDYDIYDVELTVVHTNSDLRRLLIETTSKSIIVIEDIDCTLDVTGDRASSSSGRPRRREAADEKPPPPRDTVTLSGLLNFIDGLWSACGGERIVVFTTNHVEKLDPALIRRGRMDMHIEMSYCRFEAFQTLAKNYLDVDDHELFGAVEEFLREEDLTPADVAECLMVARRAGSGEPSRCLEISIDELKKRAAEKAKAEAEAKARAEAEAMAWAAEAEARAAVEANAAAARDRGNSR

SEQ ID NO: 755 - protein, 215 aa, Solanum lycopersicum
MLGKSFATPVLTFNSASCFSSPGCESISTTANTLVGYVNCSSSITFNVTRGSWTSNYPFKKWTLHSTATDNIVLTEEEKKTWNDSRQALSALKFSPEEEDKILGKAFGHIHSPYWYEERKKEVPRLEVVNEILDYLRSLSLTDDDLTKLVKKFPEVLGCSLEDEMKTNVEILEKQWGIEGKTLRNLLLRNPKVLGYNVDCKGDCVAKCTRCWARF

SEQ ID NO: 756 - protein, 365 aa, Brachypodium distachyon
MDVEAPKEPLPVGGAARGTSSNNKAMHWLMVALNCGMLTLGTTGGPLLSRLYYSKGGHRQWLSAWLETGGWPLLLFPVSFSYLARRARDGPGAPLVLTRPRTLMAAAALGLATGADDFIYAYGLSYLPVSTSAILISTQLAFTVFFAFLVVRQRLTAFSVNAVALLTVGAVVLGLHASSDRPAGVTRGQYWLGFFLSLGAAALYGLVLPLIELAYKHAAGGGREVTYALVLEMQLVMGFFATAFCTVGMVVNNDFQAISREARAFELGETRYYVVLVSCAVLWQFFFLGAVGVIFCVHTLFAGILIAVFIPVTEVLGVIFLHEKFSSEKGVALVLSLWGLASYSYGEYSDAKAKKKKAALQAQDP

SEQ ID NO: 757 - protein, 597 aa, Brachypodium distachyon
MDVESSAAHEVSVDWRGRPCEPRRHGGMRAAVFVLGIQAFEIMAIAAVGNNLITYVFGEMHFPLSEAANVVTNFVGTIFLLSLVGGFLSDSYLGCFWTILTFGFVELSGFILLSVQAHLPQLKPAPCNMASMDGSCEQARGFKSSIFFVALYLVALGSGCLKPNMIAHGADQFAAGAGVDNAKRLSTYFNSAYFSFCLGELFALTALVWVQTHSGMDVGFGISAAAMAAGLACLASGAAFYRNKPPQGSIFTPIARVFVAAFNKRKQICPASQANVGVCEPARLDGNFRHGNKFRFLDKACIRENAGQQQGQDGNTKPESPWRLCTVAEVQQAKTLLAVTPIFACTIVFNTVLAQLQTFSVQQGSAMDTALGGHGSFRVPPASLQAIPYAMLLFLVPCYELLLVPLMKRLTGTRSGITPLTRIGVGLCTVAFSMVAAATVERRRRDLALSPGGAQQKMSVLWIVPQFLVFGVSEMFTAVGLIEFFYKQAAASGAGIGMQSFLTALTYCSYAFGFYLSSVLVKLVNMVTAGHGGAGGWLGDNDLNKDRLDLFYWMLAVLSVLNFFCYLVCARWYNSGADGLDAASAQIAAEGDGKEIS

SEQ ID NO: 758 - protein, 302 aa, Solanum lycopersicum
MDGMSSYWQFGDELRGQSKVSEDHTWTTGTVKLAEQLRSKGERVNNLDLSKSSAESRFRVYLGLQEDNKWENQYLNMLNFDTKITDNTTKSSFSNDIHNVNSVCPKSNVNSLGNMSFSKFSSNHTNDASSYGNNKNTESINGNNAVDKRFKTLPAAETLPRNEVLGGYIFVCNNDTMQEDLKRQLFGLPPRYKDSVRAITPGLPLFLYNYTTHQLHGIFEATSFGGSNIDPTAWEDKKCKGESRFPAQVKIRIRKLGRALEEDAFRPVLHHYDGPKFRLELSVPETLDLMDLFENTSVFAPV

SEQ ID NO: 759 - protein, 299 aa, Triticum aestivum
MEAPLLLPVSTAASSSTSITVDDDSHCAAQNVSPSRASPSARSIAARYLAVALVAAVSLFSQHEASKGFRIDVIRGGGTADAAGKRFDLLFVANGRAERVLHRASRRVEEALFPDPSFPRRRVARVTVRLMAGGNLTADDAAVDAVTDGEYVISLSPRLLSPSSGGGSSAGAADAVAATVRRAVARMWLWDGRGAAPARVTESMVEYLATAVPAESWPPAEEHTSASNTHCISPRFLKHLERRRAGFVARLNRAMRDRWSDAAVDAALGAPARPVCAAYLAAATETGGQRPVVGSAVAV

SEQ ID NO: 760 - protein, 1363 aa, Sorghum bicolor
MATAAAPVAATVNGMAVDRVVFALNGQRYEVAGVDPSTRLLEFIRTQTPFRGPKFGCGEGGCGACVVLIAKYNPETDEVTEFTASSCLTLLYNINFCSIITTEGLGNSRDGFHSVQERMSGFHASQCGFCTPGMCMSIFTSLINADKSKRPEPPNGFSKLKVSEAEKAFSGNLCRCTGYRPIIDACKSFASDVDLEDLGLNIFWKKGDRKPDVSDLPHYTLGGGVCTFPDFLKAELKSSLDHLNNPCIADSREGWYHPRSIKEYYELINSCFFSDSVKVVVGNTSSGVPGYKDQDLYNKYIDIGGIPELSNIVRRESGFEIGAATPIARTIEILEEECESISSPNGSVVFRKLANHMSKVATPFVRNTASIGGNIVLAQKYPFPSDIATILLGAGATVCLQVVAERRQITLEEFLEQPPIEATTLLLSIFIPHWIPDSGTKTSLLFETYRAAPRPLGNAVSYVNCAFLGHASVDEQSDTLVLSNLRLAFGAYGTEHAIRAKKVEDFLTGKSLTASVVLGAIQLLRETVVPMEGTSHPEYRVSAAIGFLFSFLSPLSKGIPEPGKSLTSSSADSAVTDDVCNMPLSTRRETVFSDEYKPVGEPIKKYGVELQASGEAVYVDDIPAPKNCLYGEFIYSTQPLAYVKSIKFKSSLASEKIVSFVSAKDIPSGGQNIGSSFSYGDEPLFGDPVAEYAGQALGIVIAETQRYADMAAKQVIIEYDTKDLGPPIITVEQAVENSSYFEIPPEMYPKEVGDVSKGMAEADHRIPSTEVKLASEYYFYMETQTALAVPDEDNTLVVYSSSQYPELAQSVIARCLGIPFSSVRVITRRVGGGFGGKAYRSFQVATAAALCAYKLRRPVRMYLNRNTDMVMVGGRHPVKAHYSVGFKSDGKITALHLDLLINAGISPDASPIIPDAIISSVKKYNWGALSFDIKLCKTNISSKSVMRAPGDTQGSLIADAVIEHVASALSLDANSVREKNFHTYGTLQLFYPDSAGEASTYTLHSIFDRLISTSSYLDRAESIKEFNSNNKWRKRGISCVPLIFKVDPRAAPGRVSVLNDGSIVVEVGGIEIGQGLWTKVQQMTAFALGKLWPDGGESLLERVRVLQADTLNLIQGGLTAGSTSSESSCAATLQACNMLIGRLKPVFDRLQQQSENVSWDTLISQASKDNVNLSASTYWVPGKVSNKYLNYGAGISEVEIDLLTGAITLLRGDLVYDCGKSMNPAVDLGQIEGSFIKGIGFFVYEEYLTNSDGLMISNSTWDYKIPTVDIIPKQFNAEVLNTGYNKNRVLSSKAAGEPALVLASSVHCALREAIRAARMEFANSTVSGRSPLEFKMDVPAPMTLVKQLCGLDIVEKYLESLST

SEQ ID NO: 761 - DNA, 1324 bp, Triticum aestivum
cttcctctccttatccacaatttccataccaatccaccactctccactcggccttcccctcgctaccactccgcctgctgccgcgccatggcgctccacgccgtctcccctgcggcggcggcctccccgccctgcgccctctcctctgcccgtctgccccagcgcccaggttgtggttgtctctcaaaccgttcatccctgttaagttcgtccacaaacttcatgaaatttcagtctggagcagtgggtttctttggtgtgcctttggttcttcaacactcggacaagagagcagttttgaggcatgccactaatgaagaaattgaggaagaaaagatgatcgttgaagaacaagctaaagaaaagatggagaaggccattgaaacagttcaatcgaacttcaataccgtcaggactgggcgggcaaacccgtctatgctcgacaggattgaggttgagtactatggaactcctgtaaacttgaagactattgcacagataaataccccagatgcgacttctcttcttatccaaccatatgacaagtcttgcctcaagctcattgagaaagctatagttgctgcaaatattggggtaacaccaagcaatgatggagaagtgatacgagtcactgtcccaccattgacatctgaccgcagaaaggaaatgacaaaaaccgtagccaagttatctgaagaaggcaaggttgctatcagaaacataagacgagatgcaatcaaagcctacgataagctagagaaggaaaagaaactttctgaagataatgtgaaggatttatcagccgatctacaaaaaatcacagacgagtacatgaagaaggttgaagccatccaaaagcaaaaggaacaggagctgagcaaggtttagatccagacccgactccgactgaacaaaaactggctacatgttttctgaagccctcctctggtcatcggatggctgccagtgcgatggggtgcactcgttgggttgttggagtctcgctaagactgatggatgcaaagttgagacagtgttgctgcgtccctcctttcccttttgtaattaggccttccccgtcttcctgtccgactgccattgtcaatatttccatgaattaaattctgtgatgtgcactctaaaagttattttcagttttcctttgctaattatataccctgggccaggctccactgcaatcgggtgctacaaattgggcaagttcttttccatgtttcagagattgaaacgaggctttactgtatctttgacacgataggccggccaccggctgtagccagtgtatcatgggtcccaagtaaag

SEQ ID NO: 762 - DNA, 1503 bp, Triticum aestivum
tccactcggccttcccctcgctaccactccgcctgctgccgcgccatggcgctccacgccgtctcccctgcggcggcggcctccccgccctgcgccctctcctctgcccgtctgccccagcgcccaggttgtggttgtctctcaaaccgttcatccctgttaagttcgtccacaaacttcatgaaatttcattctggagcagtgggtttctttggtgtgcctttggttcttcaacactcggacaagagagcagttttgaggcatgccactaatgaagaaattgaggaagaaaagatgatcgttgaagaacaagctaaagaaaagatggagaaggccattgaaacagttcaatcgaacttcaataccgtcaggactgggcgggcaaacccgtctatgctcgacaggattgaggttgagtactatggaactcctgtaaacttgaagactattgcacagataaataccccagatgcgacttctcttcttatccaaccatatgacaagtcttgcctcaagctcattgagaaagctatagttgctgcaaatattggggtaacaccaagcaatgatggagaagtgatacgagtcactgtcccaccattgacatctgaccgcagaaaggaaatgacaaaaaccgtagccaagttatctgaagaaggcaaggttgctatcagaaacataagacgagatgcaatcaaagcctacgataagctagagaaggaaaagaaactttctgaagataatgtgaaggatttatcagccgatctacaaaaaatcacagacgagtacatgaaaaaggttgaagccatccaaaagcagaaggaacaggagctgagcaaggtttagatcctgacccgactgaacaaaaactggctacatgttttctgaagccctcctcgtcatcggatggttgccactgcgctgggatgcactcattgggttgttggagtcttgctaaaactgatggatgcgagttcagacagtgccgctgcgtccatcgtttcccttttgtaattaggccttccccgtcttgctgcccgactgccattgtcaatatttccatgaattaaattctgtgatgtgcactctaaaagttcttttcacgtttcgtttgctaattatacacccggggccgggctccactacaatcgggtgccacaaattgggcaagttctttccatgtttcagagattgaaacgaggctttactgtaacttttgacacgatatgccggccaccggctgtagccagtgtatcatggggtcccgcgtgaaaatatccacgcatcagcgacgatgacttgcagggcgacacgtcccttgtcgacaacgaccaggctgcgataattacggacgctggtgccggccccacggaaggacgggccggactcgtgtggcagtggtagggccaccaatcggcgggtggtcccggcgtacagtacgtcccattcctgtgctctccactaggatcgagtgatggtaactccggtaggcaaagtattcat

SEQ ID NO: 763 - DNA, 1218 bp, Secale cereale
ccactctccactcggccttcctctcgctaccactccgcctcctgccgcgccatggcgctccacgccgtctcccctgcggcggcggcctccccgccctgcgccctctcctctgcccgtctgccccagcgcgcaggttgtggttgtctctcaaaccgttcatccctgttaagttcatccacaaacttcatgaaatttcagtctggagcagttggtttctttggtgtgcctttggttcttcaacactcggacaagagagcagttttgaggcatgccactaatgaagaaattgaggaagaaagacaatcgttgaagaacaagctaaagaaaagatggagaaggccattgaaacagttcaatcgaacttcaatacagtgaggactgggcgggcaaacccgtctatgcttgacaggattgaggttgagtattatggaactcctgtaaacttgaagactcttgcacaaataaatactccagatgcgacttctcttcttatccagccatatgacaagtcttgcctcaagctcattgagaaagctatagttgctgcaaatattggggtaacaccaagcaatgatggagaagtgatacgagtcactgtcccaccattgacatctgatcgcagaaaggaaatgacaaaaaccgtagctaagttatctgaagaaggcaaggttgctatcagaaacataagacgagatgcaatcaaagcttacgataagctagagaaggaaaagaaactttctgaagataatgtgaaggatttatcagccgatctacaaaaaatcacagacgtgtacatgaaaaaggttgaagccatccaaaaacagaaggaacaggagctgagcaaggtttagttcccgaccggactgtacaactggctgcaagttttctgaagttctctcgtcatcgggtggttgccacttcgccgggatgcactccttggactggaagtcttgctaaaactgatggatgcaaagttcagacagtgtcgctgcgtcccttgtttcccttttgtaattagtccttcaccgtcttctcctgtccgactgccattgtcaatattttcatgaattaaattctgtgatgtgcactctaaaagttcttttcatgtttcctttggtaattatgtaccctgagctgggctccactgcaatcgggtgcaacagattgggcaagttatttccatgtttcagataattaaaagaaaaaaaaaaaaaaaaa

SEQ ID NO: 764 - DNA, 1116 bp, Leymus cinereus x Leymus triticoides
  misc_feature (42)..(42): n is a, c, g, or t
  misc_feature (79)..(79): n is a, c, g, or t
  misc_feature (87)..(87): n is a, c, g, or t
  misc_feature (105)..(105): n is a, c, g, or t
  misc_feature (123)..(123): n is a, c, g, or t
  misc_feature (145)..(145): n is a, c, g, or t
  misc_feature (150)..(150): n is a, c, g, or t
  misc_feature (175)..(175): n is a, c, g, or t
  misc_feature (180)..(180): n is a, c, g, or t
  misc_feature (195)..(195): n is a, c, g, or t
  misc_feature (228)..(228): n is a, c, g, or t
  misc_feature (275)..(275): n is a, c, g, or t
  misc_feature (289)..(289): n is a, c, g, or t
  misc_feature (334)..(335): n is a, c, g, or t
  misc_feature (342)..(342): n is a, c, g, or t
  misc_feature (441)..(441): n is a, c, g, or t
  misc_feature (444)..(444): n is a, c, g, or t
  misc_feature (465)..(465): n is a, c, g, or t
  misc_feature (529)..(529): n is a, c, g, or t
  misc_feature (576)..(576): n is a, c, g, or t
  misc_feature (600)..(600): n is a, c, g, or t
  misc_feature (624)..(624): n is a, c, g, or t
  misc_feature (636)..(636): n is a, c, g, or t
  misc_feature (690)..(690): n is a, c, g, or t
  misc_feature (699)..(699): n is a, c, g, or t
  misc_feature (839)..(839): n is a, c, g, or t
  misc_feature (842)..(842): n is a, c, g, or t
  misc_feature (858)..(858): n is a, c, g, or t
  misc_feature (872)..(872): n is a, c, g, or t
  misc_feature (877)..(877): n is a, c, g, or t
  misc_feature (921)..(921): n is a, c, g, or t
  misc_feature (928)..(928): n is a, c, g, or t
  misc_feature (954)..(954): n is a, c, g, or t
  misc_feature (965)..(965): n is a, c, g, or t
  misc_feature (990)..(990): n is a, c, g, or t
  misc_feature (992)..(992): n is a, c, g, or t
  misc_feature (1004)..(1004): n is a, c, g, or t
  misc_feature (1016)..(1016): n is a, c, g, or t
  misc_feature (1018)..(1018): n is a, c, g, or t
  misc_feature (1030)..(1031): n is a, c, g, or t
  misc_feature (1043)..(1044): n is a, c, g, or t
  misc_feature (1047)..(1047): n is a, c, g, or t
tcctctcgctaccactccgcctgctgccgcgccatggcgctncacgccgtctcccctgcggcggcggcatctccgcccngcgccctntcctctgcccgtctgccncagcgcccaggttgtggntgtctctcaaaccgttcatccntgttnagttcgtccacaaacttcatgaaanttcantctggagcagtgggnttctttggtgtgcctttggttcttcaacactcngacaagagagcagttttgaggcatgccactaatgaagaaattgaggnagaaaagacaatcnttgaagaacaagctaaagaaaagatggagaaggccattgaaacanntcaatcnaacttcaataccgtgaggactgggcgggcaaacccgtctatgcttgacaggattgaggttgagtactatggaactcctgtaaacttgaagactattgcncanataaatactccagatgcgacntctcttcttatccagccatatgacaagtcttgcctcaagctcattgagaaagctatagttgctncaaatattggggtaacaccaagcaatgatggagaagtgatacgagtnactgtcccaccattgacatctgancgcagaaaggaaatgacaaaaacngtagctaagttntctgaagaaggcaaggttgctatcagaaacataagacgagacgcaatcaaagcntacgataanctagagaaggaaaagaaactttctgaagataatgtgaaggatttatcagccgatctacaaaaaatcacagacgagtacatgaaaaaggttgaagccatccaaaagcagaaggaacaggagctgagcaaggtttagatccnganccgactgtacggccanaagttttctgaagncttcntgtcattggatggttgccactgcgctctgcgatcactccttggnttggatnctaaactgatggatgcaagttcaganagtgttgctgngtccctcgtttcccttttgtaatgncntcgccgtcttcntgtccgactgcnantgtcaatatttnncttcgccacatnnatnaaattctgtgacgtgcactgtaaaagtctcggtttcctttgctaattatgtaccctgggttccactgca

SEQ ID NO: 765 - DNA, 1371 bp, Brachypodium distachyon
tctcgggtctctccttctccagcggccctcctctctctctctccctctcttatccacagttcgacacaaatccaactctccactcggttcctctcgctaccactccgcctgctgctacgccatggcgctccacgccgtctcccctgcagcggcggcctccccgccctgcgccctctcctctgcgcgtcttccccagcggccaggttgcggttgtctctcaagtcgttcttccctgctgagttcctccacaaacttcatgaaacttcattctggagcagtgggcttcttttctgctcctctggttattcaatactcagacaagagagcagttttgaggcatgccactattgaagaaattgaggcagagaaaacaatcattgaagaccaagctaaagaaaagatggagaaggcaattgaaacagtccaaactaacttcaatactgtgaggacagggcgggcaaacccagctatgcttgacaggattgaggttgagtactatggaactccagtgaacttgaagagtattgcacagattaatactccagatgcgacttctcttcttatccagccatatgacaaaacttgcctcaagctcatcgagaaagctatagttgctgcaaatattggggtaacaccaagcaatgatggagaagtgatacgagtcaccgtcccaccattgacatctgaccgcagaaaggaaatgacaaaaaccgtagctaaattatctgaagaaggcaaggtagcaataaggaatataagaagagatgcaatcaaagcttatgataaactagagaaggaaaagaaactttctgaagataacgtgaaggatttatcagctgatctacaaaaactcacggacgaatacatgaaaaaggttgaagccattcagaagcagaaggaacaggaactgagcaaagtttagatgccgtcctgggtgcagaactggtctacaggttttctaaagcctaaacatcttttgatggttgacactgcggacttcgctgggatgtgcgctcttttgcttaaactgatggatgcaagttgagacaatgttgctatgtccctcatttcctctttgtaattaggccttcaccgtcttgttgtccgactgccattgtcaatatttcttcaccgcgtggatcaaaatgttttgtgtcagcaatcttgaagtcaaaataactgccgaggtgccttgtttgacttcgacccgttaaaaaatggattagtgccggatggagggaaaggttgggttttcctatgagtgtggcctttatttttgttccatctttcatctcatatattaatttatttattaatatctaatctttaggatagaagattttcaaattttcaccgattgagtttttcatc

SEQ ID NO: 766 - DNA, 1149 bp, Avena sativa
tcaccaatccactactctccacccggccttcctctcgctacgactaccggactacgcctgctgctccgacatggcgctccgcgccgtctcccctgcggccgcggcctccccaccctgcgccctctactctgcccgcattccccagcgcccaggttgtggttgtctctcaaatcgttcatccctgttgatttcctccacaagcttcctgaaccttcattctggagcagtaggcttctttagtgtgcctctggttcttcagcactctgacaagagagcagttttgaggcatgccactattgaagaaattgaggcagaaaaaacaatcattgaagatcaagctaaagaaaagatggagaaggcaattgaaacaatgcaaactaacttcaatactgtgaggactgggcgggcaaaccctactatgcttgacaggattgaggttgagtattatggtactcctgtgaacttgaagagtattgcacagataaatactccagatgcatcttctcttcttatccagccatttgacaaatcttgcctcaagcttattgagaaagctatagttgctgcaaatattggggtaacaccaagcaatgatggagaagtgatacgagtcactgtcccaccattgacatctgaccgcagaaaggaaatggcaaaaaccgtagccaaattatctgaagatggcaaggttgcaataagaaacataagaagagatgcgatcaaagcttacgataaactagagaaggagaagaaactttctgaagataacaagaaggatttatcagctgatctacagaaaattacagacgagtacatgaaaaaggttgaatccatccaaaaggcgaaggaacaggaactgagcaaagtttagagtccgacgtgactgtaaaactgttttgtgaagccttctcgtcttctgatggatgccactgcgcgaggatgcacttcttgccatcttctttttgggttggatggagtctggctaaaactgaaggacgcaagctcagacgatgtcgccgtgtccctcatttccttcttgtaattacgccttcagcatcttccttcctgtctgactgccattgtcaattttttttttgttgccacgtgaatcaaaatgctatgcgatccactgaaatggtcacaattaat

SEQ ID NO: 767 - DNA, 1381 bp, Oryza sativa
tcccaacctcgcttccttatccacaccaatccgccactcccctccgcggcaacccccccgcgctccgccacagaagccgacgccgacgccgcgcgcgtacatgccgccgctccacgccgtctcccccgcggcggcggccgccccgccgcgcgcgctctcctccgccgcgcgcgtcccgcagcgcccaggttgtgttccagaacgcccaaacattttaagctcctccacaaacttcatgagtctccgtgctggaccaatgcgcttctatagcaggcctcttattcttcaaaactcggacaagagagcagtattgaggcatgccactattgaagaaattgaggcagaaaaatctgtcattgaagaccaagctagagaaaggatggaaaaggcaattgaaacagtccaaaataacttcaatactgtgaggacagggcgggcaaacccagctatgcttgacaggattgaggttgagtattatggaactccagtgaacttgaagagcatcgcacagataaacactccagatgcaacttctctccttattcagccatatgacaaatcctccctcaagctcattgagaaaacaatagttgctgcaaatctgggggttacaccaagcaatgatggagaagtgattcgagtcactgttccaccattgacttctgaccgcagaaaggaattggcaaaaactgttgctaaattagctgaagaaggcaaggttgctataaggaacataagaagagatgccatcaaagcttacgataagcttgagaaggaaaagaaactttctgaagataacgtgaaggatttgtccgctgatctacaaaaagttactgacgagtacatgaaaaagatcgaagctatccaaaagcagaaggaacaggaactcatgaaaatttagacaccaggttttaatcttgaaattggtgagttcatcttcctgcgaagtagatgaagccgaagaaaacaatgtcctcagctaacacggtgaattatgcggtcacagatttcttgagccttttccatctttctgatggccggcattttgccggatgcatctttttgggctggagtgcaatttcagacaatgttgccgtgtccttcattttcatttttgtaattattgtgtgtactccgtgtaaaagtaggtcttgaccttatccttgttctaccgctacattgtcaatattcctcacgtgaattaaaatgctacagttgtgaatttatcgccacgcactctgaagcatcaactactggtgccatattgccagttatctccatgttcagtggatctcagttttgtcagcagtcaccgacatctggaccttcgcacattactctatgtcatcgcacggactgacggacaatagcaaaaaggcca

SEQ ID NO: 768 - DNA, 1451 bp, Panicum virgatum
tgagacgggctgggctggattccaatccagcccaccagagcggatatggtcgtatggccatgatcttatcctcttcttcttcgcttggcggcggcttcggcttggcttggccactactgctccctcccactccactccctcaccgtcaccggctgcgcgcatggcgctccacgccgtctcccccgcggcggcctcctccccgctgcgcgccctctcgcgccgcctcgccgagcgccaaggctgtggttgcctcccaaagcaattggtttactcctccacgaactttgcaagacttcaggctggacaagtggactttgttggcaggccactcgttcttcagcactccgacaagagagcagttttgacgcatgccactatcgaagaaattgaagcagaaaaatctgtcattgaagagcaagctaaagaaaagatggagaaggcaatcgaaacggtccaaactaacttcaacactgtgaggacagggcgtgcaaacccggcaatgctggaccggattgaggttgagtactatggaactccagtgaacttgaagagcattgcacagataagcactccagatgcaacttctcttcttattcagccatatgacaagtcaagcctcaagcttattgagaaaacaatagttgccgcgaatcttggtgtaacaccaagcaatgatggagaagtgatacgagtgactgtcccaccactgacatcagatcgcagaaaggaattagcaaaaactgtagctaagttagctgaagatggcaaggttgctataaggaacataagaagagatgcaatcaaagcttatgataaactacagaaggaaaagaagctttctgaagataacgtgaaagatttgtcggctgatctacaaaaagtcacagatgggtacatgaaaaagatagaatccatccaaaagcagaaggaagaggaactgatgaaaatttagatctcaagctgacagtataactgtttggtgctgcgccggggatgcacgttctgtgtcggtgctttgctggaactttttggatgcaagttcagacaatggtagtgttgctgtgcttctgtttttgtaatggttagggttgaaaacggacggaaatattcccattccggcccgttctgttttctatttttgtccatccgtttctgtatttgtgggatcccgtttccgtatttacggaagtagaaatgaggtttctccgtccgtttccgagaaatcccgtttttacatggaattgactcgtatttattctgtttttcatctcgtttttaatctacataagatatgtctaaaaattgatatgttcaaaaacataccaattactaagtatgcatgttaacatgttaacacatggcatactagtgaatattggactaataacttcgtacgtgtatattattttgtgactttgttaatgtatacttgagaatatttgatcgtgtta

SEQ ID NO: 769 - DNA, 1381 bp, Panicum virgatum
atgagacgatgcggttgcaggcggcgggttggtgggccgccgggccgtgggctttaatgggccgagccctgagacgggctgggctggattcaaatccagcccaccagaggggatatggccatgatcttatccacacgccgtcctcttcttcccttggcggcggcttcggcttggcttggcttggccactactgctccctcccactccactccctcaccgtcaccggctgcgcgcatggcgctccacgccgtctcccccgcggcggcctcctccccgctgcgcgccctctcgcgccgcctcgccgagcgcccaggctgtggttgtctcccaaagcaattggtttactcctccaagaactttgcaagacttcaggctggacaagtggactttgttggcaggcctctcgttcttcagcactccgacaagagagcagttttgacgcatgccactatcgaagaaattgaagcagaaaaatctgtcattgaagagcaagctaaagaaaagatggagaaagcaatcgaaacggtccaaactaacttcaacactgtgaggacagggcgtgcaaacccggcaatgctggaccggattgaggttgagtactatggaactccagtgaacttgaagagcattgcacagataagcactccagatgcaacttctcttcttattcagccatatgacaagtcaagcctcaaacttattgagaaaacaatagttgctgcaaatcttggtgtaacaccaagcaatgatggagaagtgatacgagtaactgtcccaccactgacatcagatcgcagaaaggaattagcaaaaactgtagctaagttagctgaagatggcaaggttgctataaggaacataagaagagatgcaatcaaagcttatgataaactacagaaggaaaaaaagctttctgaagataacgtgaaagatttgtcagctgatctacaaaaagtcacagatgggtacatgaaaaagatagaatccatccaaaagcagaaggaagaggaactgatgaaaatttagatctcaagctgacagtataactgcttggcgctgcggcgggaatgcatgttctgggtcggtgctttgctggaacgttttggatgcaagttcagacaatgttgctgttgctgttgctgtgcttctctttttgtaatgctcgtaaataggcaggctctcatcacatcacagtggtggtcagaccactacattgtcaatatttctcaccatctgaatctcaaatgactgaattgtttggttctactctcaagtctttgttgtgaacattctgaggctcaaaacaattttgcgcagcatagttccatgtctgtgtaagtgcatatgaatttgtacctaactatatatgatggtgggctgt

SEQ ID NO: 770 - DNA, 837 bp, Festuca arundinacea
  misc_feature (206)..(206): n is a, c, g, or t
  misc_feature (480)..(480): n is a, c, g, or t
  misc_feature (657)..(657): n is a, c, g, or t
  misc_feature (676)..(676): n is a, c, g, or t
  misc_feature (722)..(722): n is a, c, g, or t
  misc_feature (749)..(749): n is a, c, g, or t
  misc_feature (762)..(762): n is a, c, g, or t
  misc_feature (786)..(786): n is a, c, g, or t
ggcacgaggacaaaatccactatcctccacccggctgctgctccgacatggcgctccacgccgtctcccccgcggcggcggcctccccgccctgcaccctctcctctgcccgcattcctcagcgcccaggttgtggttgtctctcaaatcgttcatccctgttgagtttctctacaaacctcatgaaccttcattctggagcggtnggcttcttcagtgtgccgctggtttttcaacactctgacaagagagcagttttgaggcatgccactattgaagaaattgaggcagaaaaaacaatcattgaagaccaagctaaagaaaagatggagaaggcacttgaaacaatgcaaactaacttcaatactgtgaggactgggcgggcaaacccggctatgctcgacaggattgaggttgagtactatggtactcctgtgaacttgaagagtattgcacagataaatactccagatgcgtctnctcttcttatccagccatttgataagtcttgcctcaagctcattgagaaagctatagttgctgcaaatattggggttacaccaagcaatgatggagaggtgatacgagtcactgtcccaccattgacctctgaccgcagaaaggaaatggcaaaaaccgtagctaagttatcggaanaaggcaaggttgcaataanaaacataagaagagatgcgatcaaagcttacgataaactagagaangaaaagaaactttctgaagataacaanaaggatttatcanctgatctacaaaaaattacagacnagtacatgaaaaaggttgaatccctccaaaaggcgaaggaacaggaactga

SEQ ID NO: 771 - DNA, 1289 bp, Zea mays
acttactttgatacggcccttcgttcttatccacatccccttttgccagccactgctcccgtcccacccgccacaccgtccaccggcacgtccaccggctcccatggcgctccacgccgtctcctccgcggcggtctcctccccgttgcgcgccctctcacgcagcctcccccagcgcccaggctgtggttgtttaccaaagcagtccgtcatgatttactccacaaaatttgcaagacctcaggctggaccggtggacttcgctggcaggcctctggttcttggacgctcggacaagagagcagttttgatgcatgccactattgaagaaatcgaagcggagaaatccctcatcgaagaccaagctaaagaaaagatggagaaggcaatcgaaacagtccaagctaacttcaacactgtgaggacaggacgtgcaaacccggccatgcttgaccggattgaggttgagtactacggaactccagtaaacttgaagagcattgcacagataagcactccagatgcaacttctcttcttattcaaccatatgataagtcaagcctcaagcttattgagaaaactatagttgctgcaaatcttggtgtgacaccaagcaatgatggagaagtaatacgagtgactgtcccaccattgacatctgatcgcagaaaggaattatcaaagacagtagctaaattagctgaagatggcaaggttgctataaggaacataagaagagatgcaatcaaagcttatgataaactagagaaggaaaagaagctttctgaggacaatgtgaaagatttatcagctgatctacaaaaagtcacagatgagtacatgaaaaagatcgaatccatccagaagcagaaggaacaggaactgatgaaaatttagacctcaagctgactgtatggctggtgaggagtaaccgcctccgtgaagcatggacccctgcatatgttggtgtttctgaagcaatttgtttggttcatggctttggcgtctcggcgctgcgccagggatgcacgttttgaatcaggcgctttgctggaacttttgggtgcacacaagttgagactgctgctgctgctgtgtgtgtgttttgagattaagacaatgctgctgtgttttttctttgagattaagacaatgctgttgcgtgtgttcttctcgttttctgtaatgttcgtaaatagtctcttcgtcgccgtgttgtctgactgctacattgtcaatatttcaaaacatacgtctctgaatcaaatgtctggattggttctgccta

SEQ ID NO: 772 - DNA, 1498 bp, Sorghum bicolor
cggcccagttaggcccatttctccctgatatggccttcgtcttatccacacgcgctcggtcttcgtccccactgctccacccgcaccaccgtccaccagctcgcatggcgctccacgccgtctcccccgcggcggtctcctccccgctgcgcgccctctcgcgcagcctcccccagcgcccaggctgcggttgtttaccaaagcaatccctcgcagtttactcctccataaactttgcgagacttcgggctggaccagtggacttcggtggcaggcctctggttcttcgacactcggacaagagagcagttttgatgcatgctactattgaagaaatcgaagcggagaaatccctcattgaagaccaagctaaagaaaagatggagaaggcaattgaaacagtccaaactaacttcaacactgtgaggacagggcgtgcaaacccagcgatgcttgaccgaattgaggttgagtactacggaactccagtgaacttgaagagcattgcgcagataagcactccagatgcaacttctcttcttatccaaccatatgacaagtcaagcctcaagcttattgagaaaacgatagttgctgcaaatcttggtgtgacaccaagcaatgacggagaagtgatacgagtgactgtcccacctttgacatctgatcgtagaaaggaattagcaaagacagtagctaaattatctgaagatggcaaggttgctataaggaacataagaagagatgcaatcaaagcttatgataaactacagaaggaaaagaagctttctgaggataatgtgaaagatttatcagctgatctacaaaaagtcacagatgagtacatgaaaaagatcgattccatccagaagcagaaggaacaggaactgatgaaaatttagatctcaagctgactgtatgactgcttggcgctgtgccggggatgcacgttttgagtcaggtgctttgctgcaaccattggatgcacacaagttgagacaataccgctgtgtgtgcttctcgtttttgtaatgctcgtaaataggctctcgtcaccgtgttgtcggacttgctagtgctacattgtcaatgtttctcaccatctgaatcgaatgtctgaattgtttctgaacgtctgttgtcaaaactctgccgaggttcaaagcaattttgcaggtcaaaactctgctgaggctcaaagcaatgttacagggttcgttgcgttaatgttgagtcactgacaagtagggcctatggtgtaacgttatgctgagtcactgacatgtgaggatatgataggatcctctcgcaattttgcaccagctagccatgggagtctggtgctgagtgcaagctcaagcagagagtacgtgggcttgtggtccgtgatgaggttgttgggcccgattgaattgcgaaccagaaagaatgtccttatcgcctttggtgggccgctgctttggttttgacggacaagtcttttctttctctgccctat

SEQ ID NO: 773 - DNA, 1178 bp, Panicum virgatum
actactgctccctcccactccactccctcaccgtcaccggctgcgcgcatggcgctccacgccgtctcccccgcggcggcctcctccccgctgcgcgccctctcgcgccgcctcgccgagcgcccaggctgtggttgtctcccaaagcaattggtttactcctccaagaactttgcaagacttcaggctggacaagtggactttgttggcaggcctctcgttcttcagcactccgacaagagagcagttttgacgcatgccactatcgaagaaattgaagcagaaaaatctgtcattgaagagcaagctaaagaaaagatggagaaagcaatcgaaacggtccaaactaacttcaacactgtgaggacagggcgtgcaaacccggcaatgctggaccggattgaggttgagtactatggaactccagtgaacttgaagagcattgcacagataagcactccagatgcaacttctcttcttattcagccatatgacaagtcaagcctcaaacttattgagaaaacaatagttgctgcaaatcttggtgtaacaccaagcaatgatggagaagtgatacgagtaactgtcccaccactgacatcagatcgcagaaaggaattagcaaaaactgtagctaagttagctgaagatggcaaggttgctataaggaacatgagaagagatgcaatcaaagcttatgataaactacagaaggaaaaaaagctttctgaagataacgtgaaagatttgtcagctgatctacaaaaagtcacagatgggtacatgaaaaagatagaatccatccaaaagcagaaggaagaggaactgatgaaaatttagatctcaagctgacagtataactgcttggcgctgcggcgggaatgcatgttctgggtcggtgctttgctggaacgttttggatgcaagttcagacaatgttgctgttgctgttgctgtgcttctctttttgtaatgctcgtaaataggcaggctctcatcacatcacagtggtggtcagaccactacattgtcaatatttctcaccatctgaatctcaaatgactgaattgtttggttctactctcaagtctttgttgtgaacattctgaggctcaaaacaattttgcgcagcatagttccatgtctgtgtaagtgcatatgaatttgtacctaactat

SEQ ID NO: 774 - DNA, 1976 bp, Triticum aestivum
cgcgggcccaacccgctccctccctccgtctcggacccagacgcacgcgcacacgcgactcctccctccctccctccaccccgaccgacacgcaccgcaccgcaccggcgagctagggttcgttcgctcgctccggcgtccatctccggcgagcgggcgggcgcgcgggcatggcggggatacggtggccgccggaggacccggagatgttcccgacgcggatgctcgggaccggggtctggggcgggccccccgccgcggccgcggggggaggcccccccggcgagatggcgtcggacgacgaccgctccgtggcggccgactcctggtccatcaagagcgactacggcagcaccctcgacgacgagcagcgctacgccgacaccgccgaggtgctcctcgcctcctgcccctcctcggcctcctcctccgccgcctccgccgccgcgccctccgcctgctcctcctccctcagcgcccaccactcctccgacttcagctttgacaaggatgtgcccgacgtcgtgccgccgatgctgggcctgcacaattaccaggacggcgcgtacgccgaagacctagctaattaccatgaacgcagccacgcggatgactggtttggcaccgaggccatggatgtccttgtaggctggacgaaaaacttatgcttcagcaaggatttgcccggctgcagtgtacttgacataggaactgggagcggacgactcttacagcagcttgcaaaacaagggttttctgatctaactggcattgactatagtgaagccgcaattgagcttgctcgaaaccttgcaattcgtgatggatttgagcacattaatttcctggttgatgatgttctggagtcgaagttggagaggagatttgaacttgtgatggatgaagggactctggatgcaatagggctccaccctgatggacctgtaaagagaatgatgtattggcagtcagtggccagcttggtttcccctggtggcatactggtcatcacatcctgcagcaggaccaaggatgagctagtgcaggaggtggagaacttcaaccagagaaagttgggcgctatggtctctgaaggagctcttgccagcgatgccgtggtgttcaagtacctcgaccacgtccaagcttacccaaacgtcgatggtgtttgcatcgccaccgttgctttcctgcatacatgaaatatatgtatatgtatccatcccccctctctgcccctaacttatcagacctgtgagtaacaatgtaccccaggacagctgctcttctatggatgataatttaccttgtcggatacgttattcgctagtgtggtgctttgttatggctgggtataccgcggtactgtactgtttgaactttgaaatcttgtcaagcaaatgttgcaatcagatgtacagaaatttgtatgctcagaaaactgatcaacagtccatgcacatgtcagtaagacaaaccaaagaactgtagatcaagcatgagttgcaggatcaccggctcagatacaggcctgtaattccatgcattttgcaagtaattttaggtaatctctcgagtacatgggggagctagagaagctcacaagttacatcgtctgggtcagtcttgtggtatgtacagagccactgcattcttctagttcttgtgcacacagaagcgagtggcttcagactatcctactacatcagtatcttttcccctgtttcttgggatctttgcttctgttaaccacatctacgccgtgctgacttatatggtgtcagtagacggggataatgcgtggttggtagtgaggcagcgcaggatcggtgtcggcatcctcttcttcctcctagtcgtcatcgtcctcgtcgttggtgtccgagaagaacatgtaagttccctggtttccctgcagtatcaggtgatctagaccccagagttatgcatcagaaaatagtatacgcagaactctg

SEQ ID NO: 775 - DNA, 1421 bp, Secale cereale
gactagccctctccctctccctccgtctcggacccagacgcacgcgcacacgcgactcctcctcccccctcaccccgaccgacacgcaccgcaccggcgagctagggttcgctccgccgtccatctccggcgagcgggcatggcggggatacggtggccgccggaggacccggagatgttcccgacgcggatgctggggaccggggtctggggcgggccccccgccgcggctggaggagggggagggggagggcccccgggcccgcccggcgagatggcgtcggacgacgaccggtccgtggcggccgactcctggtccatcaagagcgactacggcagcaccctcgacgacgagcagcgctacgccgacaccgccgaggtgctcctcgcctcctgcccctcctcggcctcctcctccgcggcctccgccgccgcgccctccgcctgctcctcctccctcagcgcccaccactcctccgacttcagctttgacaaggatgtgcccgacgtcgtgccgccgatgctgggcctgcacaattaccaggacggatcctacgccgaagacctagctaattaccatgaacgcagccacgcggatgactggtttggcaccgaggccatggatgtccttgtaggctggacgaaaaacttatgctccagcaaggatttgcccggatgcagcgtacttgacatcggaaccgggagcggacgactcttacagcagcttgcaaaacaggggttttctgatctaactggcattgactatagtgaagccgcaattgagcttgctcgaaaccttgcaattcgtgatggatttgagcacattaatttcctggttgatgatgtcctggagtcaaagttggagaggagatttgaacttgtgatggatgaaggaactctggatgcaatagggctccaccctgatggacctgtaaagagaatgatgtattggcagtcagtggctagcttggtttcccctggtggcatactggtcatcacatcctgcagcaggaccaaggatgagctggtgcaggaggtggagaacttcaaccagagaaagctgggcgccacgatccctgaaggagctctagccagcgatgccgtggtgttcaagtacctcgaccgtgtccaagcttacccaaacgtcgatggtgtttgcatcgccacagtcgctttcctgcatacatgaaacatatgtatatttatccctgcccccctttccgcccctaacttatcagacctgtgagtaacaatgtaccccaggacagctgctcttctatggatgataatttaccttgtcggatacgttattcgctagtgtggtgctttgttatggctgggtataccgcattactgtaccgtttgaatcttgaaagcttgtcaagcaaatgttgcaatcagatgtacagaaatttgtatgc

SEQ ID NO: 776 - DNA, 2067 bp, Brachypodium distachyon
agcattgaccatttacccccaccgacaagcgggccaggcccagccgcccacacgcgcacggatcttcccaagtcacatcccctctcccttctcgtccccgagtcccgaccgcaccggcgagcgcgagctagggttcgtcgatcggccgcggcgcatcccatctccggcgagcctagcctagcggcatggcggggatacggtggccgccggaggacccggagatgttcccgacgcggatgctcggcagcggcgtctgggcaggagcaggagccggggcccccggcgagatggcgtcggacgacgaccggtccgtggcggcggactcgtggtcgatcaagagcgactacgggagcaccctcgacgacgagcagcggtacgccgacacggccgaggtcctcctcgcctcctcctgctccgcatcctccgcctcctcctccgtcgtcgcgccctcctccgcctcctcgctcagcgcccaccactcctccgacttcagctttgacaaggatgtgcccgatgtcgtgccgcccatgctaggcttgcataattatcatgacggtgcgtacgcggaagaccttgcccattaccacgaacgcagccacgcagatgactggtttggcaccgaggtcatggatgtccttgtaggctggaccacaaacttgtgttccagcaaaaatttgcccggctgcagcgtacttgacatcggaactgggagcggacgactcttgcagcagcttgcaaagcaagggttttctgatctaacaggcatcgactatagtgaagctgcaattgaacatgctcgaaatctttcaatccgtgatgggtttgagcacattaattttttggttgatgatgtcttggagtcaaaattggagagaagatttgaacttgtgatggatgaaggaactctggatgcaattgggctccatcctgatggacctgtaaagagaatgatgtattggcagtcagtggctagcttggtttctcctggcggcgtactggttatcacatcatgcagcagaactaaggatgagttggtgcaagaggtggagaacttcaaccaaaggaagttaggtgctacggtctctgaaggagcgttgggcagtgatgctgtggtgttcaagtaccttgaccatgtccaagcttacccgaacgtggatagtccctgcattgccaccgttgctttccttcatatgtgaaatatatatgtatctatcctttccccactttctatccctaacttatcaaacttgtgagtaacaatgtacccccatgacagctgttcttctatggatcaatttacattgtcagattggttcatccattgttatgttgctttgttatgtccggatatttcatacctccactctttgaaagcataagatgcacttaaatgtgtatgattggagacttgaatcaacagtcaacagtccacacacatatcaatgaggtgatgaaatgcctgtagcctgatacattattacatggccaggcgtgaggcatcaattgataacctttgaatacagggggccaacttgtacttccttccatttgcaagtaattttatgcaatctcttcaacgcacaggagagctagggaagctcaacagttacatcatcttggttagtattctcatatgtacagagccactacattcttcttgtgcacacggaagcgagtggcttcaaactaccctaccatgtcaggatatagtcatcccttttcacatttcctttgtttcttggaacctttcttgtgatctttgcttctgtcatcaacaccgaggcattgctctcggatcttgatcgtgtggtgtcagtagatcggcacaaggcgtggttgcgtgtgcagccatgcagaatcggtgtcagtatcctcctcttctgcttcctcctcgtcgttgtcattgtccgatgaagacatataggtttcctggttttcctgcagtgttaaatgatctagacccgagagttatgcatcagaaaatagtgtaggctcttctacatatatgcaggggactctgtgctgtgttaagtgatattagcatgctattgctggcatcagtattgc

SEQ ID NO: 777 - DNA, 1218 bp, Secale cereale
gacccggagatgttcccgacgcggatgctggggaccggggtctggggcgggccccccgcgcggctggaggagggggaggggaggcccccgggccgcccggcgagatggcgtcggacgacgaccggtccgtggcggccgactcctggtccatcaagagcgactacggcagcaccctcgacgacgagcagcgctacgccgacaccgccgaggtgctcctcgcctcctgcccctcctcggcctcctcctccgcggcctccgccgccgcgccctccgcctgctcctcctccctcagcgcccaccactcctccgacttcagctttgacaaggatgtgcccgacgtcgtgccgccgatgctgggcctgcacaattaccaggacggcgcgtacgccgaagacctggctaattaccatgaacgcagccacgcggatgactggtttggcaccgaggccatggatgtccttgtaggctggacgaaaaacttatgctccagcaaggatttgcccggatgcagcgtacttgacatcggaactgggagcggacgactcttacagcagcttgcaaaacaagggttttctgatctaactggcattgactatagtgaagccgcaattgagcttgctcgaaacctcgcaattcgtgatggatttgagcacattaatttcctggttgatgatgtcctggagtcaaagttggagaggagatttgaacttgtgatggatgaaggaactctggatgcaatagggctccaccctgatggacctgtaaagagaatgatgtattggcagtcagtggctagcttggtttcccctggtggcatactggtcatcacatcctgcagcaggaccaaggatgagctggtgcaggaggtggagaacttcaaccagagaaagctgggcgccacgatccctgaaggagcgttggccagcgatgccgtggtgttcaagtacctcgaccgtgtccaagcttacccaaacgtcgatggtgtttgcatcgccacagtcgctttcctgcatacatgaaacatatgtatatttatccctgcccccctttccgcccctaacttatcagacctgtgagtaacaatgtaccccaggacagctgctcttctatggatgataattttaccttgtcggatacgttattcgctagtgtggtgctttgttatggctgggtataccgcattactgtactgtttgaaccttgaaagcttgtcaagca

SEQ ID NO: 778 - DNA, 1405 bp, Setaria italica
ctccaagtacccgcgccatcccaacgaaccgggacaccgacacgtaggccaatccctccgcggacccacctgtcatctccgagccgcttcgcatccctcgtcccccttcctcccggcacaaccagcacacgccatcgtcgcgggaaggctagggttccggcgaggccacggcgagcgccatggcggggattcggtggccgccggaggacccggagatcttcccgtcccggatggtcggcagcggcgtttgggttcccgtcgggcccccgggcgagatggcgtcggacgacgaccggtcggtggccgcggactcgtggtcgatcaagagcgactacggcagcaccctcgacgacgagcagcgctacgccgacaccgccgaagtcctcctcgcctcgtcatcggcttccgccgcggccgcgccctccgcgtcggtcgccgccaacccctcctccgacttcagcttcgacaaggatgtccctgactccggcgacgtggagcctccgttgctggccatgcagaattttcaggatggtgcttatgctgaagatcttgctaatttccacgaacgcagccacgctgatgactggtttggcactgaggtcatggatgtccgtgtaggctggaccaaaaatttgtgctcgagcaaggatttgcccagctgcagtgtacttgacatcgggactgggagtggcagactcttgcaacagctcgcaaagcaagggttttctgatctgactgggattgactatagtgaaggcgcaattgagcttgcacgaaatcttgcaattcgtgatggttttgagcacattaatttcttggttgatgatgtattggagtcaaaggtggagagaagatttgaacttgtcatggatgaagggactcttgatgcaattgggctccatcctgatggacctgtgaagaggatgatgtactggcagtcagttgctagcttggtttcccctggtggtatattggtcatcacatcatgcagcagaaccaaggatgagttggtacaggaggtggagaacttcaaccaaagaaagctcggtgctatgggctcagagggattgccagccagtgacactgcggtgttcagctacctcgaccacgttcgaagttaccctaatgtggatagttcttgcatcacgaccgttgctttcctgcataagtgaaacatacatgtatgtttggtttgttgccccccagaaagttattataccttttactatattaactgtgtacccaaatcactgatgtatctggatgacattttagtattttactgtcggattggttcttcaaaatttagatgttatgttgttttggtattgccggatgcctggatttcattttggtattgttctccttgaaagcgtgtcaagcaactgatgcaatccgacgtacg

SEQ ID NO: 779 - DNA, 1543 bp, Sorghum bicolor
ctcccagtacccccgtgccaatcccaacgaaccgagacaccgacacgtaggccaacctctccgctgacccacctgtcatcaccgagccgcctcgcatccgtcgttcccctcctcccggcacaaccccaacccagcacgcgagcgagcggcacgagaagggctagggttccggcgaggcgacggcgagcgccatggcggggattcggtggccgccggaggacccggagatcttcccttctcgcatggtcagcggcggggcctggatccccgtcgcgcccccgggagagatggcgtcggacgacgaccggtcggtggccgcggactcgtggtcgatcaagagcgactacggcagcaccctcgacgacgatcagcgctacgcagacaccgccgaggtcctcctcgcctcctcctccgcctcctccgcggccgcgccctccgcgtcggttgccgtccacccctcctccgacttcagcttcgacaaggatgtccctgactccagtgacgttgagcctcggttgctggggttgcagaattttcaggatggtgcttatgctgaggatcttgcaaatttccatgaacgcagccacgctgatgactggtttggcactgagatcatggatatccgtgtaggttggaccaaaaatttgtgctcaagcagggatttacccagctgcagcgtacttgacattgggactgggagtggcagactcttgcagcagcttgcgaagcaggggttttctgatctgactgggattgactacagtgaaggcgcgattgagcttgctcggaacctagcaattcgtgatgggtttgagcacattaatttcttggttgatgatgtattagagtcgaagctggagagaagatttgaacttgtaatggatgaagggactcttgatgcaattgggctccatcctgatggacctgtgaagagaatgatgtattggcagtcagttgctagcttggttttccctggtggtatattggtcatcacatcatgcagcagaaccaaggatgagctggtgcaggaggtagagaacttcaaccaaaggaagcttggtgctatgggctcagaaggattgccagctagtgaagctgcggtgttcagctacctcgaccacgtccaaagttatcctagtgtggatagttcttgcatcacgaccgttgctttcctgcataagtgaatgaaacacaaatgtatgtttggtttgttgggcctagaaagttaccatacctgctacgatattaactatgtatccaaatcactggtgtatctggataatgttttagtactttaccttgttgggttggttcatcagcgctcagatgttactatatgttgttttggtattgctggatcctggatttcactttggtatactctttgaaagcatgtcaaggaactgacgcaatcaagacatgcggatattttaaagcgtggaaaccgggtacatatctgaccagaaacacaagctgcttgttagcacgtatcctggcagatgactcacattacctgtctcgagttcttgcaatacgaagggca

SEQ ID NO: 780 - DNA, 1350 bp, Pennisetum glaucum
atcttcccgcggacccacctgtcatcgccgagccgcctcgcatccctcgtcccccttcctcccggcacaaccagcacacgccagcgtcgcgggaaggctagggttccggcgaggcgacggcgagcgaccatggcggggattcggtggccgccggaggacccggagatcttcccgtccaggatggtcggcagcggcgtttgggtccccgtcgggcccccgggcgagatggcgtcggacgacgaccggtccgtggccgcggactcgtggtcgatcaagagcgactacggcagcaccctcgacgacgagcagcgctacgccgacaccgccgaggtcctcctcgcctcgtcctccgcttccgccgcggccgcgccctccgcgtcggtcgccgtcaacccctcctccgacttcagcttcgacaaggatgtctctgactccggcgacgtggagcctccgttgctagtgatgcagaatttccaggatggtgcttatgctgaagatcttactaatttccatgaacgcagccacgctgatgactggtttggcactgaggttatggatgtccgtgtaggatggaccaaaaatttgtgctcaagcaaggatttgcccagctgcagtgtacttgacattgggactgggagtggcagactcttgcaacagctcgcgaagcaagggttttctgatctgactgggattgactatagtgaaggcgcaattgagcttgcacgaaatcttgcaattcgtgatggttttgagcacattaatttcttggttgatgatgtattggagtcaaagttggagagaagatttgaacttgtcatggatgaagggactcttgatgcaattgggctccatcctgatggacctgtgaagaggatgatgtattggcaatcagttgctagcttggtttcccctggtggtatattggtcatcacatcaagtagcagaaccaaggatgagttggtacaggaggtggagaacttcaaccaaagaaagcttggtgctataggcccggagggattgccagccagtgatgctgcggtgttcagctacctcgaccacgtccgaagctaccctagtgtggatagttcttgcatcacaaccgttgctttcctgcataagtgaaatatacatgtatgcctggtttgttgcccccagaaagttataatacctgttaccatattaaccgtgtacccaaatcactgatgtatctggatgacattttagtattttacttgttggattggttcttaagagtttagacgttatgttgttttggtattgtcagatgcctgtatatcactttggaattgttctcgttgaaagcgtgtcaagcaagagatgcaatccgac

SEQ ID NO: 781 - DNA, 1427 bp, Panicum virgatum
caagtagccgcgccatcccaacgaaccgggacaccgacacgtaggccaatatctccgcggacccacctgtcacctccaagccgcctcgcgtccttcgtccccgtcctcccggcacaaccaggccagcacgccaccgtcacgagaaggctagggttccggcgaggcgacggcgagcgccatggcggggattcggtggccgccggaggacccggagatcttcccgtcccggatgctcggcagcggcgtttgggtacccgtcgggcccccgggcgagatggcgtcggacgacgaccggtcggtggccgcggactcgtggtcgatcaagagcgactacggcagcaccctcgatgacgagcagcgctacgccgacaccgccgaagtcctcctcgcctcgtcctccgcctccgccgcggccgcgccgtccgcgtcggtcgccgccaacccctcctccgacttcagcttcgacaaggatgtccctgactccagcgacgtggagcctccgttgctggttatgcagaatttccaggatggtgcttattctgaggatcttgctaatttccatgaacgcagccacgctgatgtctggtttggcactgaggtcatggatatccgtgtaggctggaccaaaaatttgtgctcaagcaaggatttgcccagctgcagcgtacttgacatcgggaccggaagtggtaggctcttgcagcagcttgcaaagcaagggttttctgatctgactgggattgactatagtgaagatgcgattgagcttgcacgaaatcttgcaattcgtgacgggtttgagcacattaatttcttggttgatgatgtattagagtcaaagttggagagaagatttgaacttgtcatggatgaagggactcttgatgcaatagggctccatcctgatggacctgtgaagagaatgatgtattggcaatcagttgctagcttggtttcccctggtggtatattggtcatcacatcgtgcagcagaagcaaggatgagttggtgcaggaggtggagaacttcaaccaaagaaagcttggtgctatgggctcaggagtgccagtcattgatgctgcggtgttcagctaccttgaccatgttcagagttaccctagtgtggatagttcttccatcacgaccgttgctttcctgcataagtgaaacatacatgtatgcctgattgcctgggttattgcccccagaaagttatcgtacctgttactatattaactatgtacccaaatcactgatgtatctggatggcattttagtattttactgttggattggttctttggagttcagacgttgtgctgttttggtattgatgcctggattgttctctaaatcactttggtattgttctcctccctggaagcgcgtccagatgcgatccaacatacaaatgtttcagtgcgtg

SEQ ID NO: 782 - DNA, 1345 bp, Zea mays
cttgctcccagtaccccccgtgccaccccaacgaagcgagacaccaacacgtaggccaacccctccgctgagtcgctgaccgcctcgcacccgtcgttcccctccttccggcacaaccagcacgcgagcggcacgagaagactagggttacggcgaggcgacggcgagagccatggcagggattcggtggccgccagaggacccggagatcttcccttccaggatggtcagcggcggggcttgggtccccgtcgcgcccccaggagagatggcgtcggacgacgaccggtcggtggccgcggactcgtggtcgatcaagagcgactacggcagcaccctcgacgacgatcagcgttactccgacaccgccgaggtcctcctagcctcctcctccgcctcctctgttgccgcgccctccacgacggttgccgtccacccctcctccgacttcagcttcgacaaggatgtccatgactccagctacgttgaacctcccttgctgggcttgcagaattttcaggatggtgcttacgctgaggatcttgcaaatttccatgaacgcagccacgctgatgactggtttggcactgatatcatggatatccgcgtaggttggaccaaaaatttgtgctcaagtagagatttacccagctgcagcgtacttgacattgggactgggagtggcagactcttgcagcagcttgcgaagcaggggttttctgatctgactgggattgactatagtgaaagtgcaattgagcttgctcgtagccttgcaatcggtgatgggtttgagcacattaatttcttggttgatgatgttttggagtcgaagttggagagaagatttgaacttgtcatggatgaagggactcttgatgcgattgggctccatcctgatggacctgtgaagagaatgatgtattggcagtccgttgatagcttggtttcccgtggtggtatattggtcatcacatcatgcagcagaaccaaggatgagttggtgcaggaggtagagaacttcaaccaaaggaagcttggtgctgtgggctcaggctcagaaggattgccggccagtgaagctgcggtgttcagctacctggaccacgtccaaagttaccctagtgtggatagttcttgcataacgaccgttgctttacttcataagtgaaaaacataattgtattgtatgcttggtttattggccctagaaagttaccgtatacctgctacgatattaactatgtacccagtcacttgtgtatctggacaatattctactagtattttaccttgtcgggttggtattgctggatcctggattccactttggcatgctctttga

SEQ ID NO: 783 - DNA, 1461 bp, Triticum aestivum
cgcgcgccttatctgcccatggtctggtgcgctggtaaatctcagcacagtcgagtcgatgcaccaaaccatgggcagataaggcgcgcgccactcccaccacacgcagggcgtccaagaaaaaccccatcgtcgggcatggggacagcagtgctgcccgtcgcccacaagctctcgctcgcctcccccttcctcccgcgccaccgccgggcctgccgtccccccgcccagcagcactgccggcgccggcgccatggggcggtggtggcgtacatggagccggacccgaactcgccggcggccatcctgggccgcatcgtcggggccctccccgtggtgggcctcgtggcgcgcatcctgagcgacgacggcggcgtcggcggcgacaccgtcgacttcgccgagttccgccgccgcgtcagcaagaagtgcaccgtcatggactcccaggccttctacgacttcaacgaccgccgcggcaaggtgggagaccccttctacgtcctgctctgctgctggctggccgccattggcgccgggctgctgaaaacggaggagatcctggaaggcgtggcccggctccgcatgtccaacgacatcgagtacgaggaggagaccttcctcgacatgatgaagattgcaagggagaaacgggccaagtcgaagagccaggcgccggtgataccgatggaggcgcgggcggagaaggcgctggaggccatctacgtgtgctgcttcgggcaggacatggtggagccggaggacgagcggctgctgtgcaccatgctgaacgcggtgttcccgtcggtggggaggccggcggtggagaggatggtgtccaccgtggccaagcaggtggcctccggcgagaggaggggccccggcgccaaggtggtgcccaaggaggtggcgcagcggcagctcaaggacctcgagttcctcaagcagaacaagctggactcgatatgattaagggctcatttttggcaggtagatccatggagaaatgagatgagaatgaattttgatgtagccacggtgcgtaggaggaaccagctgccatcgatcatactgctgcaagcaacgccatttacaaggtcgagtccgtggctgctatctcccttattgcagcgttcttgcagtgtgacatgagtgccactagcacatcagaagcttgtaagatagcgcgagatttggctcgtgctccttgaaaagaatgttaccggttgtggcacattctcgattactaatgcatgttaatgatggcatttgtaatttgtcactagcaattatgtttgctcagacagaaaaggtagaaaatcattgctaaattagttatatgtggcatgcacatttgtgcttgaatttttacatgatgttgtgcttggtagtattattattatagaattacttagaattgaacataatgttgatttaaacaatggttactagtaataaacg

SEQ ID NO: 784 - DNA, 1230 bp, Triticum aestivum
atctcagcacagtcgagtcgatgcaccaaaccatgggcagataaggcgcgcgccactcccaccacacgcagggcgtccaagaaaaaccccatcgtcgggcatggggacagcagtgctgcccgtcgcccacaagctctcgctcgcctcccccttcctcccgtgccaccggcggccctgccgtccccccgcccagcagcactgccggcgccggcgccatggggcggtggtggcctacatggagccggacccgaactcgccggcggccatcctgggccgcatcgtcggggccctccccgtggtgggcctggtggcgcgcatcctgagcgacgacggcggcgtcggcggcgacaccgtcgacttcgccgagttccgccgccgcgtcagcaagaagtgcaccgtcatggactcccaggccttctacgacttcaacgaccgccgcggcaaggtgggagaccccttctacgtcctgctctgctgctggctggccgccattggcgccgggctgctgaaaacggaggagatcctggaaggcgtggcccggctccgcatgtccaacgacatcgagtacgaggaggagaccttcctcgacatgatgaagattgcaagggagaaacgggccaagtcgaagagccaggcgccggtgataccgatggaggcgcgggcggagaaggcgctggaggccatctacgtgtgctgcttcgggcaggacatggtggagccggaggacgagcggctgctgtgcaccatgctgaacgcggtgttcccgtcggtggggaggccggcggtggagaggatggtgtccaccgtggccaaggaggtggcctccggcgagaggaggggccccggcgccaaggtggtgcccaaggaggtggcgcagcggcagctcaaggacctcgagttcctcaagcagaacaagctggactcgatatgaggaggggaacgtcatttttggcaggtagatccacggaggaatgagaatgaattttgatgtagccacggtacgtaggaggaaccagctgccatcgatcatactgctgcaagcaacgcgatttacacggtcgagtccgtgcctgctatgtgctatctcccctattgcggtgttcttgcagtgtgatatgagtggcactagcacatcagaatcttcaatcttgtaagatggcacaagatttgactcgtgctccttaaaaagaatgttaccagctgtgacacattctcgattacatgttaatg

SEQ ID NO: 785 - DNA, 950 bp, Pseudoroegneria spicata
ggggacaacagtgctgcccgtcgcccacaagctctcgctcgcctcccccttcctcccgcgccaccgtccccccgcccagcggcactgccggcgccggcgccatggggcggtggtggcgtacatggagccggaccccaactcgccggcggccatcctggggcgcatcgtcggggccctccccgtggtgggcctcgtggcccgcatcctgagcgacgacggcggcgtcggcggcgacacggtcgacttcgccgagttccgccgccgcgtcagcaagaagtgcaccgtcatggactcccaggccttctacgacttcaacgaccgccgcggcaaggtgggagaccccttctacgttctgctgtgctgctggctggccgccattggcgccgggctgctgaaaacagaggagatcctggaaggcgtggcccggctccgcatgtccaacgacatcgagtacgaggaggagaccttcctcgacatgatgaagatagcaagggagaaacgggccaagtcgaagagccaggcgccggtgataccgatggaggcgcgggcggagaaggcgctggaggccatctacgtgtgctgcttcgggcaggacatggtggagccggaggacgagaggctgctgtgcaccatgctgaacgcggtgttcccgtcggtggggaggccggcggtggagaggatggtgtccaccatggccaagcaggtggcctccggcgagaggaggggccccggcgccaaggtggtgcccaaggaggtggcgcagcggcagctcaaggacctcgagttcctcaagcagaacaagctggactcgatatgaggaggggctcatttttggcaggtagatccatggaggaatgagaagagagtgaactttgatgtagccacggtacgtaggaggaaccagctgccattgtaggattgcaagcaacacaatttgcagggtcgagtca

SEQ ID NO: 786 - DNA, 1170 bp, Leymus cinereus x Leymus triticoides
  misc_feature (26)..(26): n is a, c, g, or t
  misc_feature (58)..(58): n is a, c, g, or t
  misc_feature (104)..(104): n is a, c, g, or t
  misc_feature (107)..(108): n is a, c, g, or t
  misc_feature (122)..(122): n is a, c, g, or t
  misc_feature (125)..(125): n is a, c, g, or t
  misc_feature (131)..(131): n is a, c, g, or t
  misc_feature (146)..(147): n is a, c, g, or t
  misc_feature (239)..(239): n is a, c, g, or t
  misc_feature (245)..(245): n is a, c, g, or t
  misc_feature (275)..(275): n is a, c, g, or t
  misc_feature (305)..(305): n is a, c, g, or t
  misc_feature (347)..(347): n is a, c, g, or t
  misc_feature (402)..(402): n is a, c, g, or t
  misc_feature (440)..(440): n is a, c, g, or t
  misc_feature (470)..(470): n is a, c, g, or t
  misc_feature (532)..(532): n is a, c, g, or t
  misc_feature (536)..(536): n is a, c, g, or t
  misc_feature (551)..(551): n is a, c, g, or t
  misc_feature (622)..(622): n is a, c, g, or t
  misc_feature (644)..(644): n is a, c, g, or t
  misc_feature (664)..(664): n is a, c, g, or t
  misc_feature (671)..(671): n is a, c, g, or t
  misc_feature (810)..(810): n is a, c, g, or t
  misc_feature (870)..(870): n is a, c, g, or t
  misc_feature (885)..(885): n is a, c, g, or t
  misc_feature (896)..(896): n is a, c, g, or t
  misc_feature (908)..(908): n is a, c, g, or t
  misc_feature (938)..(938): n is a, c, g, or t
  misc_feature (941)..(941): n is a, c, g, or t
  misc_feature (943)..(943): n is a, c, g, or t
  misc_feature (954)..(954): n is a, c, g, or t
  misc_feature (964)..(964): n is a, c, g, or t
  misc_feature (978)..(978): n is a, c, g, or t
  misc_feature (981)..(981): n is a, c, g, or t
  misc_feature (1015)..(1016): n is a, c, g, or t
  misc_feature (1018)..(1018): n is a, c, g, or t
  misc_feature (1025)..(1025): n is a, c, g, or t
  misc_feature (1029)..(1029): n is a, c, g, or t
  misc_feature (1050)..(1051): n is a, c, g, or t
  misc_feature (1067)..(1067): n is a, c, g, or t
  misc_feature (1070)..(1070): n is a, c, g, or t
  misc_feature (1077)..(1077): n is a, c, g, or t
  misc_feature (1099)..(1099): n is a, c, g, or t
  misc_feature (1102)..(1105): n is a, c, g, or t
  misc_feature (1110)..(1110): n is a, c, g, or t
  misc_feature (1120)..(1120): n is a, c, g, or t
  misc_feature (1122)..(1122): n is a, c, g, or t
  misc_feature (1156)..(1156): n is a, c, g, or t
acgcagggcgtccaagaaaaaccccntcgatgggcatggggacaacagtgctgcccgncgcccacaagctctcgctcgcctcccccttcctcccgcgccaccgncgnncctgccgctccccngcncagcantgccggcgccggcgnnatggggcggtggtggcgtacatggagccggacccgaactcgccggcggccatcctggggcgcatcgtcggggccctccccgtggtgggcctngtggcncgcatcctgagcgacgacggcggcgtcggnggcgacaccgtcgacttcgccgagttccgncgccgcgtcagcaagaagtgcaccgtcatggactcccaggcnttctacgacttcaacgaccgccgcggcaaggtaggagaccccttctacgttctgntgtgctgctggctggccgccattggcgccgggctgctnaaaacagaggagatcctggaaggcgtggcncggctccgcatgtccaacgacatcgagtacgaggaggagaccttcctcgacatgatgaaganggcnagggagaaacgggcnaagtcgaagagccaggcgccggtgataccgatggaggtgcgggcggagaaggccctggaggccatctacgngtgctgcttcgggcaggacatngtggagccggaggacgagangctgctntgcacgatgctgaacgcggtgttcccgtcggtggggaggccggcggtggagaggatggtgtccaccatggccaagcaggtggcctccggcgagaggaggggccccggcgccaaggtcgtgcccaaggaggtggcgcagnggcagctcaaggacctcgagttcctcaagcagaacaagctggactcgatatgaggagggnctcatttttggcagntagatccatgnagaaatgagaangaattttgatgtagccacggtacgtaggangancnagctgccattntaggattgcnagcaacacaatttncanggtcgagtcaatgcttgctatcactctccttatnngnagtgttnttgnagtgtgatatgagtggcactnncacatcagaagcttgnaanatagtanaagatttgactcgtgctccttnaannnnatgtnaccagctgtnanacattctcgattacatgttaatgatagtatttgntacggtttttgcta

SEQ ID NO: 787 - DNA, 1311 bp, Secale cereale
tcagttcctaccacacgcagggtgtccaagaaaaaccccatcgtcgggcatggggacaacagtgctgcccgtcccccaccagctctcgctcgcctcccctcctcccgcgccaccgccgggccagccgctccccgcccagcagcactgccggcgccggcgccatggggcggtggtggcgtacatggagccggacccgaactcgccggcggccatcctggggcgcatcgtcggggccctccccgtggttggcctcgtggcgcgcatcctgagcgacgacggcggcgtcggcggcgacaccgtcgacttcgccgagttccgccgccgcgtcagcaagaagtgcaccgtcatggactcccaggccttctacgacttcaacgaccgccgcggcaaggtgggggaccccttctacgttctgctgtgctgctggctggccgccattggcgccgggctgctgaaaacagaggagatcctggaaggcgtggcccggctccgcatgtccaacgacatcgagtacgaggaggagaccttcctcgacatgatgaagatagcaagggagaaacgggccaagtcgaagagccaggcgccggtgataccgatggaggcgcgggcggagaaggcgctggaggccatctacgtgtgctgcttcgggcaggagatggtggagccggaggacgagaggctgctgtgcaccatgctcaacgcggtgttcccgtcggtggggaggccggcggtggagaggatggtgtccaccatggccaagcaggtggcctccggcgagaggaggggccccgacgccaaggtggtgcccaaggacgtggcgcagcggcagctcaaggacctcgagttcctcaagcagaacaagctggactcgatatgaggaggggggaacgtcatttttggcaggtagatccatggaggaatgagaatgaattttgatgtagccacggtacgtaggatgaaccagccgccatcgatcatactgctgcaagcaacacaatttacacggtcgagtccgtgcccgttatctcctcattgcagtgtgatatgagtggcacgagcacatcagaagcttggtaagatatagctcaagatttgactcgtgctccttgaaaagatgctaccagctgtgacacattcctgattacatgttaatggtagcatttgtaatttgtcactagcaattatgtttgctcggacacaaaaggtagaaaatcattgctaaattagctacatgtggcatgcacatttgcgcatgaagttttacataatgttgtgcttggtaatattatttatacgaattacctgaaagtc

SEQ ID NO: 788 - DNA, 1216 bp, Avena sativa
gaaaactcggcaaaagcgagtccatgagcagataaggcgcgcgccactcccaccacacgcagggcgtccaagaaaacccatcaatgggcatggggacactgcccgtcgcccacaagctctcgctcgcgtcccccttcctcccgcgccaccggcgggcctgccgctcccccgcccagcactgccggcgccggcggcatggagcggtggtggcgtacatggagccggacccgaactcgccggcggccatcctgggtcgcatcgtcggggccctccccgtggtgggcctcgtggcgcgcatcctgagcgacgacggcggcgtcggcggcgacaccgtcgacttcgccgagttccggcgccgcgtcagcaagaagtgcaccgtcatggactcccaggccttctacgacttcaacgaccgccgcggcaaggtcggcgaccctttctacgtcctgctgtgttgctggctggccgccattggtgccgggctgctgaaatcagaggagatcttggaaggcgtggcccggcttcgcatgtccaacgacatcgagtacgaggaggagacattcctcgacatgatgaagctggctagggagaaacgggcaaagtcgaagggccaagctccgcaggtacccatggaggtgcgcgcggagaaggccctggaggccatctacgtgtgctgcttcgggcaggacatggtggagccggaggacgaggagctcctgtgcacgatccttaacgcggtgttcccgtcggtggggaggccggcggtggagaggatggtgtctactttagccgaccaggtggccaccggcgagaggagggggcccgacgccaaggtcgtgtccaaggaagtggcgcagcggcagctcaaggacctcgagttcctgaagcagaacaagctcgactccatatgatcaggggaacatttttggcaggtagatcggtggcgttattttttgcagttcgaggaacagatggagcagtcagaatgaattttgatgtaggcgcggtaggaggaaaccagccatcatacaattgcaacaaagtttaacatagtatttgcacaatcgagccaatgctttatttgctatgagtggcatccgagtcttgtaagatagaatatgtgacatgtgagtgtgaattgtgcaacttgaaaagaatgttgcaatcgagttggggcacattctgtgttacatgttaatgaagtactagtaaattt

SEQ ID NO: 789 - DNA, 1265 bp, Brachypodium distachyon
agcagataaggcgcgcgccactcccaccacacgcagacgcaggcgtccaaggaaaaccccatcgatgggcatggggacactagccgtcgcccacaagctctcgctcacctccgccttcctcccgcgccaccgtcggccctgccgctcctcctcttcatccgcccagcacccccgtcgccggcgccatggcgcggtggtggcgtacatggagccggacccgaactcgccggcggccatcctgggccgcatcgtgggggccctccccgtggtgggcctcgtggcgcgcatcctgaccgacgacggcggcgtcggcggcgacaccgtggacttcgccgagttccgccgccgcgtcagcaagaagtgcaccgtcatggactcccaggccttctacgacttcaacgaccgccgcggcaaggtaggagatcctttctacgttctgctctgctgctggctggccgccgtcggcgccgggctgctgaaaacagaggagatcctggaaggcgtggcgcgtctccgcatgtccagcgacatcgagtacgaggaggagaccttcctcgacatgatgaagatcgcaagggagaaacgagcgaaatcgaaggggcaagcgccgcagatacccatggaggtgcgggcggagaaggccctggaggccatctacgtgtgctgcttcgggcaggacatggtggaaccggaggacgagaagctcctgtgcacgatgctgaacgcggtgttcccgtcggtggggaggccggcggtggagaggatggtatccgccatggcgaagcaagtggcggatggcgagaggttggtgtccgccaaggtcgtgtccaaggaggtggtgcagcggcagctcaaggatctggagttcctgcagcagaacaagctggactcgatatgagacggcggacatttttgtcagatagatcaatcgaccgatggtgtgttattcagtctgaggaacagatggatggagaatgagtttcaactaggcgtggtaggaggataagatgccagccattatacgtgcgttgctgcaatttgcacactggaaacaatattcttgatgtaattctcctcggctccttctggtgtcgcagtgtgatgtgcgttatcagacgatgagacgagttaggaataacaatgttttagcttcagttttctaggttcttattcaaatactatcataagattcttatgtacccagtactcaaaattataaaagcctaatcaataggacatggcgagtcggcgaccttcggctcgaa

SEQ ID NO: 790 - DNA, 1291 bp, Setaria italica
tcagcagcaaggtgattttcaaatttcaagtttcaacaactccaatagatcaaaaaacaaaaaaaaaaaaccaactcttcgctgccttcccggacagcagcgagcagtgagcagtccatttgacaaggagataaggcgcgcgccaccacacacgcacagcggcatcccagtaagctccatcggcgggcatgggggcactacccgtcgcccacaagctcgctctcacctcccccttcctcccgcgccaccgccgaccctgccccgccgcccaccaccacgggcagcgccggcggcgacatggagtggtggtggcgtacatggagccgaaccccaattcgccggcggccatcgcggggcgcctcgtcggggcgctccccgtggtgggcctcgttgcgcgcatcctgagtgacgagggcggcgtcggcggcgacatcatcgacttcgccgagttccgccgccgcgtcagcaagaagtgcaccgtcatggactcccaggccttctacgacttcaacgagcgccgcggcaagccgggggatcccttctacgtcctgctgtgctgctggctcgccgccgtcggcgccgggctactcaagacagaggagatcttggaaggcgtggcgcggctccgcatttccaacgacatcgagttcgaggaggagaccttcattgacatgatcaggacggcaaaggagaaacgagcaaagctgaaggctccagctccgcagataccgatggaaacgcgggcggagaaggcccttgaagccatctacgtctgctgcttcgggcaggacatggttgaggaagaggacgagaagcttctccgcacgatactgaacgctgtcttcccctccgtcgggaggccggcgatcgagaggatggtggcgtccatggccaagcaggtggcctccggcgagaggaagcgggacgggaggaccgtgtccaaggaagttcagcagcggcagctcaaggacctacagtttctcaaacagaacaagctggactctgcatgagccatcgagcgtgtttggccgtggtttacttactcaggtatttgagttccgtagttgtagggagacgaggaacaagtcagatgcaatttggtttttaccataagtgtgctaggaggaatcagccatgatagcttgcaatgcaaagatatcgaatgtaattaggacggcaagcgcggttcatagagtcagcacagggaagcagagtaaaagtacaattttgaaacgaaccagggcagtagggttgccgattatattaaaaggaatatgacgttgagactgag

SEQ ID NO: 791 - DNA, 1302 bp, Oryza sativa
aactagccaagccacccccaaagtccaagcttggcttcagtcaagcaggcgcatgagcagataaggcgcgcgccacgtccaccacacacaatggggacgttacccgtcgcccacaggttctcgctcgcctcggccttcctgccgcgccaccgccggccatcgccgtccgcccccaaccggcgccggcggcatggaacggtggtggcgtacatggagccgaaccccaactcgccgtcctccatcgcgggccgcctcatcggggctctccccgtggtgggcctcgtggcgcgcatcctgagcgacgagggtggcgtcggcggcgacatgatcgacttcgccgagttccgccgccgcgtcagcaagaagtgcaccgtcatggactcccaggccttctacgatttcaacgaacgccgcggcaaggcaggagatcccttctacgttctgctgtgctgctggctggccgccgttggtggcgggctgctgaaaacggaggagatcttggaaggcgtcgcgcggctccgcctctccaacgacatcgagttcgaggaggagacgttcctcgacatgatgaagacggcaaaggagaaaagagcaaagctgaaggctccggcgccacagataccaatggaagcgcgggcggagaaggccctggaggccatctacgtgtgctgcttcgggcaggacatggtggaagacgtggacgtgaagctgctgtgcaaaatgctgaacgccgtcttcccctccgtcgggaggcaggcggtcgagaggatagtgacctccatggcgaagcaggtggctgccggcgagaggaagggccccggcgtcaagaccgtgtccaaggaagcagcgcagcggcaactcaaggacctggaatttctcaagcagaacaagttggattcggcatgagcattgtgcagaacacattgggaaattttgtcagatagacgtcgtttttaggccaagaaacagaaattgcatggcttacttggccgtgtttgtcatagaccgagttttctcctaagatgtgctaggaaggtcagctatcgtagggaaatagaaatcagcatagattgcaagtttgcgacacagttgacgcaggccaaacaatggtctcggttcattagaattgcaatgtgagtgagctcagaaccttgtaagatgaagttgtacgttgtgacatgctcagaaaatgtctactgctacagtactttttaatgctacatgtgtttactaagaataaaaatgtaacagacgtggcatcgtttaagatggcaaaaccaacaggttcattactttctacta

SEQ ID NO: 792 - DNA, 1761 bp, Panicum virgatum
ctagttgttgctacttggcatcctgggctagctggaatcgatgggccgtcctagggaaccggaggcccacgccacagcaggagtgtccttgcccactaagagaaattaggctgggcccacgaggcgcgccatctgcctaggctctccggcccgctcctccaattcgacacaggcttggagtccacgcgacgagataaggcgcgcgccgcgccacgccacgcccaccacacgcgcagcggcatccgagcgagctcgctccatcgacggcgggcatgggggcactacccgtcgcccacgggcatctcgctctcacctcccccttcctcccgcgcccgcgccgcggccggcccggccccgcgtcccacggccccgggcgccggcggcggcatgcggcggcggtggtggcgtacatggagccgaacccgaactcgccggcggccatcgcggggcgcctcgtcggcgcgctccccgtggtgggcctcgtggcgcgcatcctcagcgacgagggcggcgtcggcggcgacatcatcgacttcgccgagttccgccgccgcgtcagcaagaagtgcaccgtcatggactcccaggccttctacgacttcaacgagcgccgcggcaagccgggagatcccttctacgtcctgctgtgctgctggctggccgccgtcggcgccgggctgctcaagacggaggagatcttggaaggcgtggcgcggctccgcatttccaacgacatcgagtatgaggaggagaccttcatcgatatgatgagggcggcaaaggagaaacgagcaaagctcaaggctccagctccgcagatacccatggagacgcgggcggagaaggccctggaagccatctacgtctgctgcttcgggcaggacatggtcgagcaagaggacgagaagctcctccgcaccatactcaacgcggtcttccagtccgtcgggaggcctgcgatcgagaggatggtggcgtccatggccaagcaggtggcctccggcgagaggaagcgggacgggaagaccgtgtccaaggaagttcagcagcggcagctcaaggacctagagtttctgaaacagaataagctggactcgtcatgagcatcgagcagcagaattttttttgtcatagaagacagtgtagtccagcatcacaaattacacggcgtgtttaatttggccgtagttgagtcaggtgtcgacgaagttcatagttgtaggaagacgagaacaaggtagatgcagtgtgttttttttttactacaggtgctaggaggaatcagctgcgacatgctgaataggaagcacaacacatgtagtaataaacagaattaaacgtgggtggggtatgacattccttgtaatgagactgataagcaccttttcagatgctcaacagtggttactccgggagatggttgcacagcctcattctgggattcaacgtggtctgatggggttgctcctcgggatctagctccacatctttacaagctggcttggcgcaagagtttaactgtcagagaggaggtggaaaatcgaacctggactcggggtttatggaggatgtcaactgcagagatggctgaatttgttcttctgtgggaaagagtgcaggaggtcaccttctctgatcaagccgacacaatcacttggaaatggtctgcaaatgggttgtactcttccaagtcggcgtatgggatccaattcgtcgggtcttactgcaccttcaattctaaggctatctggaaggcaaagg

SEQ ID NO: 793 - DNA, 1663 bp, Brachypodium distachyon
ggaaaatcggaagaggcccccaaaccctcagctacttcctcctcctctagggtttcttcgtcctccccccgtcgtctcgacgagccgagcgaccatggccgccgccttttcctgcgacgcgccgggcccgcccgcgatgccggacctggtccgcgaccgcctctacttcggagacatcaacgacgccatcgcggctctcaccgggcccctcccggacggcaccgacatcacccacgtcctctcagtcgtcagctccgcctccatctccttcatcgccgactgccgcccgggcctctccatccccgccgaggaggtccgccgcgtggtcgccggggaggacggcgcgccgccctcggcggtggcccccgggcggctgatgcgggtcgtggagaaggccgggcaagggctgagggtgacgcggatggccgtgccgctcagggacaccgaggaggagaacctgctggatcacctcgagccctgccttgatttcattgacgaggggaggaaggagggcagtgtgctggtgcattgcttcgcgggggtctccaggagtgctaccattatcacggcatatctgatgagaacagagcagaaatctctggaagaagccctagaatctttgaaggaaattaatgaatctgtttgcccaaacgacggttttgttgaacagttgaaattgtttgaagaaatgggtttcaaggttgacacttcaagtcctttatacaagcgcttccgcttaaaattgttaggccagtcctacaaaattggagagaaaataggaagccatgtactggaagacgatccgggtgtttctcgacagcctaatcctagccaggaattgtcaaacatagagaccaataaaacagcataccgctgcaagaaatgcaggaggattgttgctgtgcaggataacgttattagtcacactcctggcgagggtaactctagcttcgagtggcatgacaaaaggaaaggtggtcacacatacaacaaggaaaaagattgctcttctctgtatgtcgagcctttgaagtggatgactccagtagaagatggtgctttggaagggaagctatcgtgcatccactgtggagcacgcctagggtacttcaactggtcgggaatccagtgcaactgtggcagctggatcacccctgcattccaaatttccaagagcaaagttgacataagcatcatctagatcttgcatattcgaggagtttgtcaggttcactaaataccatttcatcagaaccattgcgcactagatataaaaatgcaattgctagagcctgctacatatattcttacggccagcatacggtcatttgcaggtctttggttctgaattctgatggcaagaattgtaatctgaaatacttcaaaacaacttatgataggttgaacctgacaatgttaagcaagcaaagattaagattaaacgtgcacaactaatatatttttgctttctgggaaatacaagatgaactgtgacgatagcaactggaaaacgtattcatatgtttacttgatttacaaagaaacatattaccaagcagagtgatatgttgaattgtgaaatataattgtttgatccaccttttatctaaactgtttatttgagatctaatggttagaattggaagctttcaacttttcgttt

SEQ ID NO: 794 - DNA, 1205 bp, Brachypodium distachyon
atggaggaagctgctgttacctgctactccaaacctttgagaaacaatctccagccgaggttttttcctttctcggccctcaccgggcccctcccggacggcaccgacatcacccacgtcctctccgtcgtcagctccgcctccatctccttcatcgccgactgccgcccgggcctctccatccccgccgaggaggtccgccgcgtggtcgccggggaggacggcgcgccgccctcggcggtggcccccgggcggctgatgcgggtcgtggagaaggccgggcaagggctgagggtgacgcggatggccgtgccgctcagggacaccgaggaggagaacctgctggatcacctcgagccctgccttgatttcattgacgaggggaggaaggagggcagtgtgctggtgcattgcttcgcgggggtctccaggagtgctaccattatcacggcatatctgatgagaacagagcagaaatctctggaagaagcagtagagtctttgaaggaaattaatgagtctgtttgcccaaacgatggttttcttgatcaattgagattgtttgaagaaatgggtttcaaggttgacacttcaagtaatttatacaagcgcttccgcttaaaattgttaggccagtcctacaaaattggagagaaaataggaagccatgtactggaagacgaccccggtgttcctcaacagcctaatcctagccaggaattgtcaaacaaagagacccataaaacagcataccgctgcaagaaatgtaggaggattgttgctgcggaggacaatgttatcagccacactcctggggagggtaactctagcttcgagtggcacgacaaaaggaaaggcggtcacacatacaacaaagaaaaagattgctcttctctgtatgttgagcctctgaagtggatgactccagcagaagatggtgctttgcaagggaagctatcgtgcattcactgcggagcacggctaggatacttcaactggtcggggatccagtgcaactgcggcagctggatcacccctgcattccaaatttccaagagcaaagttgatataagcaccatctaaatcttttccagggttaacaaaattgtggtttttaccaggttcaggtgctgtaaatactatttcatcagaaaccgttgtgtgtgcactagatctcaattctcaagaatcaaaagctggagcct

SEQ ID NO: 795 - DNA, 1025 bp, Pseudoroegneria spicata
caccgatcggtcctcgtccccctcgctcgattctcggaggccagggagctagggcggcggcgcgcgtgcggattggattccttcccagtaccgtgagttcttcaaaaaaagaactgtttgcaacgcatagcatcctgattgctatggaaggtgggggactggaccaggtttgcatggctgccatgaccaaccaaccttcagtgtctgataacaagccgatgaagaacatcagtggggagatgcctgcaaccgcaactgctggaagcggctcctttgactgcaacatctgcctcgacttcgctgcagacccagttgttaccctctgtggccatctctactgctggccttgcatctacgagtggctgcggccgtcggtggtgtcagcttccggtgccaacagcacttcagcaaggcagcagtgccccgtgtgcaaggccgcactatctgtcgacagcctcgtgccgctctatggccgtggtggtagctcgaagaaatcactggatggcacggccattcctcgacggccaacggtgcaccgggagaatgttgcgcaccagcacgcacaaagcaacatcgatgatgaccggcatcaccacaacgtggagcccagccctccgctccggccactacggcatgcgcaccaccaccatcctggtgccaccgaattcgacttcgtctaccctccttcgccaatggggcgtggcctgatccactcgacggccggaggggtgcttggagggatggcggaggcggtgcttccgtgggcgttccgcggccaggtgccgccgagcatgtactacacaagcccttatgccgttgcggaccacaccttgggtccccggcttaggaggcagcagatggaggtggagaggtccctgcaccagatctggttcttcctctttgtgtttgtggtgttgtgtctgctcttgttctgaagcaaagactagaggctcttgttctgaactgaagaggcggtatacggcttgtgtatatattggaaggcatgatatactgcttctcgagga

SEQ ID NO: 796 - DNA, 1398 bp, Triticum aestivum
cgcagcgacgcaatctcaccgatcggtcctcgcccccctcgctcgatcctcggaggccagggaccgagggcggcggcgcgcgtgcggattggattccttccgagtaccgtgagttcttcgaccagaactgtttgcgacagatagcatcctgattgctatggaaggtgggggaatggaccaggtttgcatggctgccatgaccaaccaacctccagtgtccgataacaagccgatgaagaacatcagtggggagatgcctgcaaccgcgaccgctggaagcggctcctttgactgcaacatctgcctcgacttcgctgcagacccagttgttaccctctgtggccatctctactgctggccttgcatctacgagtggctgcgaccatcggtggtatcagcttccggtgccaacagcacttcagcaaggcagcagtgccctgtgtgcaaggccgcactatctgctgacagcctcgtgccgctctatggccgtggtggtagctcgaagaaatcactggatggcacggccattcctcgacggccaacggtgcaccgggagaatgttgcgcaccagcacgcgcaaagcagcatcgatgatgaccggcaccaccacaatgtggagcccagccctccgctccggccactgcggcatgcgcaccaccaccatcctggtgccaccgaattcgacttcgtctaccctccttcgccaatggggcgtggcctgatccactcgacggctggaggggtgcttggagggatggcggaggcggtgcttccgtgggcgttccgcggccaggtgccgccgagcatgtactacacaagcccctacgctgtcgcggaccacacggtgggtccccggctgaggaggcagcagatggaggtggagaggtccctgcaccagatctggttcttcctcttcgtgtttgtggtcttgtgtctgctcttgttctgaagcaaggctagaggctctcgttctgaactgaagaggcggtatacggcttgtgtatatattggaaggcgtgatatactgcctctcgaggaaaaagaaggcaagatactaatgaatgggtgtcacttatatagtgatgaagagagggtaaggaatggttaatgctcttaacggtctctatcggtaagcatgcgtctaaatcatgctgatatatagagttgtaatatgaaagacttggaggtgaaatgcaaatttcattcttgtcttgcctcagtaccaggaaatccattacctgaaccatacatatggcctgtttggtttgcctgcatctgtcactaccatgtaatgcaaattttcctctcaatctggattttctttccagaatctgcattgttcttgcattggttggtggtttgctgctactggatttacgtttacgaatctccccattc

SEQ ID NO: 797 - DNA, 1355 bp, Leymus cinereus x Leymus triticoides
cccgcacgccgcagcgacgcagcgcccgcaatctccccgatcgtttctcgcccccctcgctcgattctcggaggccaggaccgagggcggcggcgcgcgcggggattggattccttccgagtaccgtgagttcttcaaccagaagtgtttggaacagatagcatcctgattgctatggaaggtgggggaatggaccaggtttgcatggctgccatgaccaaccaaccttcagtgtctgataacaagctgatgaagaacatcagtggggagatgcctgctaccgcgaccgccggaagcggctcctttgactgcaacatctgcctcgacttcgctgcagacccagtcgttaccctctgtggccatctctactgctggccttgcatctacgagtggctgcggccgtcggtggtatcagcttccagcgacaacagcacttcagcaaggcagcagtgccccgtgtgcaaggccgcactatctgctgacagccttgtgccgctatatggccgtggtggtagctcaaagaaatcactggatggcacggccattccccgacggccaacggtgcaccgggagaatgttgcgcaccagcacgcacaaagcaacatcgatgacgaccggcaccatcacaacgtggagcccagccctctgctccggccactgcggcatgcgcaccaccaccatcctggtgccgcagaattcgacttcgtctaccctccttcgccaatggggcgtggcctgatccactcgacggctggaggggtgcttggagggatggcggaggcggtgcttccgtgggcgttccgcggccaggtgtcgccgagcatgtactacacaagcccctacgctgtcgcggaccacacggtgggtccccggctgaggaggcagcagatggaggtggagaggtccctgcaccagatctggttcttcctcttcgtgtttgtggtgttgtgtctgctcttgttctgaagcagggcgagaggctctcgttctgaacagaagaggcggtatacggcttgtgtatatattggaaggcatgatatactgcctctcgaggaaaaagaaggcaagatactaatgaatgggtgttgcttatatagtgatgaagagagggtaaggaatggttaatgctcttaacggtctctattgacaagcatgcgtctaaatcatgctgatatatagagttgtaatatgaaagacttggtggtgaaatgcaaatttcattcttgtcttgcctcggtaccaggaactccatcacctgaaccatatggtctgtttggttttgcctgcatctgtgcatctgtgaccaccatgtaatgcaaattttcctcccaatgtgcatctttttaccagaatca

SEQ ID NO: 798 - DNA, 1392 bp, Secale cereale
tccttcttaacctccctcatcttcttcctccgcccgcagcccgcaccgcagcgacgcaatctcaccgatcggtcctcgccccccctcgctcgattctcggaggccagggaccgacggcggcggcgcgcgcgcggattggattccttcccagtaccgtgagttcttcaaccagagctgcttgagacagatagcatcctgattgctatggaaggtgggggaatggaccaggtttgcatggctgccatgaccaaccaaccttcagtgtccgataacaagccgatgaagagcatcagcggggagatgcctgcagccgcgaccgctggaagcggctcctttgactgcaacatctgcctcgacttcgctgcagacccagttgttaccctctgcggccatctctactgctggccctgcatctacgagtggctgcgtccgtcggtggtgtcagcttccggtgccaacagcacttcagcaaggcagcagtgccccgtgtgcaaggccgcgctatctgctgacagcctcgtgccgctctatggccgtggtggtagctcgaagaaatcactggatggcacggccattcctcgacggccaacagtgcaccgggagaatgttgcgcaccagcacgcgcaaagcagcatcgataatgaccggcaccatcacaacgtggagcccagccctccgctccggccactgcggcatgcgcaccaccaccatcctggtgccaccgagttcgattttgtctaccctccttcgccaatggggcgtggcctgatccactcgacggccggaggggtgcttggagggatggcggaggcggtgcttccatgggcgttccgcggccaggtgccgccgagcatgtactacacaagcccctacgccgttgcggaccacacggtgggtccccggctgaggaggcagcagatggaggtggagaggtccctgcaccagatttggttcttcctcttcgtgtttgtggtgttgtgtctgctcttgttctgaagcgagaggctcctgttctgaactgaagaggcggtatacggcttgtgtatatattggaaggcacgatatactgccctctcgaggaaaaagaaggcaagatactaatgaatgggtgttgcttatatagtgatgaagagagggtaaggaatggttaatgctcttaacggtctctatcgataagcatgcgtctaaatcatgctgatatatagagctgtaatatgaaagacttggaggtgaaatgcaaatttcattcttgtcttgcctcagtaccaggaactccattacctaaaccatacatatggcctgtttggtttgcctgcatctgtcactaccatgtaatgcaaaatttcctttcaatctggattttctttccagaatctgcattgttcttcttaa

SEQ ID NO: 799 - DNA, 923 bp, Secale cereale
cggattggattccttcccagtaccgtgagttcttcaaccagaactgtttgcaactgatatcatcctgattgctatggaaggtgggggaatggaccaggtttgcatggctgccatgaccaaccaaccttcagtgtccgataacaagccgatgaagagcatcagtggggagatgcctgcagccgcgaccgctggaagcggctcctttgactgcaacatctgcctcgacttcgctgcagacccagttgttaccctctgcggccatctctactgctggccctgcatctacgagtggctgcgtccgtcggtggtgtcagcttccggtgccaacagcacttcagcaaggcagcagtgccccgtgtgcaaggccgcgctatctgctgacagcctagtgccgctctatggccgtggtggtagctcgaagaaatcactggatggcacggccattcctcgacggccaacagtgcaccgggagaatgttgcgcaccagcacgcgcaaagcagcatcgatgatgaccggcaccatcacaacgtggagcccagccctccgctccggccactgcggcatgcgcaccaccaccatcctggtgccaccgagttcgattttgtctaccctccttcgccaatggggcgtggcctgatccactcgacggctggaggggtgcttggagggatggcggaggcggtgcttccatgggcgttccgcggccaggtgccgccgagcatgtactacacaagcccctacgccgttgcggaccacacggtgggtccccggctgaggaggcagcagatggaggtggagaggtccctgcaccagatttggttcttcctccaagtctttcatattacagctctatatatcagcatgatttagacgcatgcttatcgatagagatcgttaagagcattaaccattccttaccctc

SEQ ID NO: 800 - DNA, 1427 bp, Avena sativa
ggcaagtgacgtcgtcgcctaatctcaatccccccttctttacctcaacctcctccctcttcttcttcctcccccaacccgccgcagcggccacagcatccccgcaatctcccgatcgtttctcgcccccctcgccggaatctcgcaagccaggagccgacggaagaacatagggcccgcgcgtgcgcgctagccgattcgatttcttccttccaagtactgtgagttcttcaaccagaacagtttgcaacagatagcattcctgattaccatggaaggtgggagaatggatcagggttgcatggctgccatcaccagcgaacccttagtgtctgatgataagccgatgaagaacattagtggggagatgcctgcaactgcaactgcaactgctgggagtggatcctttgattgcaacatctgcctcgacttcgctgcagatccagttgttaccctctgtggccatctctactgctggccttgcatctacgagtggctgcgcccagcggtgggatcagcttccaccgacaacaggactgcagccaggcagcagtgccctgtgtgcaaggccgtgctatctgctgacagccttgtgccactatatggccgtggtggcagctccaagaaatcactggatggtgcagccattccgcgacggccaacggtgcacagggagaatgtcgaacaccagcacgcacagagcaccctcggtgaccagcaccaccataacgttgtggagcccagccctcagctccgtccactgcggcatgcacaccaccaccattcgagcaccaccgaattcgacttcatctaccctccttcaccaatggggcgtggcctgatgcactcgacggccggaggggtgcttggagggatggcggaggcagtgcttccatgggcattccggggccaggtgcctccgagcatgtactacactagcccttactccgtcgcggaccacaccgtgggtccccgactgaggaggcagcagatggaggtggagaggtccctgcaccagatctggttcttcctcttcgtgtttgttgtgttgtgtctgctcctgttctgaagcaagggtcactcctgttccgaagaggcggtatacaagcttgtgtatatatttcgaaggcgagatactgcttctccgaggggtgaaaaggagttatgagtgctgcttatatagtgatgaggagggtaaagggttaatgctcttaacggtctctatcgataagcatgtgccttgaaccatgctgacatagagtttgtaatgtgacgagatttggaggtgaaatgcagattccattcttgtcctgccgccccaggaccaggaaggaactccattaactgaactatatggccttgtttgggtttgtctgcatccgtctgtaatgcagtttctcttgtcaatgagcattgttttgtacggc

SEQ ID NO: 801 - DNA, 1673 bp, Brachypodium distachyon
ctctcgccctcttccgcaggtgacgtcgacgcctaatctcatccccctccttctccttcctcctcgcagcgacacagcacccgcaatctcccgattctcgcctcctttcttgatcccctctcccgattcttggacaccaggagccggcaacagtcgccgcgcgcacggattggatttcttccaagtactgtgagttgttcaaccggaacagatagcatcctgattgccatggaagctgggagaatggatcaggtttgcatggctgccatcaatagccaaccttcagtgtctgacgataagccaatgaagaacattagtggggagatgcctgcagccgctggaagtggctcctttgactgcaacatctgccttgacttcgccgcagatccagttgttaccctctgtggccatctctactgctggccttgcatctacgagtggctgcaaccagctgcggaatcagcttccagtaacaaccgaagttccgcaaggcagcagtgccctgtgtgcaaggccacactatctgctgacagccttgtgccactatatggccgcggtggtagctctaagaaatcactggatggtatggccattccacgccggccaatggtgcaccgggaaaatgctgagcaccaccacacacaaagcaacattgatgaccgccaccatcagaacatggagcccagacctctgctgcggccattgcggcatgcccaccaccattccggtgccactgaattcgacttcatccatcctccttcaccattgggacgtggtttgatccactcgacagctggaggggtgcttggaggcatggccgaagcagtgcttccatcggcattccgtggccagctccctccgagcatgtactacacaagcccttactatatcgcggctcataacatgggcccccgactgagaaggcagcagatggaggtggagaggtccctgcaccacatctggttcttcctcttcgtgtttgtggtgctatgcctgctcttgttctgaagcaagaggggcagtatacaccttatgtatatattcaaaggcaatatactgcttctcggtggaaaaaagaaggcaagatactaatgactgctgcttatagcgaagagggtaatggttaacgctttcaacggcctttatggataagcatgtgcctaaatcatgctgatatagagatgtaatgtgacgagatttggagctgaaatgcagataccattcttgtcttgccagtatcaggaattcctgtttggtttgcctgcatctgtcactaccatgtactgcaattttgtttcaatctcaatctgcactggttggtggcttggagcgttactggagcaacttttcaaatcttgtctttattgtgaactttgcatgtagttgtagaacaatataaaattgcacatcaccgtaatctgtctacttggttacatgtcaagttgaactacatcaagcgtgatgaagtttgccgacatgttcacgcgatcaaaacagttctgttgagatatttagtagtcagtacggagtacctgtatattatttattgcaccaaaagtgttgcccagctgcatttttgtccgtgtaaagggaatggaggggccttcgaagcgatgaacaccgtgcagcctaaacggcagtgttgcttgtccagtgaaacagtttcatgtgca

SEQ ID NO: 802 - DNA, 1797 bp, Secale cereale
gactaaacaccaccattcatgtttcagtgtgctttcaaagtggatgcatatctaaaatattgtcttccctggatttttctgtctttgctcgtttggctccagtgtgactcataaaagtagatatgttgccactataaagctgcacagagcttacaaaaggatgaagctctgaaggtacataacaaaacatggctccgctgactcccagacttgtggtgcccatagatgtgaagaagaagccatgggagcagaaggttcgtctccataaccgctggcatccggatatccctcctgttgctgatgtaactgaaggggaattattccgtgttgagatggtcgattggactggaggacgggttagagatgatgactctgcggatgatatcaaatttctggacctcacaattactcattatctcagtggcccccttagaatagttgatgctgaaggggttccagcttcacctggtgatcttcttgcggtagagatctgcaaccttggtccgctccctggtgacgagtggggttatactggaatattcgaaagggagaatggaggcgggttcttaaccgatcactttccaagtgcaagaaaagccatttggtattttgaaggaatttatgcatactcccctcagataccaggtgttcggtttccgggattaactcaccctggtatagtgggaactgcaccatcagttgagcttcttaatatatggaatgaaagggaaagaaaattgatcgagactggtcacgagtctctgaaactgtgcgaagttctacatcagaggccccttgctaacttaccaacctctgacaactgcttacttggaaagattcaagaagggactgctgaatggcaaaaaattgcaaatgaagcagcaagaactattcctggaagagagaatggggggaattgtgacataaagaatctaagcagaggttccaaagtttatctaccagtatttgttgacggagcaaatctgagtactggcgatatgcacttttcccaaggtgatggtgaagtctcattttgcggagcaatagaaatgagtggattccttgagctaaagtgtgagatcataagaggtgggatgaaggaatacttgactcctgttggtccaacagcacttcatgtgaatcctatctttgagataggtccggtggagccacgtttctcagaatggttagtctttgagggcatcagtgtagatgagtcagggaaacagcatttccttgatgcatcagttgcatacaagcgtgcagttctcaatgccattgagtatctttccagatttgggtactccaaggagcaggtctatcttttactgtcatgctgtccatgtgagggtaggatatctggaatagtagacgcccctaatgcagtggcgacacttgcgatccctacagcaatattcgaccaggatataaagccaaaacgcctggggcatggaccaaaattgagaagacttccggatgttctgagatgaaggttcagtagacaccttcctgtaagacaagaccaaatatcatgtatagaatatctaataataaatctaaataatcatctttagtattcccgcaaccatctatgtatgtccaacatggaacgtggacccgtagttgtaatatggggtttcttgtttctcgatacttgataatttatatatcagacaattgacgtatatgaagacacccatatgacaaaaaataaaaaaaaaaaaaaaaaaaaaaaaaaagaaaaaaaaaaaaaagagagagagagagagagagagagagagagagacacgacacgac

SEQ ID NO: 803 - DNA, 1867 bp, Triticum aestivum
acttctgagcatactctattattgctaggtaaagatgtgtctaatccttggaaacaccaccatccatgtttcagtgtgctttcaaagtggatgcatatctaaaatgttgtcttccctggatttttctgtctttgctcgtttggttccagtgtgactcataaaagtagatatgttgccagtataaagctgcacagagcttacaaaaggatgaagctctgaaggtacataacaaaatatggctccgctgactcccagacttgtggtgcccatagatgtgaagaagaagccatgggagcagaaggttcgtctccataaccgctggcatccggatatccctcctgttgctgatgtaactgaaggggaattattccgtgttgagatggtcgattggactggaggacgggttagagatgatgactctgcagatgatatcaaatttctggacctcacaattactcattatctcagtgggccccttagaatagttgatgctgaaggggttccagcttcacctggtgatcttcttgcggtagagatctgcaacctcggtccgctccctggtgacgagtggggttatactggaatattcgaaagggagaatggaggcgggttcttaaccgaccactttccaagtgcaagaaaagccatttggtattttgaaggaatttatgcatactcccctcagataccaggtgttcggtttccgggattaactcatcctggtatagtgggaactgcaccatcagttgagcttcttaatatatggaacgaaagggaaagaaaattgatcgagacaggtcacgagtctctgaaactgtgcgaagttctacatcagagaccccttgctaatttaccaacctctgacaactgcttacttggaaagattcaagaagggactgctgaatggcaaaaaattgcaaatgaagcagcaagaactattcctggaagagagaatggggggaattgtgacataaagaatctaagcagaggttccaaagtttatctaccagtatttgttgaaggagcaaatctgagtactggcgatatgcacttttcccaaggtgatggtgaagtctcattttgcggagcaatagaaatgagtggattccttgagctaaagtgtgagatcataagaggtgggatgaaggaatacttgactcctgttggtccaacagcgcttcatgtgaatcctatctttgagataggtccggtggagccacgtttctcagaatggttagtctttgagggcatcagtgtagatgagtcagggaaacaacatttccttgatgcatcagtcgcatacaagcgtgcagttctcaatgccattgagtatctttccagatttgggtactccaaggagcaggtctatcttttactgtcatgctgtccatgtgagggtaggatatctggaatagtagacgcccctaatgcagtggcgacacttgcgatccctacagcaatattcgaccaggatataaagccaaaacgcctggggcatggaccaaaattgagaagacttccggatgttctgagatgaaggtgcagtggacaccttcctggaacacaagaccaaatatcatgtttggaatatctaacaataaatctaaataatcatctttaggatttccacaaccatctatgtacgtgcaagacggaatgtggacccgtaattgtaatatggggtttcttgtttctcgatacttgataatttatatgtcagaacaatcgacgtatatgaagacacctatatgcatattttctatattgctgcaaagttttgttatgtaggtcatggagacatttttgcttgttattactactgaaattgaaattatgccacgcttccaataaattgctgctcttctag

SEQ ID NO: 804 - DNA, 1901 bp, Triticum aestivum
tacttgatggtgacccagttatgggttaccaatcacttctgagcatactctattattgctaggtaaagatgtgtctaatccttggaaacaccaccatccatgtttcagtgtgctttcaaagtggatgcatatctaaaatgttgtcttccctggatttttctgtctttgctcgttttgctccagtgtgactcataaaagtagatatgttgccagtataaagctgcacagagcttacaaaaggatgaagctctgaaggtacataacaaaacatggctcccctgactcccagacttgtggtgcccatagatgtgaagaagaagccatgggagcagaaggttcgtctccataaccgctggcatccggatatccctcctgttgctgatgtaactgaaggggaattattccgtgttgagatggtcgattggactggaggacgggttagagatgatgactctgcagatgatatcaaatttctggacctcaaaattactcattatctcagtggcccccttagaatagttgatgctgaaggggttccagcttcacctggtgatcttcttgcggtagagatctgcaacctcggtccgctccctggtgacgagtggggttataccggaatattcgaaagggagaatggaggcgggttcttaaccgaccactttccaagtgcaagaaaagccatttggtattttgaaggaatttatgcatactcccctcagataccaggtgttcggtttccgggattaactcatcctggtatagtgggaactgcaccatcagttgagcttcttaatatatggaacgaaagggaaagaaaattgattgagacaggtcacgagtctctgaaactgtgcgaagttctacatcagagaccccttgctaacttaccaacctctgataactgcttacttggaaagattcaagaagggactgctgaatggcaaaaaattgcaaatgaagcagcaagaactattcctggaagagagaatggggggaattgtgacataaagaatctaagcagaggttccaaagtttatctaccagtatttgttgacggagcaaatctgagtactggcgatatgcacttttcccaaggtgatggtgaagtgtcattttgcggagcaatagaaatgagtggattccttgagctaaagtgtgagatcataagaggtgggatgaaggaatacttgactcctgttggtccaacagcacttcatgtgaatcctatctttgagataggtccagtggagccacgtttctcagaatggttagtctttgagggcatcagtgtagatgagtcggggaaacagcatttccttgatgcatcagttgcatacaagcgtgcagttctcaatgccattgagtatctttccagatttgggtactccaaggagcaggtctatcttttactgtcatgctgtccatgtgagggtaggatatctggaatagtagacgcccctaatgcagtggcgacacttgcgatccctacagcaatattcgaccaggatataaagccaaaacgcctggggcatggaccgaaattgagaagacttccggatgttctgagatgaaggtgcagtagacaccttcctgtaacacaggaccaatatcatgtttagaatatctaacaataaatctaaataatcatctttagtattccacaaccatctatgtttgtgcaacacgaatgtggacgtgttgttgtaatatggggtttcttgtttctcgatacttgataatttatatatcagacaatcgacgtatatgaaggcacctatatgcatattctctatattgctgcatagttttgttatgtaggtcatggagacattttacctgttattactattgaaattgaaattatgccactctcccaataaattgctgctcttctagacctt

SEQ ID NO: 805 - DNA, 1653 bp, Triticum aestivum
tccagtgtgactcataaaagtagatatgttgccagtataaagctgcacagagcttacaaaaggatgaagctctgaaggtacataacaaaacatggctcccctgactcccagacttgtggtgcccatagatgtgaagaagaagccatgggagcagaaggttcgtctccataaccgctggcatccggatatccctcctgttgctgatgtaactgaaggggaattattccgtgttgagatggtcgattggactggaggacgggttagagatgatgactctgcagatgatatcaaatttctggacctcaaaattactcattatctcagtggcccccttagaatagttgatgctgaaggggttccagcttcacctggtgatcttcttgcggtagagatctgcaacctcggtccgctccctggtgacgagtggggttataccggaatattcgaaagggagaatggaggcgggttcttaaccgaccactttccaagtgcaagaaaagccatttggtattttgaaggaatttatgcatactcccctcagataccaggtgttcggtttccgggattaactcatcctggtatagtgggaactgcaccatcagttgagcttcttaatatatggaacgaaagggaaagaaaattgatcgagacaggtcacgagtctctgaaactgtgcgaagttctacatcagagaccccttgctaacttaccaacctctgacaactgcttacttggaaaggtactcaagaagggactgctgaatggcaaaaaattgcaaatgaagcagcaagaactattcctggaagagagaatggggggaattgtgacataaagaatctaagcagaggttccaaagtttatctaccagtatttgttgacggagcaaatctgagtactggtgatatgcacttctcccaaggtgatggtgaagtctcattttgcggagcaatagaaatgagtggattccttgagctaaagtgtgagatcataagaggtgggatgaaggaatacttgactcctgttggtcctacaccacttcatgtgaatcctatctttgagataggtccggtggagccacgtttctcagaatggttagtctttgaaggcatcagtgttgatgagtcggggaaacagcatttccttgatgcatcagttgcgtacaagcgtgcagttctcaatgccattgagtatctttccagatttgggtactccaaggagcaggtctatcttttactgtcatgctgtccatgtgagggtaggatatctggaatagtagacgcccctaatgcagtggcgacacttgcgatccctacagcaatattcgaccaggatataaagccaaaacgcctggggcatggaccaaaattgagaagacttccagatgttctgagatgaaggtgcagtggacacctgctgcaacacaaggccaaagatcatgtttagaatatctaataataaatctaaataatcatctttggtattctcacaaccatctatgtaatgtgcaacatggaatgtggacccgcagttgtaatatggggtttcttgtttcctgatgcttgataatttagaagacacctatatgcatattttctatattgctgcaaagtttttatatgtaggtcatggagacattttgcttattattactta

SEQ ID NO: 806 - DNA, 1816 bp, Triticum aestivum
tctaaaatgttgtcttcctggatttttctgtctttgctcgttttgctccagtgtgactcataaaagtagatatgttgccagtataaagctgcacagagcttacagaaggatgaagctctgaaggtacataacaaaatatggctccgctgactcccagacttgtggtgcccatagatgtgaagaagaagccatgggagcagaaggttcgtctccataaccgctggcatccggatatccctcctgttgctgatgtaactgaaggggaattattccgtgttgagatggtcgattggactggaggacgggttagagatgatgactctgcagatgatatcaaatttctggacctcacaattactcattatctcagtgggccccttagaatagttgatgctgaaggggttccagcttcacctggtgatcttcttgcggtagagatctgcaacctcggtccgctccctggtgacgagtggggttatactggaatattcgaaagggagaatggaggcgggttcttaactgaccactttccaagtgcaagaaaagccatttggtattttgaaggaatttatgcatactcccctcagataccaggtgttcggtttccgggattaactcatcctggtatagtgggaactgcaccatcagttgagcttcttaatatatggaacgaaagggaaagaaaattgatcgagacaggtcacgagtctctgaaactgtgcgaagttctacatcagagaccccttgctaatttaccaacctctgacaactgcttacttggaaagattcaagaagggactgctgaatggcaaaaaattgcaaatgaagcagcaagaactattcctggaagagagaatggggggaattgtgacataaagaatctaagcagaggttccaaagtttatctaccagtatttgttgaaggagcaaatctgagtactggcgatatgcacttttcccaaggtgatggtgaagtgtcattttgcggagcaatagaaatgagtggattccttgagctaaagtgtgagatcataagaggtgggatgaaggaatacttgactcctgttggtccaacagcacttcatgtgaatcctatctttgagataggtccggtggagccacgtttctcagaatggttagtctttgagggcatcagtgtagatgagtcagggaagcaacatttccttgatgcatcagttgcctacaagcgtgcagttctcaatgccattgagtacctttccagatttgggtactccaaggagcaggtctatcttttactgtcatgctgtccatgtgagggtaggatatctggaatagtagatgcccctaacgcagtggcgacacttgccatcccgacagcgatattcgaccaggatataaagccaaaacgcctggggaatggaccaaaattgagaagatttccggatgttctgagatgaacgtacagtggaccatatatattagcacaagaccaaggcggtacaagggcaccacaacgtcgatatctaaagtgatgcatgatcatgtttagactactgtctaataataaatctacataaccatctttattatttgaataatcatttcagtaggtgcggcatggaatgtggacttgtagttgtgatgtgggatttcttgattctagacacttgaaaatttgtaaagcagacgtatatgaagatacatatatgccataatgtttatcttgctgcaaagttttatcatgtaagacatgcaagtattttgcttgtgattactattgagactagcatagcgccctcgcaaatgcaagccatcatctttagtgtgccgaaag

SEQ ID NO: 807 - DNA, 1702 bp, Avena sativa
agtgtgactcatcatcgaagttgatatgtaccatactaagatgcacggagcctacaaaaggatgaagctctgaatttacataacaaaccatggctcctctgactcccagacttgtagtgcccatagatgtgaagaagaagccttgggagcaaaaggttcatctccataaccgctggcatccagatatccctcctgttgctgatgtaactgaaggggaattattccgtgttgagatggtcgattgcactggaggacgggttagagatgatgactccgcagatgatatcaagtttctggacctcacaattcctcattatcttagtggcccctttagaatagttgatgctgaaggggtcccagcttcacccggggatcttcttgcggtagagatctgcaaccttggtccacttcctggtgatgagtggggttatactggaatatttgaaagggagaatggaggtggattcttaacagaccacttcccaagtgcaagaaaagccatttggtattttgaaggaatttatgcatactccccacagatacctggtgttcggtttccaggtttaactcatcctggtatagtgggaactgcaccatctgccgaacttcttaatatatggaacgaaagggaaaggaaattgaccgagacaagtcatgagtctctgaaactgtgtgaagttcttcaccagaggccccttgctagcttaccaacctccgagaactgcttacttggaaagattgaagaagggactgctgaatggcaaaagattgcaaatgaagcagcaagaactattcctggaagagagaatggggggaactgtgacattaagaatcttagcagaggttccaaagtttatctcccagtatttgttgaaggagcaaatttgagtactggtgatatgcacttctcccaaggtgacggtgaagtctcattttgtggagcaatagaaatgagtggattccttgagctcaagtgtgagattatacgaggtgggatgaaggaatacttgactcctattggtccgacagcacttcatgtgaatcctatctttgagataggtccagtggagccacgtttttcagaatggttagtcttcgagggcatcagtgtagatgagtctggcaaacagcatttccttgatgcatcagttgcctacaagtgtgctgttctcaatgccattgaatacctttccaaatttgggtactccaaggagcaggtctatcttttactatcatgctgtccatgtgagggcaggatatctggaatagtagacgcccctaatgcagtggcgacacttgccatccctacagcaatatttgaccaggatataaggccaaaacgcctggggcatggaccaaaattgagaagaactccggatgttctgaggtgcacgtaggatgggcaccttcctgtaacacaagaccaaagcggaacagtggcaccataagtgacgagacatctaaaaatcaatccatgatggacatgtttacactgtataattataaacataaataatcatcgacatatgcgcaaactataatgtagaccaattgttgcaaacttgcaatatgggatttgttgacacttggtaatttacgtatcagagaatcagacatatatgaggacagagatatgccatataaaattcctgccttgttggcttgttgaaaagttgggctatatgggttatgcaagcatttt

SEQ ID NO: 808 - DNA, 1720 bp, Triticum aestivum
gccttcaaaactagcgctgccattcttatcttatataaagaagcaggtggagcttacaaaggatgaagcactgaagctggcataacaacaaaacatggctcctctgactcccaggcttgtggtgcccgtcgatgtgaagaagacgccatgggagcaggaggttcaactccacaaccgctggcatccggacatccctcccgtcgccgatgtgaccgagggggagttgttccgtgttgagatggtcgattggaccggaggacaggtcagagacgatgactccgcagatgacatcaaatctctggatctcaccactcctcactatctcagtggcccacttagggtagttgatgctgagggggttccagcttcacccggcgatcttctcgcggtggagatctgcaacctcggcccgcttcccggcgatgagtggggttataccggcatattcgaaagggagaatgggggcgggttcttgaccgaccacttcccaagtgcaagaaaagccatttggtatttcgaagggatttacgcacactcccctcagataccaggtgttcggtttccggggttaactcatcctggtatagtgggaactgcaccgtcggccgagcttctcaatatatggaaccaaagggaaagggaattggtcgatacgggccacgagtctctgaaactgtgtgaagttctacaccagagaccccttgctaacttaccaacctcccacagctgcttacttgggaagatccaagaagggactcctgagtggcaaaggattgcaaatgaagcagcaaggaccattcctggaagagagaatgggggaaactgtgacataaagaatctaagcaggggctccaaagtttatctgccagtatttgttgaaggagcaaatttgagtaccggtgatatgcacttctcccaaggtgatggtgaagtctcattttgcggagcgatagaaatgagtggattccttgagctaaagtgtgagatcataagaggtggcatgaaggagtacttgactcctgttggtccaacagcacttcatgtgaaccctatcttcgagataggcccggtggagccgcgcttctcggaatggttagtcttcgagggcatcagcgtcgatgagtcggggaagcagcatttccttgacgcatcagttgcctacaagcgtgcagttctcaatgccattgaatacctttccaagtttgggtactccaaggagcaggcctatcttttgttgtcatgttgtccatgtgagggtaggatatctggaatagtagatgcccctaacgcagtggcgacacttgccatcccgacagcgatatccgaccaggatataaggccaaaacgcctggggcatggaccaaaactgaggagacttccggatgttctgagatgaacatacagtggaccatatatgcagtggagcacaagaccaaagcggtacaaggacaccatggcatcaatcaaacgtctaaaaataatgcgcgatcatgtttacacaatctcttataataaatctgagtaaccatctttattatttcaaccatcatttatgtatgtgtgaccctgaatgtggaccagtagttgtaatgccgtattgtctattgagttctctcttgtctatattgctgcaaagttttgtgatgtaggtgatgcaagcattttgcttgttattactattgaaattatgcaactctccaaagaaattagaggtcctcta

SEQ ID NO: 809 - DNA, 1674 bp, Triticum aestivum
tgtgctgcacccgccacctacgcacacaacgcctgaatgcattgaaagattacccacctcggccggctacgtacgcatcgccattttccgggaagggtgtcttacaaagggatgaaggtctgaagctggcataacaaattaacatggctcctctcactcccaggcttgtagtgcccatagatgtaaagaagcagccatgggagcaggaggttcctctccacaaccgctggcacccggatatccctccggtcgccgatgtgactcaaggggaattattccgtgttgagatggtcgattgcaccggagggcaggttagagatgatgactcggcggacgatatcaaatctctggattttgcagcgcctcactatctcagcggcccccttagagtagtcgatgccgaaggggttccggcttcacctggtgatcttctggcggtggagatatgcaacctcggcccgcttcctggtgacgagtggggttatactggaacatttgaaagggagcatggaggcgggttcttaactgaccacttcccgagtgcaagaaaagccatttggtatttcgaaggaatttacacgcactcccctcagataccaggtgttcggtttccggggttaactcatcctggtatagtgggaactgcaccgtcagctgagcttctcaatatatggaaccaaagggaaagagaattggtcgaggcgggtcatgagtctctgaaattgtgtcaagttctacaccagagacctcttgctagcttaccaacctcccacaactgcttacttgggaagatgcaagaagggactgctgaatgggaaaaaattgcaaatgaagcagcaagaacgattcctggaagagagaatgggggtaactgtgacataaagaatctaggcagaggttccaaggtttatctaccggtatttgttgaaggagcaaatttgagtactggtgatatgcacttctcccaaggagacggtgaagtttcattttgcggagcaatagaaatgagtggattccttgagctaaagtgtgaaatcataagaggtggcatgaaggaatacttgactcctattggtccaacaccacttcatgtaaatcctatctttgagataggtccggtggagccgcgtttctcggaatggttagtcttcgagggcatcagcgtggatgagtcggggaaacaacatttccttgatgcatcagttgcctacaagcgtgcagttctcaacgccattgagtacctttctagatttgggtactccaaggagcaggtctatattttactgtcatgctgtccatgtgaaggtaggatatctggaatagtagacgcccctaatgcagtggcgacacttgccatccctacagcgatattcggccaggatataaagccaaaacgcctggggaatggaccaaagttgagaagatttccggatgttttgagatgaacgtacatgggaacatatatgttagcacaagaccaaggcggtacaagggcaccacaacgtcaaatatctaaagtaatgcgtgatcatgtattcatgtttacactattgtctaataataaatctaaataaccatctttattatttgaacaatcatttctgcatgtgctgttgttgtaatgtgggatttcttgattctagacacttgaaaatttataaatcagacgtatat

SEQ ID NO: 810 - DNA, 1758 bp, Brachypodium distachyon
ttcctgatgtgctttccaagtggatgtacgtttaaaactcggtcttccttggatttttctgtctcctggtttctctttcagtgtgactcatcgaagttgacatgttgctattatgaagatgcatggagcttacaaaaggatgaagctcagaaggtacatcacaaaacatggctcctctgacccccagacttgtagtgcccatagatgtgaagaagaagccatgggagcaaaaggttcacctccataaccgctggcatccagatatccctcctgttgctgatgtgactgaaggggagttattccgtgttgagatggtagattggactggaggacgggttagtgatgataactctgcagatgatatcaaatttctggatcttacaattactcattatcttagtggccccttcagagtaattgacgctgaagggattccagcttcacctggtgatcttctagctgtagagatttgcaaccttggtcctcttcctggtgatgagtggggttacactgcaatatttgaaagggagaacggaggcggattcttaaccgaccactttccaagtgcaagaaaagcgatttggtactttgaaggaatttatgcatactcccctcagataccaggtgttcggtttccaggattaactcatcctggtatagtgggaactgcaccctcggccgagctgcttaatatatggaatgaaagggaaaggcaattgaccgagacaggtcacgagtctctgaaactgtgtgaagtcctacaccagaggccccttgctaacttaccaacccctgagaactgcttacttggaaaggttcaagaagggactgctgagtggcaaaaaattgcgaatgaagcagcaagaactattcccggaagagagaatggggggaactgcgacataaagaatctaagcagaggttccaaagtttatctaccagtatttgttgatggagcaaatttgagtactggtgatatgcacttctcccaaggtgacggtgaagtctcattttgtggagcaatagaaatgagtggattccttgagctaaagtgtgagatcataagaggtgggatgaaagaatacttgactccagttggtccgacaccacttcatgtgaatcctatctttgagataggtccagtggagccacgtttctcagaatggttagtctttgagggcatcagcgtagatgagtctgggaaacagcatttccttgatgcatcagttgcctacaagcgtgctattcttaatgcaattgaatacctttccagatttgggtactccaaggagcaggtatatcttctactatcatgctgtccatgtgagggtaggatatctggaatagtagacgcccctaatgcagtggcgacacttgccatccctacatcaatatttgaccaggatataaggccaaaacgcctaggccatggaccaaaattgaggagagttccggatgttctgaggtgcacctatgatggacaccttcctgtaacacaagaccaaagttatgcaagggcgccatagtgcaattatctagaaattcatatgcgtgatcatatttacgattgctaattatgtatatacagattgcgacgatcatctgtactattcagaaccatctatgtatgctcaatccagattgcttaaaatgtacttcctcccaatgggttgtatcttagagttgtatctaaacaaggtataatttattatgttttgtgagataggagttactcattccgtttcataatataaggca

SEQ ID NO: 811 - DNA, 1887 bp, Oryza sativa
tttcagtgcactttcgagatggagtgtatatttgaaaccattccttcctgggattcctttgtctttgctcattttgtcgttttttgcctgactcattgctatggatatgctatcattatatagaagcatgagcttccggaaggatgaacctctgatcccttccctccctgcaacagaacatggctcttccaacaccaagattggtagttcctatagatgtgagcaagaagccatgggagcaaaaagtccctctccataaccgctggcatccagatatccctcctgttgcagatgtaactgaaggggaattgttccgtgttgagatggtcgattggactggaggaagagtcagtgatgataactccgcagatgacatcaaattcctggatctcacaattactcattatcttagtgggcccttaagaatagttgatgctgaaggggttccagctgcacctggtgatcttcttgctgtagagatctgcaaccttggtccacttcccggtgacgaatggggatatactgccatatttgaaagggagaatggtggtggattcttaaccgaccacttccctagtgcaagaaaggcgatttggtattttgaaggaatttatgcatactcccctcaaataccaggtgtccgatttccaggattaactcatcctggtatagtggggactgcaccatctgctgagcttctcaatatatggaatgagagggaaaaaatattggctgagacaaatcatgagtcaatcaaaatctgtgaagttctacatcagaggcctcttgccaacttaccaacccctgagaactgtttacttggaaagattcaagaagggactgctgattggcagaaaatcgcaaatgaagcagcaagaactattcctggaagggagaatggagggaattgtgacatcaagaatctaagtagaggttccaaggtttatctcccggtatttgttgatggagcaaatctgagtactggtgacatgcatttttcccagggtgacggcgaagtctcattctgtggagcaatagaaatgagtggatttcttgagctcaagtgtgagatcataagaggtgggatgaaggaatacttgactccaataggtccaacaccacttcatgtgaatcctatctttgatataggtccagtggaaccacgtttctcagactggttagtctttgagggcatcagtgtagacgagtctgggaagcagcattttcttgatgcatcagttgcctacaagcgtgctgtcctcaatgccattgagtacctttccagatttgggtactccaaggagcaggtataccttttgctatcatgctgcccatgtgagggtaggatatctggaatagtagactcccctaatgcagtggcaactcttgccatccctacagcaatatttgaccaggatgtaaaaccaaaacgcctgagtgggaaacaaggaccaaagttgagaaggcttccagatgttttgagatgctcgtccgatggacaccttcctgttacacaggacccaagcggtacaaaggcaccttaactactgcaaaatgcgtggtcatattcacaatccactatatgattagtaattataaatctaaataatcatatttattattccaacatctatctagtgtaatccataatgtgggtcacatgttgtattttctgtattgtacgtgccgtattttctgtattgctaccaagcaccaactcgtgttatctgagttgtgcaagcaactaaatttccttattgtcccaaatatcacggcttgtttggcaacttgagggaagaggattgggagtttacacgagggaattgatggtgagattaagatggaaatttgatttttcatcctagtctcttgtttggtagaggtggt

SEQ ID NO: 812 - DNA, 3060 bp, Zea mays
ttcgctctcccgcgccaccggcctagacgcctagtatgttctagagcataccgcgatggccgaccctgctggcctcccgccgcggcttcgcccgtccactgtgccgcctccagccgccgtcacgcgcgcgctgcacgcgatcaacacctgcacctccgccgcggcactcgcgcccctccgcgtccacatcctccgggaacccgcgctcctccgctccaccgccgtcatctccgccttcttcctcgcctgcggccgcctccgtagcctcgaccccgcactcgttctcttcgcctccctcccgcggccccacgttttcgtcttcaactccctcctccgctccctcccccaggcccccgcctgctcaccgctcccgctcttgcgccacttcctcggcctcggcgcccgccccaaccgctacaccttcccgttgatgctcacctcgctttcctctctccgcgagctcaacgtcgcgcactcccaggtggccaagtccggctttgcgcgcgacctccacgtccgaaacgccctccttgctcgctacgcggcctgtgatccggacctcgggcacgctgagcagttgtttgatgaaatgccacgcccggacgtcgtctcgtggaccacggtgatcaccgcgtacagaaaccacggccacagtttcttggctctggccaccttccggcggatgttcgctgcatctgttgctcccaaccgcgtcaccatggtttctgcacttggtgcttgtgcagcacatggtgctgtggacactggcatctggattcatcagtacgttcagaagctgggttgggaactggatgtcgtgttaggcactgcgcttgttgacatgtatgggaagtgtggacacgttgcggaaggagtccgtgtattctccaaaatgactgagaggaatgtttttacttggaactctatcattggagcatttgctttggtacaggatggagaaatggctctgcgttggttcttcaggatgaaggctgatggcatacgccctgatgctgtcacgctaatttgtgttctttatgcatgcgtacatgctggattagttgatattgggaggaaaatatttaacttgattgttcaaggcgagtatgggtttcaacctgggatcaagcactttggatgcatggttgatcttcttagtcgctctggacacctgaatgatgctttcagggttgttgaggcaatgccatcacagccaaacgctgtcatttggggcctgctattgcgaggttgcaaggaccatggtgattcagtcttgagtgagcatgtgacaatgcagctgctggagttggagcctgaaaatgcttcgcattatgtgacacttgcaaacttgtatgctgagacagggaggtggctggaggctcacgaggtcttgaagtggatgaaggaaaaaggattggcaaaggatgcaggctggagccttaggatgttagaggacaggtcaagcaaatgtataagtgatggaaatttcatgaagctcttgaggagatactgtaacgaaacatggctcctctgactcctagactggtagtgcccatagacgtgaagaagcagccatgggagcagaaggttcctctccacaaccgctggcatccagacatccctcccgttgctgatgtaaccgaaggggaactgttccgggtcgagatggtagactggactggagggagggttagagacgataactctgcagacgacatcaaatccctggacctcacaatcactcattatcttagtgggcccctaagaatcgttgattccgaaggggttccggcttcaccaggcgatcttctcgcggtggaaatctgcaaccttggcccgcttcctggcgacgagtggggctacactgcgatatttgagagagagaacggaggtgggttcctaactgaccacttccctactgcgaggaaggccatctggtatttcgaaggaatctatgcgtactcccctcagataccaggtgttcgtttcccaggattaacccatcctggtattgtgggaactgcaccgtcagccgaacttcttaatatatggaacgagagggagaaaagattggccgagacaagcccacagacccttaaactgtgtgaagtgctgcaccagaggccccttgccaatttaccgacccctgagaactgcttacttggaaagattcaggaggggactgctggatggcacaaagtggcgaatgaagcagccaggactattccgggaagggagaatggcggtaattgtgacataaaaaacctaagcagaggttccaaagtttatctgccagtatttgtcgaaggagcgaatcttagcaccggtgatatgcacttctcccagggcgatggtgaagtttcgttttgtggagcaattgaaatgagtggattccttgagctcaagtgcgagatcataagaggcgggatgaaggaatacttgaccccagttggtccgacaccgctacacgtgaaccctatctttgagatcggtcctgtcgagccacgcttctcggagtggctagtgtttgagggcataagcgtggatgaatctgggaagcagcatttccttgatgcgtcagttgcttacaagcgtgcagtcctgaacgccattgagtacattgctagatttgggtactcaaaggagcaggtgtatctcttactatcatgctgtccctgtgagggtaggatctctggaatagttgactctcctaatgcagtggcaactcttgccatccctacagcaatatttgatcaggatataaagccaaaacacctgagaggaagaccgggaccaaagttgataaggcttccagatctcctgagctgttcaaacaatgggcatattcctgtcacccaagaccaaagtggtacaagggcgtcctaggggcgtatatgatctggaagctgatgccgtatccttctacttatacacacaaataatcgtgttggtgtttccaacaatgtatgaggatagagacacctgagtggtgccatattttcagtgcctgtattgctacaaagttgttcattaatttcactctatagaaaatttcttatt

SEQ ID NO: 813 - DNA, 1793 bp, Setaria italica
tttctgtgttcttcccaaacaaatgcatgtttgaaaccatgttttcctgagattccttttttgttttattgtttttatcctttagcatgactcatcactatgcatatcctaccattataaaggtgcacaaaacttccaaagggacaaagctcttgaggagatactgttatgaaacatggctcctctgactccaagactggtagtgcccatagatgtaaagaagcagccatgggaacaaaagatccctctccataaccgctggcacccaaatatccctcctgttgctgatgtaactgaaggggaattgttccgtgttgagatggttgattggactggagggcgggttagggatgataactctgctgatgatatcaaattcctggatctcacaacaactcattatcttagtggacccctaagaatagttgattctgaaggggttccagcttcacctggtgatcttcttgtagtagagatctgcaaccttggtccacttcctggcgatgagtggggttatactgcaatatttgaaagggagaatggaggtggattcttaactgaccatttccctagtgcaagaaaggccatttggtattttgaaggaatttatgcatactcccctcagataccaggtgttcgttttccaggattaactcatcccggtatagtaggaactgcaccatcagttgaacttcttaatatatggaatgaaagggagaaaagattggctgagacaagtccagagactcttaaactgtgtgaagtcctacaccagaggccccttgctaatttaccgacccctgagaactgcttacttggaaagattcagaaagggacagctgaatggcacaaaatggcaaatgaagcagccagaactattcctggaagggagaatggcgggaactgtgacataaagaatctaagcagaggttccaaagtttatctaccagtatttgttgaaggagcaaatcttagtactggtgatatgcacttctcccagggcgatggtgaagtttcattttgtggtgcaattgaaatgagtggattccttgagctcaagtgtgagatcataagaggtgggatgaaggaatacatgaccccagttggtccaacgtcactacatgtgaatcctatcttcgagataggtcctgtcgagccacgcttctcagaatggttagtgtttgagggcatcagtgtggatgagtctgggaagcagcatttccttgatgcatcagttgcctacaagcgtgcagttctgaatgccattgagtacctttccagatttgggtactccaaggagcaggtatatctcttactatcttgctgtccatgtgagggtaggatatctggaatagtagactctcctaatgcagtggcaactcttgccatccctacagcaatatttgaccaggatataaggccaaaacacttgaaagggagaccaggaccaaaactgataagacttccagatcttctgagctgctcaaatgatggacaccttcctgtcacccaagaccaaagtggtagaagtgtaccctagagatgcatatcatctagaaattgatgagtatcgttctacttatacatataaataatcatctttatatttccaacttccaggaatcatctatgtatgtgacctggaatccagaatgttgatctttagtttgtcagacaataatcatgtatgaggatagaaacacctgagtggtgtcatattttctgtattgctacaaagtcgtgctatgaataatgttgaaatttaatttccctctctagaaacttacttattt

SEQ ID NO: 814 - DNA, 2344 bp, Sorghum bicolor
cgtggttttaatcatgttttccctggaattccttttgcttctattttttttttatcttttagcatgactcaacaccatgtatagcttaccattataaagctgcacaaagcttccaaagggaagaagctcttgaggagatactgtaatgaaacatggctcctctgactcctagactggtagttcccatagatgtgaagaagcagccatgggagcaaaaggttcctctccataaccgctggcatccagacatccctcctgtcgctgatgtaactgaaggggaattgttccgtgttgagatggtagattggactggaggacgggttagagatgataactctgcagatgacatcaaattcctggatctcacaagtacccattatcttagtggccccctaagaatagttgattctgaaggggttccagcttcaccaggtgatcttcttgcagtagaaatctgcaaccttggcccacttcctggtgatgagtggggttatactgcaatatttgaaagagagaatggaggtggattcttaactgaccactttcctactgcgagaaaggccatttggtatttcgaaggaatttatgcatactcccctcagataccaggtgttcgttttccaggattaactcatcctggtattgtgggaaccgcaccatcagtcgaacttcttaatatatggaatgaaagggagaaaagattggctgagacaagtccacatactcttaaactgtgtgaagtgttacaccagaggccccttgctaatttaccgacccctgagaactgcttacttggaaagattcaggaagggactgctgaatggcacaaaatggcaaatgaagcagccagaactattccaggaagggagaatggtggtaattgtgacataaaaaatctaagcagtggttccaaagtttatctaccagtatttgttgaaggagcaaaccttagcactggtgatatgcacttctcccagggtgatggtgaagtttctttttgtggagcaattgaaatgagtggattccttgagctcaagtgcgagatcataagaggggggatgaaggaatacttgcccccagttggtccgacaccactacatgtgaaccctatctttgagatcggtcctgttgagccacgtttctcggagtggttagtgtttgagggcataagtgtcgatgaatctgggcggcagcatttccttgatgcatcagttgcttataagcgtgcagtcctgaatgccattgagtacctttccagatttgggtactccaaggagcaggtgtatctcttactatcatgctgtccttgtgagggtaggatctctggaatagtagactctcctaatgcagtggcaactcttgccatccctacagcaatatttgatcaggatataaggccaaagcacttgagaggaaggctgagaccaaaattgataagacttccagatctcctgagctgctcaaacaatggtcttcctgtcacccaagaccaaagtagtacaagggcgccctaggggcatatatgatctgtaaattgatgccgtatccttctactttatacacaaaaataatcatcttgatatttccaacttccaaggatcatcatgtacttgacctggaatccataatgtagacctttgatttgtcaggcagtcatcatgtatgaggacagagacacctgagtggtgccatattgtctgtgtctgtattgctacaaagttgtgcattaattttactctctagaaatttccttatttgggttcgtgatcttgtcgatgtcatgctgagaggagagtggtactatggtcataggctcagctcgagaaatgacttcacactttcgttaaaaaaagaaaaagaaatgacttcacacataagtatgtagctagcagtgaagtgaggatggtataatatgaaagaaccaggcagctggcagtggctggagcgaagtagcagttgtgacagattcactctaccttgcacataactgttaaaccaacacacactgttaatccagtactagcatactatagacagatgctgctgaactcctgaaaaggcctctgcaggctgaagaagtcctaaagcgggtgaagaaatgagtttggcaaatgacaaatgatgctggttgtagccttaggatgatgttagaggacacgtgacaactcagagaactatatatgagtggtggatatttgatggaatgagcattgtggagttgtggttcagtcaatctgtactgttgccctttctttcactaccagctagatcacgaatggtttggaagctgaacacacactttatgacatttaaaaggttaataagatgaagcatctttgtgata

SEQ ID NO: 815 - DNA, 1650 bp, Panicum virgatum
ccaagttggtaggtacttggtactgctgtggaacaagaaaatatctaccatcctagctcttcatggtctacggagtagtgcgggaccagaaagaaacttcttatctgatggtgactcagttatgtaaagaagctccaaacacatgatattgttgccaggtgcacaaagcttccaactgggcgaagctcttgaggagatactgttacgaaacatggctcctctgactccaagagtggtagtgcccatagatgtgaaaaagcagccatgggagcaaaagattcctctccataaccgctggcatccagatatccctcctgttgctgatgtaactgaaggagaattgttccgcgttgagatggttgattggactggagggcgggttagggatgacaactctgcagatgatatcaaattccttgatctcacaattactcattatcttagtgggcccctaagaatagttgattctgaagggcttccagcttcacctggtgatcttcttgcagtagagatctgcaaccttggtccacttcctggtgatgagtggggttatactgcaatatttgaaatggagaatggaggtggattcttaactgaccactttcctagcgcaagaaaggccatttggtattttgaaggaatttatgcatattcccctcagataccaggtgttcgttttccaggattaactcatcctggtatagtaggaactgcaccatctgttgaacttcttaatatatggaatgaaagggagaaaaagttggctgagacaagtccagagactcttaaagtgtgtgaagttctacaccagaggccccttgctaatttaccgacccctgagaactgcttacttggaaagattcagaaagagacagctgtatggcacaaagtggcgaatgaagcagccagaactattcctggaagggagaatggtgggaattgtgacataaagaatctaagcagaggttccaaagtttatctaccagtatttgttgaaggagcaaatcttagtactggtgatatgcacttctcccagggcgatggtgaagtgtcattttgtggtgcaattgaaatgagcggattccttgagctcaagtgtgagatcataagaggtgggatgaaagaatacttgaccccagttggtccaacgccactacatgtgaatcctatctttgagataggtcctgtcgagccacgtttctcagagtggttagtatttgagggcatcagtgtggatgagtctgggaagcagcatttccttgacgcatcagttgcctacaaacgtgcagttctgaatgccatcgagtacctttccaaatttgggtactccaaggagcaggtatatctcttactatcatgctgtccatgtgagggtaggatatccggaatagtagattctcctaatgcagtggcaactcttgccattcctacagcaatattcgaccaggatataaggccaaaacacctgagagggagaccaggaccaaaattgataagacttccagatcttctgagctgctcaactgatggacaccttcctgtcatccaagaccaaagtggtagaagtgaaccctagagatgaatatgatctagaaattgatgagtatccttctacttatacatataaataatcatctttattgttccaaa

SEQ ID NO: 816 - DNA, 1804 bp, Panicum virgatum
ggttacttatttaaaaatattaactggatccactgctcatattgcagtgttcttccaaagcagatttatgtttgaaaccatattttcctgagattctttttcgtcttattgtctttatcttttagcatgacccatcaatatgtatatcttaccatcataaaggtgcacaaagcttccaactggacgaagctcttgaggagatactgttacgaaacatggctcctctgactccaagagtggtagtgcccatagatgtgaaaaagcagccatgggagcaaaagattcctctccataaccgctggcatccagatatccctcctgttgctgatgtaactgaaggagaattgttccgcgttgagatggttgattggactggagggcgggttagggatgacaactctgcagatgatatcaaattccttgatctcacaattactcattatcttagtgggcccctaagaatagttgattctgaagggcttccagcttcacctggtgatcttcttgcagtagagatctgcaaccttggtccacttcctggtgatgagtggggttatactgcaatatttgaaagggagaatggaggtggattcttaactgaccactttcctagcgcaagaaaggccatttggtattttgaaggaatttatgcatattcccctcagataccaggtgttcgttttccaggattaactcatcctggtatagtaggaactgcaccatcaattgaacttcttaatatatggaatgaaagggagaaaaagttggctgagacaagtccagagactcttaaagtgtgtgaagtcctacaccagagaccccttgctaatttgccgacccctgagaactgcttacttggaaagattcagaaagagacggctgaatggcacaaaatggcaaatgaagcagccagaactattcctggaagggagaatggtgggaattgtgacataaagaatctaagcagaggttccaaagtttatctaccagtatttgttgaaggagcaaatcttagtactggtgatatgcacttctcccagggcgatggtgaagtttcattttgtggcgcaattgaaatgagtggattccttgagctcaagtgtgagatcataagaggtgggatgaaagaatacttgaccccagttggtccaacgccactacatgtgaatcctatctttgagataggtcctgtggagccacatttctcagagtggttagtatttgagggcatcagtgtggatgagtatgggaagcagcatttccttgatgcatcagttgcctacaaacgtgcagttctgaatgccatcgagtacctttccaaatttgggtactccaaggagcaggtatatctcttactatcatgctgtccatgtgagggtaggatatccggaatagtagattctcctaatgctgtggcaactcttgccattcctacagcaatattcgaccaggatataaggccaaaacacctgagagggagaccaggaccaaaattgataagacttccagatcttctgagctgctcaaatgatggacaccttcctctcacccaagaccaaagtggtagaagtgaaccctagagatgaatatgatccagaaattgatgagtatccttctgcttatacatataaataatcatctttattgttccaacttccaagaatcatctatgtatgtggcctggaatccagaatgtagatctttaattgtcaggcaatcatcatgtatgaggatagagacacctgagtggtgccatattttcgatattactacaaagttgtgctatgagtaatgttaataattt

SEQ ID NO: 817 - DNA, 1443 bp, Pennisetum glaucum
agatactgttacaaacatggctcctctgactccaagactggtagtgcccatagatgtaaagaagaagccatgggaacaaaagatccctctccataaccgctggcatccaaatatccctcctgttgctgatgtaactgaaggagaattgttccgtgttgagatggttgattggactggagggcggattagggatgataactctgctgatgatatcaaatttctggatctcacaattactcattatcttagtggccccctaagaatagttgattctgaaggggttccagcttctcctggtgatcttcttgtagtagagatctgcaatcttggtccacttcctggcgatgagtggggttatactgcaatactcgagagggagaatggtggtggattcttaacagaccacttcccgagcgcaaggaaagccatttggtattttgaaggaatttatgcatactcccctcagataccaggtgttcgttttccaggattaactcatcctggtgtagtaggaactgcaccatcagttgaacttcttaatatatggaatgaaagggagaaaatattggctgagacaagtccagagactcttagagtgtgtgaagtcctacaccaaaggccccttgctaatttaccgacacctgagaactgcttacttggaaagattcaggaagggacagctgaatggcacaaaatggcaaatgaagcagccagaactattcctggaagagagaatggtgggaactgtgacataaagaatctaagcagaggttccaaagtttatcttccagtatttgttgaaggagccaatcttagtactggtgatatgcacttctcccagggtgatggtgaagtttcattctgtggtgcaattgaaatgagtggattccttgagctcaagtgtgagatcataagaggtgggatgaaggaatacatgaccccagttggtccaacaccactacatgtaaatcctatcttcgagataggtcctgttgagccacgcttctctgagtggttagtgttcgaaggcatcagtgtggatgagtctgggaagcagcatttccttgatgcatcagttgcctacaagcgtgcagttctgaatgccattgagtacctttccagatttgggtactccaaggagcaggtatatctcttattatcatgctgtccatgtgagggtaggatatccggaatagtagactctcctaatgcagtggcaactcttgccatccctatagcaatatttgaccaggatataaggccaaaacacttgagaggaagaccaggaccaaaactgataagacttccagatcttttgagctgctcaaatggtggacaccttcctgtcacccaagaccaaagttgtggaagtgtaccctagagatgcatatgatctagaaatttatgagtatcgttctatttatacatataataatcatcttt

SEQ ID NO: 818 - DNA, 2045 bp, Panicum virgatum
attggttacttctttaaaaatattattattaactggatccactgctcatatttcactgttcttcccaagcagatttatgtttgaaaccatattttcgtgagattcctttttgtcttattgtttttatctgttagcatgactcatcaatatgtatatcctaccatcataaaggtgcacaaagcttccaacgggacgaagctcttgaggagatactgttacaaaacatggctcctctgaccccaagactggtaattcccatagatgtgaagaagcagccatgggagcaaaaggtccctctccataaccgctggcatccagatatccctcctgttgctgatgtaactgaaggggaattgtttcgcgtcgagatggttgattggactggagggcgggttagggatgataactctgcagatgatatcaaattccttgatctcacaattactcattatcttagtgggcccctaagaatagttgattctgaagggcttccagcttcacctggtgatcttcttgcagtagagatctgcaaccttggtccacttcctggcgatgagtggggttatactgcaatatttgaaagggaaaatagaggtggattcttaactgaccactttcctagtgcaagaaaggccatttggtattttgaaggaatttatgcatattcccctcagataccaggtgttcgttttccaggattaactcatcctggtatagtaggaactgcaccatcaattgaacttcttaatatatggaatgaaagggagaaaaagttggctgagacaagtccagagactcttaaagtgtgtgaagtcctacaccagagaccccttgctaatttgccgacccctgagaactgcttacttggaaagattcagaaagagatggctgaatggcacaaaatggcaaatgaagcagccagaactattcctggaagggagaatggtgggaattgtgacataaagaatctaagcagaggttccaaagtttatctaccagtatttgttgaaggagcaaatcttagtactggtgatatgcacttctcccagggtgatggtgaagtttcattttgtggcgcaattgaaatgagtggattccttgagctcaagtgtgagatcataagaggtgggatgaaagaatacttgaccccagttggtccaacgccactacatgtgaatcctatctttgagataggtcctgtggagccacatttctcagagtggttagtatttgagggcatcagtgtggatgagtatgggaagcagcatttccttgatgcatcagttgcctacaaacgtgcagttctgaatgccatcgagtacctttccaaatttgggtactccaaggagcaggcatatcttttactttcgtgctgcccttgcgagggtaggatatctggaatagtagattctcctaacgcagtgacaactcttgccatccctacagcaatatttgaccaggatataaaaccaaaacgcttgagcgggagaccacttcgaggaccaaaattgagaaggcttccggatcttctgagctgctcaaacagtgaacaccttcctgtcacccaaggccaaagtggcactagagagccctagtgatgaatgcgatctagaaactgaagcaatccatttacttgtggatgcaaataaatcatatgtattttttcacctttcgtacaatcatctgtgtgcgtagcctggagccctggaataagaaacgcagatctttaatttgtcaagcaatcatcatgtgtcagagcgaagtttctttgcttttcgtaattgggagccacgtccttctcactgtgactgaatgtgctgcctgtctggatcgttctctggatgtctgaaactgtcagctgatggttcctgagtgttatgctggagaactgcattggtccatttttcctgtgagaccacatggtccctcgttttgccagcaaatgtagcaatatcatgttgtcctctgtatatgaaagatgcaccatcatgttcagctaacttgtaagatcccctatgccatagtatatattgtcaaacagtcaa

SEQ ID NO: 819 - DNA, 1326 bp, Hordeum vulgare
atgcatgtatgtaggaaggatgccttacaaagggatggagctctgacgctggcataacaaagagatggctcctctcactcccaggcttgtagtgcccatagatgtgaagaagaagccatgggagcaagaggttcctctccacaaccgctggcacccggatatccctccggttgctgatgtgactcaaggggaattattccgtgttgagatggtcgatgccacaggagggcaggttagagatgatgactcggcggatgatatcaaatctctggatttcgcagcgcctcactatctcagtggcccccttagagtggtcgatgccgaaggggttccagcttcacctggtgatcttcttgcagtggagatctgcaacctcggcccgcttcccggtgacgagtggggctatactgggatatttgaaagggagcatggaggcggcttcttaaccgaccacttcccgagtgcaagaaaagccatttggtattttgaaggaatttacgcgtactccccttagataccaggtgttcggtttccggggttacctcatcctggtatagtgggaactgcaccgtcagccgaccttcttgacatatggaaccaaagggaacgagaattggtcgaggcgggtcatgagcctctgaaattgtgtcaagttctacaccagagaccccttgctagcttaccaacctccgagaactgcttacttgggaagatgcaagaagggagtgctgaatgggaaaaaattgcaagtgaagcagcaagaacgattcctggaagagagaatgggggtaactgcgacataaagaatctaagcagaggttccaaagtttatctaccagtatttgttgaaggagcaaatttgagtactggtgatatgcacttctcccaaggtgatggcgaaatctcattttgtggagcaatagaaatgagtgggttccttgagctaaagtgtgagatcataagaggtgggatgaaggaatacttgactcctgttggtccaacaccacttcatgtgaatcctatctttgagataggtccagtggagccacgtttctcggaatggttagtcttcgagggcatcagcgtggatgagtcggggaaacaacatttccttgatgcatcagttgcctacaagcgtgcagttctcaacgccattgagtacctttctagatttgggtgctccaaggagcaggtctatattttactgtcatgttgtccatgtgaaggtaggatatctggaatagtagacgcccctaatgcagtggtgacacttgccatccctacatcgatattcgatcaggtatcctacaatagccccaacacact

SEQ ID NO: 820 - DNA, 1690 bp, Pennisetum glaucum
ggagatactgtactgaaacatggctcctctgacctcaagattagtagtccccatagatgtgaagaagcagccatgggagcaaaaggtccctctccataaccgctggcatccagatatccctcctgttgctgatgtaactgaaggggaattgttccgtgttgagatggttgattggagtggaggacgggttagggatgataactctgcagatgatatgaaatccatggatttcacaattgctcattatcttagtggtccgctaaggatagtcgattctgaaggggttccagcttctcctggtgatcttctagcagtagagatctgcaaccttgggccacttcctggcgatgagtggggttatactgcaatactcgagagggagaatggtggtggattcttaacagaccacttcccgagcgcaaggaaagccatttggtattttgaaggaatttatgcatactcccctcagataccaggtgttcgttttccaggattaactcatcctggtgtagtaggaactgcaccatcagttgaacttcttaatatatggaatgaaagggagaaaagattggctgagacaaaccaagagacctttaaactgtgtgaagtcctgcaccagaggccccttgctcatttaccgaccccggagaactgcttacttgggaagattcaagaaggaactgctggatgggacaaaattgcaaatgaagcagctagaaccattgctgggagggagaatggtgggaattgtgacataaagaatctaagcagaggttcaaaagtttatctaccggtatttgttgaaggagcaaatcttagtactggtgatatgcacttctcccagggtgatggcgaaatttcattgtgtggagcaattgaaatgagcggattcctggagctcaagtgtgagatcataagaggtggaatgaaggaatacttaaccccagttggtccaacaccatttcatgtgaatcctatctttgagataggtcctgtcgagccacgtttctcagagtggttagtgtttgagggcatcagtgtggatgagtctgggaagcaacatttccttgatgcatcagtttcctacaagcgtgcagttctgaatgccattgagtacctttccaaatttgggtactccaaggagcaggtatatcttttactatcctgctgcccttgcgagggtaggatatcaggaatagtagacgctcctaacgcagtggcaactctggccatccctacagcaatatttgaccaggatataaaaccaaaacgcttgagcgggagaccacttccaggaccgaaattgagaaggcttccagatcttctgagctgctcagaagatggacacctgcgtgtcactcaaggaaagagtggcacaagagcgccatagtagtgaatatgatctagaaactgatgcaggatccatgcacatttgcatataaataatcatatgcatgttttccacctttcctacaagtatgtgcgtagcctggaataagaaaaattgcagatctttggatttttctggcaatcatcatatatgagagtgaagttcttgctttttgtaattgggagtcaggtacttgtctctgtcaaatgttaagtgcggctgatggtcgtttctggtcaaatattgctgtagggatggccgtttctgtaattgggagtcaggtacttgtatctgtcaaat

SEQ ID NO: 821 - DNA, 1790 bp, Sorghum bicolor
aaagtagcgaaagtgctacggtaccgaaatccgaaatcttttcggaactaaacaaggccttatagtgattgacttgatactgacttagaactccaaacacctgtttttaccattagcagattcatcaacatgcctatcctaccattataaagagctgcacaaagcttccaaagggaagaagctcttgaggagatactgtaagaaacatggctcctctgactcctagactggtagtgcccatagatgtcaagaagcagccatgggagcaaaaggtccctctccacaaccgctggcatccggatatccctcctgttgctgatgtaaccgaaggggaattgttccgtgtcgagatggtggattggagtggagggcgggttagggatgataactctgcagacgatctgaaattcatggatttcacagttgctcattatcttagtgggccactaaggatagttgattctgaaggggttccagcttcaccaggtgatcttctcgcggtagagatctgcaaccttggcccacttcctggcgacgagtggggttatactgcaatacttgaaagggagaatggaggtggattcttaactgaccacttccctagcacaagaaaagccatttggtatttcgaaggaatttacgcatactcccctcagataccaggtgttcgttttcctggaataactcatcctggtgtagtgggaactgcaccatcagttgagcttcttaatatatggaatgaaagagaaaaaagattgtctgagacaaggccagagactcttacactgtgtgaagttctacaccagaggccccttgttcctttaccgactcctgacaattgcttacttgggaaggtccaagaagggactgctgaatggcacaaaattgcaaatgaagcagccagaactattgctggaagggaaaatggagggaattgtgacataaagaatctaagtagaggctccaaagtttatctaccagtatttgttgaaggagcaaatcttagcactggtgatatgcacttctcccagggcgatggtgaaatttcgttgtgtggagcaattgaaatgagtggattccttgagctcaagtgtgagatcataagaggtgggatgaaggaatacttaaccccagttggtccaacaccacttcatgtgagccctatctttgagataggtcctgttgagccacgtttctcagagtggttggtgtttgagggcatcagtgtagatgagtctgggaagcagcattttcttgatgcatctgttgcctacaaacgtgcagttctgaatgccattgagtacctttccaaatttgggtactctaaggagcaggtatatcttttactatcatgctgcccatgcgagggtaggatatctggaatagtggactctcctaatgcagtaacaactcttgccatccctacggcgatatttgaccaggatataaagccaaaacgcatgaacgggagaccacttggaggaccacaattgagaagacttccagatcttctaagctgctcaaatgatggacaccttcctgccacccaagataaaagtggtacaagtgcgccctagtacatgaagaaacagacccactatcaatcgacatgtaattgtgcatggaaacaattatctgtgtggattactcaaaaaaacaattatctgtgtgcgcagcctataatcaagaatggatttgtcttttattttcttcgtctaataaaaattacggcaaaacttttgccctcctttgaaaaaataataaaaatgcagatctttgatttgtcaggt

SEQ ID NO: 822 - DNA, 1616 bp, Zea mays
cagattcattaacatgcctatcctaccactataaaggtacacaaagcttccgaagggaagaagctcttgagaagatactgcaatgatggctcctctgtctcctagactggtagtgcccgtagacgtgaagaagctgccgcgggagcaaaaggtccctctccacaaccgctggcacccggatatccctcctgttgctgatgtaaccgaaggggaattgttccgcgttgagatggtcgattggagtggagggcgggttagggatgataactctgcagatgatctgaaattcatggatttcacaattgctcattatcttagtgggcccctaagaatagttgattctgaaggggttccagcttcaccaggtgatcttctcgcggtagaaatctgcaaccttggcccacttcctggcgacgagtggggttacaccgcaatacttgaaagggagaatggaggtggattcttaactgaccacttccctagcgcaagaaaagccatctggtatttcgaaggaatttacgcatgctccccgcagataccaggtgttcgttttccaggattgactcatcctggtgttgtgggaactgcaccgtcacttgagctcctaaatatatggaatgaaagagagaaaagtttgtctgagacaagcctagagactattaaactgtgtgaagttctacaccagaggccccttgctcatttaccgacccctgaaaattgcttacttgggaaggtccaagaagggactgctgaatggcacataattgcaaacgaagcggccagaactattgctggaagggaaaatggcgggaattgcgacataaagaacctaagcagaggctccagaatttatctaccagtgtttgtcgaaggagcaaacctcagcactggtgacatgcacttctcccagggggacggcgagatttcgctgtgtggagcaattgaaatgagcgggttccttgagctcaagtgtgagatcataagaggtgggatgaaggaatacttgactccagttggtccaacaccactccatgtgagccccatctttgagataggtcctgtggagccacgtttctcggagtggttagtgtttgagggcatcagcgtagatgagtctgggaagcaacattttcttgacgcatctgtggcctacaagcgtgcagttctgaacgccattgagtacctttccaagttcgggtactctaaggagcaggtgtatcttttactatcatgctgcccatgcgagggtaggatatctggaatagtggactctcctaatgctgtaacaactcttgccatccctacagcgatatttgatcaggatataaagccaaaacgcgtgaaggggagaccacttggaggaccacagttgagaagacttccagatcttctaagctgctcaaatcatggacgccttcctgccacccaagacagaagtggtacaagcgcgccctagtatatggaaacagatgcagtatcaatcgacatgcaactgtgccaaggctataatcaagaatgcgtttgtctttttttttttattttcttcgtctaataaaaattacgataaagcttttgccgttctttagaaaaaaataatcaagaattatcctcgattc

SEQ ID NO: 823 - DNA, 1534 bp, Panicum virgatum
tggtagtgcccatagacgtgaagaagcacccatgggagcaaaaggtccctctccataaccgctggcatccagatatccctcctgttgctgatgtaactgaaggggaatttttccgtattgagatggtcgactggagtggaggacgggtcaaggatgataactctgcagatgatatgaaatccatggacttcacaattgctcattatcttagtgggccgctaagaatagtcgattctgaaggggttccagcttcacctggtgatcttctagcagtagagatctgcaatcttggaccacttcctggcgatgagtggggttatactgcaatactcgaaagggagaatggtggtggattcttaactgaccacttccctagtgcgagaaaagccatttggtatttcgaaggaatttatgcatactcccctcagataccaggtgttcgttttccaggattaactcatcctggtgtagtgggaactgcaccatcagttgaacttcttaatatatggaatgaaagggagaaaagattggctgagacaaaccaagagactcttaaactgtgtgaagttctacaccagaggccccttgctcatttaccgaccgcagagaactgcttacttgggaagatccgagaagggactgctgaatggcacaaaattgcaaacgaagcagctagaactattcctggaagagagaatggtgggaattgtgacataaagaatctaagcagaggttcaaaagtttatctaccagtatttgtcgaaggagcaaatcttagtactggtgatatgcacttctcccagggagatggtgaaatttcattgtgtggggcaattgaaatgagcggattccttgagctgaggtgtgagatcataagaggtgggatgaaggaatacttaaccccagttggtccaacaccacttcacgtgaatcctatctttgagataggtcctgttgagccacgtttctcagagtggttagtgtttgagggcatcagcgtcgatgagtctgggaagcagcatttccttgatgcatcagttgcctacaaacgtgcagttctgaatgccattgagtacctttccaaatttgggtactcaaaggagcaggcatatcttttactttcgtgctgcccttgcgagggtaggatatctggaatagtagactctcctaacgcagtgacaactcttgccatccctacagcaatatttgaccaggatataaaaccaaaacgcttgagcgagagaccacttccaggaccaaaattgagaaggcttccggatcttttgagctgctcaaacaatggacaacttccagtgacccaaggccaaagtggcactagagcgccctagtgataatgcgatctagaaactgatgcaatgcatttacctgtggatacaaataaatcatatgtattttttttcacctttcgtacaatcatctgtgtgcgtagcctggaataagaaacgcagatctttaatttgtcaggcaatcatcatgtgtgagagtgagagcaagttttttgcttttcgtagaa

SEQ ID NO: 824 - DNA, 1522 bp, Elaeis guineensis
catggctccaaaaactccaagactggttgtgcccatagatgtgaagaaaaagccatgggaacaaaagcttcccctccataatcgctggcaccctcacatacctcctgttgcagatgtaacggaaggggaaatctttcgagttgagatggtagatgctaatggtggtcaagttggcgataacgactccactgcagacatcaaatttgcaaacctcactggtggccattatcttagtgggccgttaagagttatagataccaaaggagtttcagcgaagcctggtgaccttcttgctgtcgaaatctgcaacctaggtccacttccaggtgatgaatggggttatacagcatcgtttgatagagaaaacggtggtggcttcttaactgaccacttcccttctgcaacaaaagcaatttggtattttgaaggaatatacgcatactcccctcatattccaggtgttcgctttccaggtttagctcaccctggggtagttggaactgcgccttcacctgaacttttgtctatttggaatgaaagggaaaagaaattagcagaagagggccctgggtctgtaacattatgtgaagtcgtgcatcaacggccacttgtaagcctaccgactgcaaagaattgccttcttggattgattgaagaaggaacaccagaatgggaaaggattgcaaacgaggctgcaaggacagtccctggaagggaaaatggaggcaattgcgacatcaaaaatcttagtaggggttcaaaggtatatcttccagtatttgtagatggagcaaatcttagtacaggggatatgcacttctctcaaggtgatggtgaagtttcattttgcggagcaatagagatgagtggattccttgagctcaagtgtgagatcataagaggaggaatgagagagtatctgacacccatgggccccaccccactacatgtaagcccaatctttgagatagggcctgtggagcctaggttctcagagtggttagtctttgagggcatcagtgtggatgaggctgggcggcagcactacctagatgccacagttgcctataagcgtgctgtcctcaatgccatcgactacctctcaaaatttggttactccaaagagcaggtttatctactactgtcttgctgcccttgtgaagggaggatttcaggaattgtggactcacccaatgctgttgcaacacttgccatcccaactgccatttttgatcaggacatacgaccaaagtctggaaaagtaccggtaggaccgcaaattgtgaagagaacaccagatgtcctaaagtacacatatgatggaaatttgcccatcacaccaaacccaggggcagcagtaagtcgacttagtgatgattgaggatgtagttttgtagcattttgtggtttgaagatagctcttgttacggctcttagcgctactatatagatcttcctagtctggacatatttctcttacggtaaacgtatttaatctctgttatggatctatggtagttgt

SEQ ID NO: 825 - DNA, 1509 bp, Mimulus guttatus
agaaatcccaaaaaaatcaagaaatcatggccccttcaactccaagattagtaatccctgtagacctaaagaagaagccatggcagcagaatccgccgctccacaaccggtggcaccccgacattccggcggtggcggaggtaaaaaccggcgaactattcagggtggagatggtggattggacaggtggcaccatttcagatgaccattctgcacttgatgtaaaaaccttagacctatcaattgttcattatcttagtgggcccattagagtggttgataccgatggaaacccggcccggcccggtgatcttttggcggttgagatatgcaatttgggtcctttgcccggagacgaatggggtttcactgcgattttcgatagggaaaatggtggtggattcctcaccgaccatttcccttgtgctaccaaagctatttggtattttgaaggaatatacgcgtattctcctcatatacctggtgtgagatttccgggattgacgcaccccggaatagttggaaccgcgccttcgatggaactactcaatatatggaacgagagggaaagggaactcgaagaaaccggtcttcaaacactaaagctatgcgaggttttgcattcacggcccttggcgaatctcccatcaaccaagggttgcgttcttggcaagattaaagaaggaagtcttgaatgggaaaaagttgcgagggaggctgcgagaactatacccggaagagaaaatggaggaaactgcgacatcaagaatctaagcagaggctcaaaagtgtaccttcccgtatttgttgacggggcgaatcttagtactggggatatgcatttctcgcaaggtgatggtgaagtggcgttttgtggggccattgagatgagcggttttctcgagctcaagtgtgagataataagggatggcatgaagaagtacttgactccaatgggtcccactcgtttacacgtgaacccaatctttgagataggtcccgtcgagccgagattctcggagtggttggttttcgagggcatcagtgtcgacgagagtggacgacaacactacctcgacgccagcgtggcatacaagcgcgcagttctcaatgcgatcgactatctctctagattcggatactctaaagaacaggtttatcttctactctcgtgttgcccgtgcgaaggaaggatttcgggtatagtggattcgcccaatgccgttgccacacttgccattccaattgctatatttgatcaggatattcgtccgaaaatcgggagtgtgcccacaggaccaaggcttgtgaggaataatccagtgctcccacagtgcacctatgatggaaatttgcctattaccaaaaacccctctgcttcaatctgatatatgtctagtctatttacataaattaaataaataaatgtgaacaaacttattatgtaccagattttatgcaactaaaactcattatgtgcagtattatcagtctattaataattaatcc

SEQ ID NO: 826 - DNA, 1599 bp, Mimulus guttatus
agaaatcccaaaaaaatcaagaaatcatggccccttcaactccaagattagtaatccctgtagacctaaagaagaagccatggcagcagaatccgccgctccacaaccggtggcaccccgacattccggcggtggcggaggtaaaaaccggcgaactattcagggtggagatggtggattggacaggtggcaccatttcagatgaccattctgcacttgatgtaaaaaccttagacctatcaattgttcattatcttagtgggcccattagagtggttgataccgatggaaacccggcccggcccggtgatcttttggcggttgagatatgcaatttgggtcctttgcccggagacgaatggggtttcactgcgattttcgatagggaaaatggtggtggattcctcaccgaccatttcccttgtgctaccaaagctatttggtattttgaaggaatatacgcgtattctcctcatatacctggtgtgagatttccgggattgacgcaccccggaatagttggaaccgcgccttcgatggaactactcaatatatggaacgagagggaaagggaactcgaagaaaccggtcttcaaacactaaagctatgcgaggttttgcattcacggcccttggcgaatctcccatcaaccaagggttgcgttcttggcaagattaaagaaggaagtcttgaatgggaaaaagttgcgagggaggctgcgagaactatacccggaagagaaaatggaggaaactgcgacatcaagaatctaagcagaggctcaaaagtgtaccttcccgtatttgttgacggggcgaatcttagtactggggatatgcatttctcgcaaggtgatggtgaagtggcgttttgtggggccattgagatgagcggttttctcgagctcaagtgtgagataataagggatggcatgaagaagtacttgactccaatgggtcccactcgtttacacgtgaacccaatctttgagataggtcccgtcgagccgagattctcggagtggttggttttcgagggcatcagtgtcgacgagagtggacgacaacactacctcgacgccagcgtggcatacaagcgcgcagttctcaatgcgatcgactatctctctagattcggatactctaaagaacaggtttatcttctactctcgtgttgcccgtgcgaaggaaggatttcgggtatagtggattcgcccaatgccgttgccacacttgccattccaattgctatatttgatcaggatattcgtccgaaaatcgggagtgtgcccacaggaccaaggcttgtgaggaataatccagtgctcccacagtgcacctatgatggaaatttgcctattaccaaaaacccctctgcttcaatctgatatatgtctagtctatttacataaattaaataaataaatgtgaacaaacttattatgtaccagattttatgcaactaaaactcattatgtgcagtattatcagtctattaataattaatccaaatttaattattaaatttcaagacttgtaaccattatttgctcagaatattttataaaccacaacaaaaataaaaattatttattctaa

SEQ ID NO: 827 - DNA, 1955 bp, Phalaenopsis aphrodite
acaagctcagtaatggctcctcgtagccccaggttagtagtgccgatcgatcccaataagaagccatggcagcagaggcaccctctccacaaccgctggcatcctcacatacccccagttgcagatgtaacagagttagaggtatttcgggtcgagatgatggactggacgggcggagctgtcgccgataatgattcagccatggacatcaaatctttggatctcaccattacgcattatcttagcgggccgataagagtttcagacgagggaggaataccagcaaagccgggtgatcttcttgcgatcgaaatctgtgacttaggtcctcttcctggacatgagtggggttacacagcaacattcgacagagaaaatggaggcggatttttgacggaccacttccccaatgcaacaaaagctatctggtactttgaaggaatatatgcatactccccacagataccaggtgtgcgctttcctggtctaattcacccaggaattgtggggactgcgccatcccttgaacttctgaatatttggaatggaagggagaagaagttggctgaaaatggtcccaattctcttaagatatgcgaagttgtgcaccagagaccgctggcaaacctaccaacagccagaaattgcctccttggaaagattaacgaaggaacagctgaatgggaaagaattgcaaatgaggctgcaagaacaatcccaggaagggaaaacggaggaaattgtgacatcaagaatctaagcagaggttcaaaaatatatcttccagtttttgtggaaggtgcaaacctcagtacaggtgacatgcacttctctcaaggtgatggtgaagtttcattttgtggagcaatagagatgggtggtttcctagagctcaagtgcgagatcataaggggcgggatgaaggaatacctatccccaatggggccaaccacgctgcacgtgaatccgatcttcgagatcggcccagtggagcctcgattctccgaatggttggtgttcgagggcatcagcgtagacgagagcggacggcagcatttcatggacgccacagtggcctacaagcgcgccgtgctgaacgccattgattacatctccaagttcggctattcgaaggagcaggcatacctcctcctctcttgctgtccctgtgagggccgtatctcctgcatcgttcacattcccaatgccgtcgccacctttgctatccccgtcgccattttcgaccaggatatacggccaaaagataggaagttggtggggcccagaattctgaagcagcttccagatgtcatccgatgttggtatgataggaactcgggtagcttcccgtcactcccaaccccagcaaaataataaagaaatttaactattaactttggattcagctcgcgcttctcttgccttcacgccggcgacggtgattgcgatcagaagtcgctcacgaagctctgtagtcttgtcaatctctgtagactactgaatccttgttaaggctctaatggcgaccgtgccggttaacccgaagccattcctgaacaatctgactgggaaacctgtgattgtgaaactgaaatggggaatggaatacaaaggttttcttgtttcagttgattcctacatgaacttgcagcttgctaacaccgaagaatatattgatggcgagttctcaggaaatctcggtgagatacttataaggtgtaacaacgtactttatcttcgaggcgtgcccgaagacgaagaaattgaagacgctgattaagattgagctgagtgttttgaatataggaagattattctgctgctataacttcttattttgatagatttgagctagaaccctaattttatcactttactctatttttttcagcacatgttttggatgaaatgataaaactttgtgggtaatttttatatgaatttgataaagatta

SEQ ID NO: 828 - DNA, 1865 bp, Vitis vinifera
aatgagtggcttaactttacactcacccttcttatagactgttgctgaaacaaacccccaactgtcttgaaagttcaatcggctcatatgagggccgtgggtggtggtgctgctggtgggtgtggtggtccatccactgaaagcagctctaaggtaccaataatggttgtcaaagttccatcaagaaaatgaaagcctagctgcatcacttcacccactacaacgaatctcccctttatctacttgtccttgccttcatctggagccaaattgaggaacagggcagagccatggcaaattatggtccgaggctggtggtgcccatagacgtgaagaaaaagccatgggagcagaaacttccgctgcataaccggtggcacccggagataccgccggtggatgaggttagatgtggagaggttttcagagttgagatggtggacttcagtgggggcggtattacaaaggactattctgcagaagatatcaaatatgctgatccctctattgttcattatctcagtgggcctatcagagttctggatgtggatggagttccggccaagccaggagacctgcttgcagtcgaaatatgcaacttgggtcctctgcctggtgatgaatggggttacacggcaacgtttgatagagaaaacggtggcggttttttgaccgaccattttccttgtgcaaccaaagctatttggtatttcgaaggaatatatgcctactctccccacataccaggagtgagatttccaggcttaactcaccctggaatagttggaactgcaccatcaatggaacttctgaatatatggaatgagagagagagacaagtagaagaaaatggtctccagactctgaaactatgcgaggttctgcattcccggccattggcaaatcttccatcaaccaaaggctgccatcttggaaagatccaaaagggaactcctgaatgggaaagaattgctagagaggctgcaaggactatcccaggaagggaaaatggaggaaactgtgacatcaagaatctcagtacaggttcaaaaatataccttccagtatttgtagatggagcaaatcttagtacaggggacatgcacttctcccagggagacggcgaagtttctttctgtggggcaattgagatgagtggtttcctggaactcaaatgtgaaatcataagaggcggaatgaaagagtaccttacaccaatgggacccactccccttcatgtaaaccctatcttcgaaatagggcctgttgaacccagattctcagaatggctggtttttgaaggcatcagtgttgatgagagtggaagacagcactaccttgatgcaagtgttgcttacaagcgtgcagtgctcaatgccattgactatctctccaaatttggctactccaaagaacagatgtatctactgttatcatgctgtccctgtgaaggaaggatttcaggaatagtggactcacccaatgctgttgcaacccttgcaatcccaacagccatctttgaccaggatattcgtccaaaaaccaaagtgccagttggaccccggttagtgaggaaaccagatgttctgagatgcacctatgatggaaatttgcccaccacaaagaacccagctgccacaatgtaactgctatcaaagtgagctaagtagaaggaggtggcctaatggaacacatattctatgggcaggacataaaaatgttgtaggagaacctttaccttctggtgagtaaaggaaaccaattgcataatgccagctaagttaataaatttagcaattgacgtttagtcaattataaaattttcatctacagtatttagctaataagctcctgttttaactaat

SEQ ID NO: 829 - DNA, 1752 bp, Citrus clementina
atcttaagcctgagcagagtcattggaaaaatttgtcccccaatttgtcagtcagctctcagctagcaagtatcccatccggacgtgtcgacttctttttctacaacaaaccgaaatttgattaatctaataaatcataaaaaatataagaatcttgaaactctctgaatcttcacagattcatccatggctccaacaaccccaacggtggtagtgccaatagacttgaagaagaaaccaaatgagcaaaagctaacccttcacaacagatggcacccggagatacctccggtggcagaagttaaagttggcgagcttttcagagtagagatggtagattggacggggggtgcgataaaagataatgattctgcaattgatgtgaaaaccttagacctctccactgtgcattatctcagcggaccgatcaaagttgtggatgaacaaggaattccagcgaagccaggtgatcttcttgcagttgaaatatgcaacttgggtcctctgcctggagatgaatggggttatacagcaacatttgatagagaaaatggaggtggttttttgactgatcatttcccttgtgcaaccaaagctatttggtactttgaaggaatttatgcctactctcctcacataacgggggtacgatttccaggtttaactcaccctggcataattggaactgcgccatcaatggaactcctgaagatatggaatgaaagggaaagagaacttgaagaaactggtcttcaatccctcaaattatgtgaggtcttgcatacgcgaccattggcaaaactaccattgaccgagggctgcttgcttggacaaatccaagaaggaactcctgaatggaaaaaaattgctatggaggctgcgaggacaattccaggaagagaaaatggaggaaattgtgacatcaaaaatctaagcagaggttcaaaaatataccttccagtattcgtggatggagcaaatcttagtaccggcgatatgcacttttctcagggtgatggtgaggtcacattctgtggggcaattgagatgagcggctttctagatctcaaatgcgaaatcatacgaggtggaatgaaagagtaccttacaccaatggggccaactcctcttcatgtaaatcctatctttgagataggtccagtcgagccaagattctcagaatggctagtatttgaagggatcagcgtggatgagagtggggggcagcactacttagatgccactgttgcttacaaacgtgcagtcctcaacgccattgactatctatctaaatttggctactccaaagaacaggtatatctgcttttatcatgctgtccgtgcgaaggaaggatctctgggatagttgactctcccaatgctgttgcaacccttgcagttccaacagcaatatttgatcaggatattcgtccgaaaagcagcaaggtgccagttggaccccggttagtgaggaaaccagatgttttaaaatgttcttatgaaggaaacttgcccactacagagaaccctggagccagaatataggctaaatcaaagcgtactaagatgaaaagaagcattttggatacagaatgggattcagaactggctatgctagcaacagattctttctttcttcttttgattaggtcttttgtcatttaaataaggcctaagttttcaattaggagtcaagactttgaactgtttgattatcattgaataaagtactttgatctctcatctccgtta

SEQ ID NO: 830 - DNA, 1643 bp, Gossypium hirsutum
cccaactctcaacccatagctatccaaaatgaagggtttcgggacctattgtttgtaattcaagacatgagccatggctcactatggtgcaaaggtagtggtgcctatagacctgaagaaaaagccatgggaacaaaaacatcccctccacaaccggtggcaccccgacataccagttgttgcagaggttaaagatggagaggttttcagagttgaaatggtggatttcagtggaggtggaataacaagtgactactctgccgaagatgtcaagcatgctgatcaatctattgttcattatctgagtgggcctataagagttgtagacaagaaggagacacctgccatgccaggtgatcttcttgcagtggaaatatgtaacctgggtcctttaccgggtgatgaatggggttatacagcaacttttgacagagaaaatggaggagggtttttgacggaccattttccatgtgcaacaaaagctatttggtattttgaaggaatctatgcctactctcctcatataccgggggtgagatttccggggttgactcatccgggaataattggaacggcaccatcaatggaacttctgaatatatggaatgaaagagaaagagaagtagaagaaaatggccacaagtccctaaaactatgtgaagttttgcattcacgaccattggcaaaccttccttcaaccaaaggctgccatttggggaagataaaaaaggggactgctgaatgggaaaagattgctaaggaggctgcgaggactattccaggaagagaaaatggtggaaattgtgacataaaaaaccttagtagaggttctaaaatatatcttcccgtgtttgttgaaggagctaaccttagcactggtgacatgcatttctctcaaggtgatggtgaagtctcattctgtggagcaattgagatgagtggttttcttgagcttaagtgtgaaattataagaggtggaatgaaagagtaccttactccaatggggccaacccctcttcatgtaaatccgatctttgagatcggaccagtggaaccgagattctcggaatggttggtttttgagggaataagcgtggatgagagtggaaggcaacatttccttgatgcaagtgttgcatataaacgtgcagtgctcaatgctatcgactacctctccaagttcgggtactcgaaagaacaggtttaccttctgctatcctgctgcccttgtgaaggaaggatctccggaattgtagatgcaccaaatgctgttgcaactcttgcaattccaactgccatcttcgaccaggacattcgtccaaaagccggaaaggtgccgatagggcctcggctagtgagaaaaccagatgttttaagatgcagttatgatggaaatcttcccacaacgaagaacccagctgcctcaatgtaacttaagtctacggagctaagaccaagaaactgcagtattgggttttcatttctatgccttgtgggacttttatacacatggaaacaactatggatgaacgacattaatgtaaataataaactccagcttctggacaagatcgaatccccgataggatgttatatgttttaagaacttatataagaacagctataaaagagccttcaatcta

SEQ ID NO: 831 - DNA, 1965 bp, Gossypium raimondii
taaaagaataaaaggtaaaaacccaatccaagcgttgggttggttcatttaagaaatataatcaaccatcatgtttttggtaaaggattggatggttctgtcaaatataccatgtattgaagcaaacctgagtcagataccacttgcattcacttccgtgattccaccaaatagccatctaataactgttactttgtcctagaagaaaatccaaggtaagttgtgaagtcagttccaagtggtccatccatcaaagcaaaaatatcccaactctcaacccatagctatccaaaatgaagggtttcgggacctattgtttgtaattcaagacatgagccatggctcactatggtgcaaaggtagtggtgcctatagacctgaagaaaaagccatgggaacaaaaacatcccctccacaaccggtggcaccccgacataccagttgttgcagaggttaaagatggagaggttttcagagttgaaatggtggatttcagtggaggtggaataacaagtgactactctgccgaagatgtcaagcatgctgatcaatctattgttcattatctgagtgggcctataagagttgtagacaagaaggagacacctgccatgccaggtgatcttcttgcagtggaaatatgtaacctgggtcctttaccgggtgatgaatggggttatacagcaacttttgacagagaaaatggaggagggtttttgacggaccattttccatgtgcaacaaaagctatttggtattttgaaggaatctatgcctactctcctcatataccgggggtgagatttccggggttgactcatccgggaataattggaacggcaccatcaatggaacttctgaatatatggaatgaaagagaaagagaagtagaagaaaatggccacaagtccctaaaactatgtgaagttttgcattcacgaccattggcaaaccttccttcaaccaaaggctgccatttggggaagataaaaaaggggactgctgaatgggaaaagattgctaaggaggctgcgaggactattccaggaagagaaaatggtggaaattgtgacataaaaaaccttagtagaggttctaaaatatatcttcccgtgtttgttgaaggagctaaccttagcaccggtgacatgcatttctctcaaggtgatggtgaagtctcattctgtggagcaattgagatgagtggttttcttgagcttaagtgtgaaattataagaggtggaatgaaagagtaccttactccaatggggccaacccctcttcatgtaaatccgatctttgagatcggaccagtggaaccgagattctcggaatggttggtttttgagggaataagcgtggatgagagtggaaggcaacatttccttgatgcaagtgttgcatataaacgtgcagtgctcaatgctatcgactacctctccaagttcgggtactcgaaagaacaggtttaccttcttctatcctgctgcccttgtgaaggaaggatctccggaattgtagatgcaccaaatgctgttgcaactcttgcaattccaactgctatcttcgaccaggacattcgtccaaaagccggaaaggtgccgatagggcctcggctagtgagaaaaccagatgttttaagatgcagttatgatggaaatcttcccacaacgaagaacccagctgcctcaatgtaacttaagtctacggaactaagaccaagaaactgcaatattgggttttcatttctatgccttgtggaacttttatacacatggaaacaactatggatgaacgacattaatgtaaataataaactccagcttctggacaagatcgtatcctcgataggatgttatatgttttaagaacttatgtaagaacagctataaaagagccttcaatctatgcgcatatacatacacattgaaatgctagttatgtcttggtgaagagatgaatttc

SEQ ID NO: 832 - DNA, 1514 bp, Tragopogon dubius
acacacaaagagttcatccatggctcctctaacaccaaagctagtagtacctatagacctaaagaagaagccatgggagcaaaagctacccttacataatcgttggcaccccgatataccaacggtggccgaggttaagactggacagatttttaagatagagatggtggactggactggtggtgctattaaagatgacaattccgctagtgatgttaaatacttagatctttcaactgtgcattatttgagtgggccgatcagagttattgatgaggaaggaacgccggccaaaccaggtgatattcttgcagttgaaatatgcaatttaggtcctcttcctggtgatgaatggggttttacagcgatttttgatagagaaaacggtggtggttttcttactgatcatttcccatgcgccacaaaagcaatttggtattttgaaggaatatatgcgtcttctccccatataccaggtgtacggtttccgggtataacacaccctggaataattggaactgcaccttcaatggaactccttaatatatggaatgaaagggagagagagctcgaagaaaacggtctaaaatctttgaagttgtgtgaagttttgcattcaagaccattggctaatctcccatcaacaaaaggctgccttcttggcaagattccagaaggaactcatgaatgggagaagattgctaatgaggctgcaagaacaattcccggaagggaaaacggaggaaactgtgacatcaagaatctaagtagaggttcaaagatatatcttccagtatttgtggaaggtgctaactttagtacaggagatatgcatttctctcaaggtgatggtgaagtttcgttttgtggggcgattgagatgagtggcttccttgagctcaagtgtgagataataagaggcgggatgaaagaatacttaacgccaatgggacctacacctcttcatgtgaatcctatatttgagattggaccaatggagccaagattttcggaatggttggtatttgagggtataagtgttgatgaaagcggaagacaacattaccttgatgcgagtgttgcttataagcgcgcagttttgaatgcaatcgactacctctccaaatttggatactccaaagaacaagtctatcttttactgtcgtgttgtccctgcgaaggaaggatttcgggaattgtggatgctcctaatgctgttgccacacttgcaattccaattgccatctttgatcaggatattcgtccgaaggctaacaagttgccggtgggaccacgcgtggtgagaaatccagatattccgagatgtacttatgatggaaatttacccattacaaaaaatcctggttcaacagggtaagttgataattaaggtgctgaatagatggttatatgctcttatgggaacccaatgtataatgaagtgggtggttgtttttttcttgtcaagtcatttatggataaagcggctaaatgagaaatggtgtttgtaaacg

SEQ ID NO: 833 - DNA, 1881 bp, Elaeis guineensis
tgagcattgaggtgcactcccccctccggtcgctatatgttctataggagcgcatagcatctttggattgcccccgcatccggccagccatagtggccaaatcccccctcaataatccatgaaaaacaaaatattttagccgtttggtagtttagtggtcgagacaaggacggaatcttgaaggcaaccaagtctcctactctttgttattaggagcaccaaagcgagttcaagtcatttagcagccaacctagggcttccgttgcagctatggctccacaaactccaagactggtggtgcccgtagatgtgaagaagaagccatgggaacaaaagcttcccctccataatcgctggcacccacacataccccctgttgcagacgtaaaggaaggagagctctttcgagttgagatggtggacgcgcttggaggtcaagtcggcgataacaactccgccgaagacatccaatctatagacctcactgctccccattatcttagtgggccattaagagttttggatacaaaaggagttccagcgaagcctggcgaccttcttgctgttgaaatctgcaacttgggtctacttccaggtgatgagtggggttatacggcaacgtttgatagagaaaaaggtggctgcttcttaactgaccacttcccttctgcaacgaaagcaatctggtattttgaaggaatatacgcatactcccctcatattccaggtgtacgctttccaggtttaactcaccctggggtggttggaactgcaccctcactcgagcttttgtctatttggcacgaaagggaaaagaaattagcagaagatggcactgggtcttggacactttgtgaagtcttgcatcaacggccacttgtaagcctaccaactgcaaagagttgccttcttggattgattgaagaaggaacaccagaatgggaaaggattgcaaatgaagctgcaaggacaatccctggaagggaaaatggagggaattgtgacatcaaaaatctgagcaggggttcaaaggtatatctcccagtatttgtagatggagcaaatcttagtactggtgatatgcacttctctcaaggtgatggtgaagtttcattttgtggagcaatagagatgagcggattccttgagctcaagtgtgagatcataagaggaggaatgagagagtatctgacacccatgggccccaccccgctacatgtaagcccaatctttgagatagggcctgtcgagcctaggttctcagagtggttagtctttgagggcatcagtgtggatgaggctgggcggcagcactacctagatgccacagttgcctataagcgtgcagtcctcaatgccatcgactacctctcaaagtttgggtactcaaaagagcaggtttatctgctactgtcttgctgcccctgtgaagggaggatttcaggaattgtggactcgcccaatgctgttgcaacccttgccatccctactgccatttttgatcaggacgtacggccgaaatctaggaaagtgccagcaggaccgcgaattgtgaagagaacacctgacgtcctaaagtgcacttatgatggaaatttgcccatcacaccaaacccaggggcaagactaagtctacttagtgatgattgatgctgttgctttgtattaatttgtggatcgaaggtagctcctgatgcagttcctaatgctactacagtcaattgcctcatgcatgaattgccatttgcttcccttcagaaggcaaaaatcagggttgaaaagtattattggctaattgtggcatatttctctcagtaaaaataaaaatttattctctgttgcggacctgtcgctgttatttaaatcaataaaaataacatt

SEQ ID NO: 834 - DNA, 1398 bp, Cirsium arvense
atggctcctccaacaccaaaactagtagtacctgtagacctgaagaagaagccatgggagcaaaagtttccgctgcataaccgttggcatcccgagataccaccggttgcagaggtgaaaactggacagatgttcaggatagatatggtggattggactggaggtgccataaaagatgatcattctgctactgatgttaaacacatagacctttcaactgtgcattatttgagtggaccgatcagggtcgtggatgaggaaggaattccggcgaaagcgggcgatcttctagcggttgaaatatgcaacttgggtcctcttcctggtgaagaatggggtttcacggcgatctttgatcgagaaaatggtggtggtttccttactgatcacttcccttgtgctactaaagctatttggtattttgaaggaatatatgcttactctccccatataccaggtgtacgatttccgggtttaacgcatcctggaatcattggaactgcaccttcaacggagctacttaatatatggaacgaaagagaaagagagctggaagaaaatggtctaaagtcattgaaattatgtgaagttttgcattcaaggccattggcaaaccttccatcaacaaaaggatgtgttcttggcaagattccagaaggaagtgaggagtgggagaagattgctaacgaagctgcgagaacgatccccggaagggaaaacggggggaattgtgacatcaaaaatctaagtagaggttcaaaaatctaccttccagtgtttgtggaaggagccaactttagtacaggagatatgcatttctcgcaaggcgatggcgaagtttcgttttgtggggccatcgagatgagtggcttccttgagctcaagtgtgagatcataagaggtggcatgaaggaatacttgactccaatggggccgacacctcttcatgttaatccgatatttgagatagggccggtagagccaagattctcggaatggcttgtatttgagggaatcagcgtggatgagagtggtagacaacattaccttgatgcaagtgttgcttataaacgtgcagttttaaatgcaatcgactatctttccaaatttgggtactcaaaagaacaggtgtatcttttactgtcatgttgtctgtgcgaggggaggatttcgggaatagtggatgctccgaatgctgttgccacacttgcaattccaactgctatctttgatcaggatattcgaccaaaacgtaacaagttgccgataggaccacgggtggtgaggaatccggatattccaagatgcacttatgacggagatttaccaatcacaaaaaaccctggtagcaacaggaagttgataagatcaatggtaacactacttgtgattatacaa

SEQ ID NO: 835 - DNA, 1389 bp, Cirsium arvense
cagtaacagttgatccatggcccctccaacaccaaaactagtagtacctgtagacctggagaagaagccatgggagcaaaagtttccgctgcataaccgttggcatcccgagataccaccggttgcagaggtgaaaactggacagattttcaggatagatatggtggattggactggaggtgccataaaagatgatcattctgctactgatgttaaacacatagacctttcaactgtgcattatttgagtggaccgatcagggtcgtggatgaggaaggaattccggcgaaagcgggcgatcttcttgcggttgaaatatgcaacttgggtcctcttcccggtgaagaatggggtttcacggctatctttgatcgagaaaatggtggcggtttccttactgatcacttcccttgtgctactaaagctatttggtattttgaaggaatatatgcttactctccccatataccaggtgtacgatttccgggtttaacgcatcctggaatcattggaactgcaccttcaatggagctacttaatatatggaacgaaagagaaagagagctggaagaaaatggtctaaagtcattgaaattatgtgaagttttgcattcaaggccattggcaaaccttccatcaacaaaaggatgtgttcttggcaagattccagaaggaagtgaggagtgggagaagattgctaacgaagctgcgagaacgatccccggaagggaaaacggggggaattgtgacatcaaaaatctaagtagaggttcaaaaatctaccttccagtgtttgtggaaggagctaactttagtacaggagatatgcatttctcgcaaggcgatggcgaagtttccttttgtggggccatcgagatgagtggcttccttgagctcaagtgtgagatcataagaggcgggatgaaggaatacttgactccaatgggaccgacacctcttcacgttaatccgatatttgagatagggccggtagagccaagattctcggaatggcttgtatttgagggaatcagcgtggatgagagcggtagacaacattaccttgatgcaagtgttgcttataaacgtgcggttttgaatgcaatcgactatctttccaaatttgggtactcaaaagaacaggtgtatcttttactgtcatgttgtccgtgcgaggggaggatttcgggaatagtggatgctccgaatgccgttgccacacttgcaattccaactgctatctttgatcaggatattcgaccaaaacgtaacaagttgccgataggaccacgggtggtgaggaatccagatattccaagatgcacttatgacggaaatttacccatcacaaaaaaccctggtgcaacaggaagttgataagattaatg

SEQ ID NO: 836 - DNA, 1697 bp, Euphorbia peplus
gaagccatgggagcacgaacgtttcccccttcacaaccggtcggcatacccgacgactaccctccgttagcagaggtacactgtcggagagcttttcagggttgagatggtggaaccttacagtggcggtggtatcacactggaaacactgcagatgacatcaaattatgctgattcttctattctagttcaattcatggctaccttcaactccaagagtggtagtgcctatagacttgaccaagaagccatgggagcaaaactacctcttcacaaccgttggcaccccgagattcccccagttgctgaggtcagagatggtgagttttttagagtagagatggtagactggactggaggtattatcaaggatgatgagtctgcagctgatgtaaaatttattgacctctcaattgtccattatcttagcggaccaatcagagttgtcgacgacaacggagttccagctatgccgggtgatcttcttgttgtggaaatatgcaacttgggtcctctacctggagacgaatggggttttacagcaacatttgacagagaaaatggaggagggtttttgactgatcattttccttgtgcaactaaagctatttggtattttgaaggaatatatgcctactctccccacataccgggggtaagatttccaggtttgactcatccgggaatagttggcactgcaccatcagaggagctcttaagtatatggaataaaagagaaagagaagttgaagaaaacggactgcaaactttcaaactttgcgaggttttgcactctaggccactagctaatcttccttcaactaagggatgccatcttggaaagatccagaagggcactccagaatgggaaaagattgcaaatgaggcagcaagaacaattccaggaagagaaaatgggggaaattgtgacataaagaatctcagtcgaggttccaaagtataccttccagtatttgtggaaggagctaatctcagtacaggggacatgcacttttctcagggtgatggtgaaatatcattttgtggagcaatcgagatgagtggttttctagagctcaagtgcgagatcataaggggcggtatgaaagagtaccttacaccaatggggccaactactcttcatgtgaatccaatctttgagataggccctgtcgagccaagattttcagagtggctggtatttgaaggtatcagtgtcgatgaaagcgggaggcagcactaccttgatgcaagtgttgcttacaagcgtgcagtgctcaatgccattgattacctctctaaatttggttattcaaaggaacagatgtatctcttgctatcatgctgtccatgtgaaggaagaatatccggaatagtagatgctcctaatgctgttgcaaccctggctataccaacagctatctttgaccaggacattcgtccaaaaacaagcaaggtgcctgctggaccacggctagtgaggaaaccggatgtcctcaaatgcacttatgatggaaacttgcccatcacaaaaaacctaagtgccatgtcgtaactacaaccaaagttctgcactgaagaagcagaattcaagctacactttccatatcgcatatatctgtaaataaatcagattatgtatgaataaatagattaaactaaacatgggtaggaagtcctctagtttcggttcagca

SEQ ID NO: 837 - DNA, 1707 bp, Glycine max
tgcacgcctttcatcggtgaccaaagtgtgatccatccacaagtggaaaaccgatccctttcctcacagtaatgctactctaattaacactgtctatctagagtgtttgtccgatccatgacccatggcgccagcaactccaagatttgttgtgccaatagacttgaagaagaatccatgggaacaaaacgctcctctccataaccgatggcaccctcacataccgcacgtggcggctgttaataccggtgaagtcttcagggtagagatggtagattggacaggaggtgctattaaagacaacgattcagcactagacataaaatttctagacctctcaactgtccattatcttagtgggccaatcagaattctggataatgatggggtcccagcccagcctggagatctgcttgctgttgaaatatgcaacttaggtcctctaccaggagatgaatggggttttacagcaacatttgacagagaaaatggtggtggcttcttgacagaccattttccttgtgccacaaaagctatatggtactttgagggaatatatgctcattcgcctcagataccaggagtacgatttccaggtttaacacaccccgggataattggaactgcaccatcgatggaactcctgaacatatggaatgaaagggagagagatgtggaagaaaatggcattaagtctttcaaactttgtgaggtcttgcattcacgacccttggcaagcttacccttaacaaaaagttgtctccttggaaagattcgaaaaggcactagtgaatgggataagattgcaaaggaagccgcaagaacaataccaggacgagaaaacggtggaaattgtgacataaaaaaccttagcagaggtgccaaggtataccttccagtttttgtagaaggagcaaatctcagcactggagacatgcatttttcacagggtgatggcgaggtctcattttgtggtgcaatagagatgagtggtttcctagaactcaagtgtgaaattataaggggtggaatgaaagagtaccttacaccaatggggccaactccccttcatgtcaacccaatatttgagataggtcctgttgaaccaagattctcagagtggttggtttttgagggcatcagtgttgatgaaagtgggaggcaacactacctagatgcaagtgttgcatacaaacgagcagtgctcaatgccattgactacatatccaagtttggatactccaaagaacaggtgtacctccttctgtcttgcatcccttgtgaaggaagaatatctggaatagtcgatgcccccaatgctgtagcaactctggccattccaacaactatatttgaccaggatattcgtcctaaaaataacaaggtgccagttggaccccgccttgtaaggaaaccagatgtcttcaaatgcacttatgacgggaacttgcccattacaaggaatccaagtgccacgtcatgattcatatgaattgcacaacataaaattaagtaattgaatacacgtggttaatgtaatggaattaaaattgaatcgttcgagtattaccgagtttaatctttagcaaaaataatttttaatcagattttacttacttctcgggtcaaactccagataattttatcgtatgctactgctcgctggacaaatgaaaaaacaatgttagtattatgaacaaatctaga

SEQ ID NO: 838 - DNA, 1878 bp, Glycine max
acattaaactcttttatttattctatcccaaagtgtagttttcttatatgagccaaatgaatgcacgcctttcatcggtgaccaaagtgtgatccatccacaagtggaaaaccgatccctttcctcacagtaatgctactctaattaacactgtctatctagagtgtttgtccgatccatgacccatggcgccagcaactccaagatttgttgtgccaatagacttgaagaagaatccatgggaacaaaacgctcctctccataaccgatggcaccctcacataccgcacgtggcggctgttaataccggtgaagtcttcagggtagagatggtagattggacaggaggtgctattaaagacaacgattcagcactagacataaaatttctagacctctcaactgtccattatcttagtgggccaatcagaattctggataatgatggggtcccagcccagcctggagatctgcttgctgttgaaatatgcaacttaggtcctctaccaggagatgaatggggttttacagcaacatttgacagagaaaatggtggtggcttcttgacagaccattttccttgtgccacaaaagctatatggtactttgagggaatatatgctcattcgcctcagataccaggagtacgatttccaggtttaacacaccccgggataattggaactgcaccatcgatggaactcctgaacatatggaatgaaagggagagagatgtggaagaaaatggcattaagtctttcaaactttgtgaggtcttgcattcacgacccttggcaagcttacccttaacaaaaagttgtctccttggaaagattcgaaaaggcactagtgaatgggataagattgcaaaggaagccgcaagaacaataccaggacgagaaaacggtggaaattgtgacataaaaaaccttagcagaggtgccaaggtataccttccagtttttgtagaaggagcaaatctcagcactggagacatgcatttttcacagggtgatggcgaggtctcattttgtggtgcaatagagatgagtggtttcctagaactcaagtgtgaaattataaggggtggaatgaaagagtaccttacaccaatggggccaactccccttcatgtcaacccaatatttgagataggtcctgttgaaccaagattctcagagtggttggtttttgagggcatcagtgttgatgaaagtgggaggcaacactacctagatgcaagtgttgcatacaaacgagcagtgctcaatgccattgactacatatccaagtttggatactccaaagaacaggtgtacctccttctgtcttgcatcccttgtgaaggaagaatatctggaatagtcgatgcccccaatgctgtagcaactctggccattccaacaactatatttgaccaggatattcgtcctaaaaataacaaggtgccagttggaccccgccttgtaaggaaaccagatgtcttcaaatgcacttatgacgggaacttgcccattacaaggaatccaagtgccacgtcatgattcatatgaattgcacaacataaaattaagtaattgaatacacgtggttaatgtaatggaattaaaattgaatcgttcgagtattaccgagtttaatctttagcaaaaataatttttaatcagattttacttacttctcgggtcaaactccagataattttatcgtatgctactgctcgctggacaaatgaaaaaacaatgttagtattatgaacaaatctagagtttagatagagtctcctaattcaaataaagggtgaatttagatagactatgttaattcaaataaaagctaacctcatgtttggatgaggaatttgaaacgtctaaaatt

SEQ ID NO: 839 - DNA, 1910 bp, Musa acuminata
gacgacagctcgatgcaggcttggaacatccattgattgggggattcatagcaccggttcatcatctctgtgcagggtgtggcgctttgccgagtaacttgcaggcagccatggctcctctgactccgagagttgtagtgccggtagacgtgaagaagaagccctgggagcagaaacttccccttcacaaccgatggcaccctgacatacccgcggtagcagatgtcacggaaggggaggtcttccgagtcgagatggtagactggactggaggtcgagttggtgatgacaactctgccgaagacatcaaatccttagacctcacaattactcattatctcagtggccctttaagagtggtggattcaaaaggcattcccgccaagcctggtgatcttctaatggttgaaatatgcaacttgggtccacttccaggtgatgaatggggttatacagcaacctttgacagagagaatggtggagggtttttaacagatcacttcccctgtgcaactaaagccatttggtactttgaaggaatatatgcatactcaccacacataccaggagttcgatttcctggtttggcacacccggggattgttggaactgcaccatccatggaacttctatgcatatggaatgagagggaaaaggaattggcggaaaatggcattggattgctgaaattatgtgaagttctacaccaacgcccacttgcgaacttaccgactgccgagaattgtctcctcggaatgataaatgaaggaactcctgaatggaaaaagattgcagatgaagctgcaaggacaattcccggaagggaaaatggagggaactgtgacatcaaaaatctcagcagaggttctaaagtatatctaccagtatttgtggaaggggcaaatctcagcactggtgacatgcacttttcccagggtgatggagaagtttcattctgtggagcgatagagatgagtggattcctagaactcaagtgtgaaatcattagggatggaatgagagagtacctgacaccaatgggccccacggttctgcatgtgagcccaatctttgagatagggccggtggagccgaggttctcagagtggctggtcttcgagggaatcagcgtagatgaggcagggcggcaacacttcctcgatgcaacagtagcctacaagcgagcagtcctcaatgccatcgactacctctcgaaatttggatactccaaggagcaggcgtatctgctgctgtcatgctgcccctgcgagggaaggatatcaggaatagtagactccccaaatgctgtagcgacccttgccattcctacatccatttttgatcaggatataaggccaagatccgggaaagtgccagcaggaccgagggtgctaaagagacttccggatgtcctcaggtgcacatacgatggaaatctgccgacgacacaaaacccatgcggaagcatgtgaattcgatggggatctcggttcatggtgttcttcggattctgcattggctcttcagcatcctaactatcatacaaatctgtggtcgtaggcctgtgttcttggagttcttaaagactaccagtatggacaacttgaatgccatctgctgtcactgaataaatagtgagatagatcgaaattgttcccagaaatttctattctctttggcaggctagcggtgattgaattggctcgagaaacttcaagggatggtacgacgatcggaagatgtttgaagtgtcatgaatcaccaagacttttgtcggacaccaagcagcattccattcaagagcgcagaccaactaaaacagcaaactgaaatcgaacattcgaccatgtccaaaagcttcgtttgaatatgaactcaaaattgtagctcatttattgtcatgtctgatt

SEQ ID NO: 840 - DNA, 1565 bp, Flaveria ramosissima
tacacacatccccctgtttctctcccacacaccaccagttcatctatggctccatcaacaccaaaactagtaataccaatcgacctcaagaagaagccatgggagcaaaagctacccctgcataaccggtggcaccccgacataccaccggttgcaaccgttaaaaccggtcagtttttcaggatagaaatggtggattggaccggaggtgctattaaagatgataattctgctactgatgttaaatacttagacctttcaactgtgcattatctgagtgggccgattcgagtcgtagatgatgatgggccggctcgaccgggtgatcttcttgcagttgaaatatgcaacctgggtcctcttcctggtgatgaatgggggtttactgctatttttgatagagaaaatggtggtggttttcttactgatcatttcccttgtgctacaaaggctatatggtattttgaaggaatatatgcttactctcctcatattccaggtgtacggtttccgggcttaacgcacccggggataatcggaacagcaccttcgatggaactactgaagatatggaatgacagggagagggagcttgaagaaaatggtttaaagtcattgaagttatgtgaagttttgcattcaagaccattggcaaacctgccttcaacaaaagggtgtcttcttggccagattccagaaggaagtcctgaatgggagaagatggcgatggaggctgcaagaacgattccggggagggaaaatggagggaattgtgacatcaagaatctaagtagaggttcaaaaatataccttccagtatttgtggaaggagctaacttcagtacaggagatatgcatttctcacaaggagatggggaagtttcgttttgtggcgcgattgagatgagtggcttccttgagctcaagtgtgagataatacgcggcgggatgaaagaatacttaactccaatgggacctactcgtcttcatgttaatcctatattcgagatcggcccagtagagcccaggttctcagaatggctggtgttcgaggggatcagtgttgatgagagtggaagacaacattaccttgatgctagtgttgcttacaagcgcgcggtcttgaacgcaatcgactacttgtccaaatttggatactctaaagaacaggtgtatcttttgctgtcatgttgtccttgtgaaggaaggatttcagggattgttgatgctcctaatgctgttgcaacacttgcaattccaactgctatctttgatcaggatattcgtccgaagcagaacaaggtaccgataggacctcgtgtggtgagaaatccagatattccaagatgcacttatgatggaaatttaccaatcactaaaaaccttagtgcaataagttaaccacaaacgtgttgaatgcatgtcatgtcatgtaagttatattctcttaaattctccgatcaagatactcaagttagaaagtacgagttccttacttaacgatcattcgtttatcatctcatgaatatatatgtattacatgaattatgatcttttcatttata

SEQ ID NO: 841 - DNA, 1617 bp, Lotus japonicus
gaatatttccaaactcatgtaccagtttctccatggagcccccaactccaacactggttgtgccaatagacctgaagaagaagccttgggaacagaaacttcctctccataacagatggcacccttacataccgcccgtggcgactgttaacacagatgaagtctttagagtagagatggtggattggactggaggtgctatcaaagatgataattcagcactagatttaaaactcctggacctctcaactgtccattatcttagtgggccaatcagaattgttgacaatgatggcattccagccaagcctggtgatctgcttgctgttgaaatatgcaacttgggtcctctccctggagatgaatggggttttacagggacatttgacagagaaaatggtggtggtttcttgacagaccatttttcatgtgccactaaagctctctggtactttgaggggatatatgctcattcacctcagataccaggagtgagatttccaggtttaacacacccggggataattggaaccgcaccatcaatggagctacttcacatatggaatgaaagggagagagatgttgaagagaatggtgttcattccttcaaactatgtgaggtcttgcattcacgacccttggcaagcttaccaacaaccaatagttgtctccttggaaagattcaaaaaggtagtcctgagtgggagaagattgcaatggaagctgcaagaacaataccaggaagagaaaatggtggaaactgtgacataaaaaatctcagcagaggctcaaaggtataccttccagtttttgttgaaggagcaaatctcagcactggtgacatgcacttttctcagggtgatggcgaggtctcattttgtggtgcaatagagatgagtggtttcctagagctcaagtgtgaaattataaggggtggaatgaaagagtatctaacaccaatgggaccaactcctcttcatgtcaacccaatatttgagataggccctgttgaaccaagattctcagagtggttggtgtttgaaggcatcagtgttgatgaaagagggaggcaacacttcctagatgccagtgttgcatacaagagagcagtactaaatgccattgactacatatccaagtttggatactcaaaagaacaggtgtatcttctgctgtcttgcatcccttgtgaaggaagaatatcttcaatagttgatgcccccaatgctgtggcaaccttggcaatcccaacagctatatttgaccaggatatccgtcccaaacagaacaaggtaccaattggaccacgccttgtaagaaaaccagatgtcttcaaatgcacttatgatgggaacttgcctattacaaagaatcctagtgctacataatgaatcatattcacatgcttctgtaacatatccctcaagttatacattttatgccataaaaataaagtttgaactatatggagatctgtatcatatgctcctgtttcctggacaatggctggaataattcagtaatttactatgccatggttgggttagcttattttcaatttaaaagaacttgtaattagaatttcaatatgaaacttttaatgcaattataatctgt

SEQ ID NO: 842 - DNA, 1458 bp, Helianthus annuus
tagtttagtaaataaataacattggaaaccagactaaaccctttatcacaaaatggctcaacatggtcctagactggtggtgccaatagacgtaaccaagaaaccaagggaacagaagcttccgcttcataaccgatggcaccctgacataccacccgttgctgaggttcgtgtcggggaggtgtttcgggtcgagatggttgatttttctggtggtggtatcactaaagaatacactgctgaagacatcaaattctctgaccaatctattgtgcattatctgagtgggccaattagagttgttgatgaggatggaccggctaaaccgggcgatcttcttgcggttgaaatatgcaatttgggtcctcttcctggtgatgaatggggttttactgctatttttgatagagaaaatggtggtggtttccttactgatcatttcccctgtgccacaaaagcaatttggtattttgaaggaatatatgcttactctcctcatattccaggtgtacggtttccgggtttaacacacccgggaataatcggaacagcgccttcaatggagctccttaagatatggaatgaaagggagagagagcttgaagaaaatggcttaaaatctttcaagttatgtgaagttttgcattcaagaccattggcaaacctgccttcaacaaaaggttgtctcctcggcaagattgaggaaggaagtcacgaatgggaaaagatggctaacgaggctgcaaggacgattccgggaagggaaaatggagggaactgtgacattaagaatctaagtagaggctcaaagatataccttccagtgtttgtggaaggagctaactttagtactggagatatgcatttctcacaaggagatggtgaagtttccttttgtggggccattgagatgagtggcttccttgagctcaagtgtgagataataagaggagggatgaaagaatatctaactccaatgggacctactcctcttcatgttaatcctatattcgagatcgggccagtagagcccagattctcagaatggctggtgtttgaaggaatcagtgttgatgagagtggaagacaacattaccttgacgccagtgttgcttacaagcgagccgtcctaaacgcaatcgactacctgtccaaatttggatactccaaggaacaggtgtatcttttattgtcatgttgtccttgcgaaggaaggatttcaggaatagttgatgctccaaatgctgtcgccacacttgcaattccaactgctatatttgatcaggatattcgcccaaaggcaaacaagttgccaataggaccacgcgttgtcaggaatccagatatcccaagatgcacttatgatggaaatttaccgatcacaaagaacctgagtgcaacaggaagttaataacaaaagtgctaaacacatgccatgctctattatcttatattgtc

SEQ ID NO: 843 - DNA, 1654 bp, Valeriana officinalis
acacaaataagccatggctcaacatggtcctagactagtggttccaatagacttaaccaaaaaaccacaacaacaaaaactaccactgcataacaggtggcaccctgacattcctccggtggcggaagtcaccaccggcgagcttttcagggtggagatggtcgattttagcggtggtagaattacgcgcgaatacacggctcttgatatcaaacatgctgatcagtctattgtccattatctaagtggtccgatccgggttgtaggttctgacggggtggcagctcagccgggcgatcttcttgtagttgagatatgcaacttgggtcctcttcccggagatgaatggggttttacggcgattttcgacagagaaaatggtggtggttttttaactgatcatttccctagtgctcacaaagctatttggtattttgaagggatatatgcatactctcctcatataccaggtgttagatttccaggtttaactcatccagggatagttggaacagcgccatcaatggagctactacaaatatggaacaaacgcgaaagagagcttgtagaaacaggtttggaatcactaaaactgtgtgaggttttgcattcacggccattagcaaacctaccctcgacaaaaggttgcgttcttggcaaggttcaacaagggagtgatgaatgggaaaaaattgctatagaggctgcaagaacaattccaggaagagaaaacggaggaaactgcgacataaagaatcttagtagagggtcgaaaatatacttaccggtatttgtcgagggagcgaatcttagtaccggggacatgcacttttctcaaggcgacggagaagtctcgttttgcggagctattgaaatgagtggctttctagagctcaagtgcgaaataattaggggtggaatgaaagagtacctaactccaatggggcccacacgactgcacgtaaatccgatatttgagatagggccggtcgagccaagattctccgaatggttagtattcgagggtatcagtgtagacgagagtggaaaacagcattacctggacgctagtgtagcgtataagcgtgcggtcctgaatgccattgactacctctcaaaatttggatatactaaagaacaggtgtacctgctgctatcgtgttgcccctgcgaaggaaggatatcggggattgttgatgcccctaatgctgtcgctacacttgccatccccactgctatcttcgaccaggatattcgtccaaaagcgaataaagtgccagttgggccacgtttggtgaggaatcccgatatccctaaatgcagttatgatggaaatttgccaaccacaaaaaaccctagtgcctcaatttaagagaccatagtcggaagcagaacaaagcattatatataaaccatataaatcatttcatctattataatctgctaagtataaaatagtatcaaagaacttgcagaaatatttaaaataatccaatggcaaaagcagtgaattcgtcaataatatatagagagcgtacggtgatgttgcagagacgggcattgaattccaactgaccataaccaaagatccagttcaacactcaaaacctggggataatacgagaacattcattatgttagattttatttcttt

SEQ ID NO: 844 - DNA, 1599 bp, Vitis vinifera
agccccaacaataaaattcatgagatctccatagtctctggaattcactgcttcatcaatggctccttcaactccaaggttagtagtgccaatagacctgaagaaggcagcatgggaacaaaagctaccttttcacaaccgttggcatcccaaaataccaccagttgcagaggttaaggctggtgaattttttagagtagaaatggtagatgcgactggaggtggtattaaggatgatgattcttcactagatgtaaaacacattgatgcctcaactgttcattatctcagtgggcctatcagagttctggatgtggatggggttccagcgaagccaggagacctgcttgcagttgaaatatgcaacttgggccctctgcctggtgatgaatggggttacacagcaacgtttgatagagaaaacggtggcggatttttgactgaccattttccttgtgcaaccaaagctatttggtattttgaaggaataaatgcttactctcctcatataccaggagtgagatttccaggtttaactcaccctggaataattggaactgcaccatcaatggaacttctgaatatatggaatgagagggagaggcaagtggaagaaaatggtcgccagactctgaaactatgtgaggttctgcattcaagaccattggcaaatcctccatcaactaaaggctgccatcttggaaagatccaacagggaactcctgaatgggaaagaattgctagagaggctgcaaggactatcccaggaagggaaaatggaggaaactgtgacatcaagaatctcagtagaggttcaaaaatataccttccagtatttgtagatggtgcaaatcttagtacaggggacatgcacttctcccagggcgacggcgaagtttctttctgtggggcaattgagatgagtggtttcctagaactcaaatgtgaaatcataagaggcggaatgaaagagtaccttacaccaatgggacctactccccttcacgtaaaccctatcttcgaaatagggcctgttgagcccagattctcagaatggctggtttttgaagggatcagcgttgatgagagtggaagacagcacttccttgacgcaaccgtcgcttacaagcgtgcagtgctcaatgccattgactatctctccaaatttggctactccaaagaacagatgtatctactgttatcatgctgcccctgtgaaggaaggatttcaggaatagtggactcacccaatgctgttgcaacccttgcaattccaacagccatcttcgaccaggatattcgtccaaaaaccaaagtgccagttgggccccggttagtgaggaaacccgatgttctaagatgcacctatgatggaaatttgcccaccacaaagaacccagctgccacaatgtaactgctatcaaaggagctaagtagaataaggaggcctaatggaacacatattccatggttgcggccttctgctcttatctttacgtctaaggacaggatataaaaatgtggtatgagaacctttggcttctggtaagtaatggaaaccaattgcataacgccagtaagttgacaaattcaggaaaa

SEQ ID NO: 845 - DNA, 1934 bp, Populus trichocarpa
tttttgtgtcaaaagctcaatcaatttctcatagtggtccatccactaagtagaggaaagagaaatcaaactctacggtgtcaatcatgggtgtcaagcttcaactgaaagtgaaggttgaagctgcagcactactccatgaacacacctccaagaaagatacaggatttataactctcttttcctttcaactacatcaagattgaaagttaagagagaaaggagccatggagcaacatggtgcacggctggtctttcccatagatgtcaaaaagaagccatgggaacagaaacttccacttcacaaccggtggcacccagacataccgccagtcgcagaggtaacagtcggagagcttttcagagttgagatggtggacttcagtggaggtcgtatcacgaaagaatactccgcagaggacatcaagaacgctgatccctctattgttcactatctcagtggcccaattagagttttggacgaggaagggaagccagcacagccaggtgatctacttgctgttgaaatatgcaacttgggtcctctccctggagatgaatggggttttacagcatcatttgacagagaaaatggaggtggtttcttgactgaccactttccttgtgcaaccaaagctatttggtattttgaaggaatctatgcctattcgcctcaaataccaggggttcgatttccaggtctgactcaccctggaatagttggtactgcaccatcaagggaactactgaacatatggaatgaaagggagagagaagtagaggaaaatgggctcaaacatctgaagctatgcgaagttttgcattcaagaccactggcaaatctaccatcaacaaaaggttgccacctaggaaagatccaaaagggcacgcctgaatgggaaaagattgctaatgaggcagcaagaacaattccaggaagagaaaatggaggaaattgtgacataaaaaatcttagtagaggttcgaaagtgtatcttccagtattcatagaaggagcaaatgttagcactggtgacatgcacttctctcagggcgatggtgaaattgccttctgtggggcgattgagatgagtgggttcttggagctcaaatgtgaaatcataaagggtggaatgaaagagtaccttaccccaatggggccgactcttcttcatgtgaacccaatctttgagataggccctgtggagccaagattttcagaatggttggtatttgaaggcatcagtgtagatgagagcggaaggcagcacttccttgatgcaagtgttgcatacaagcgagcagtgctcaatgccatcgactacctctctaaatttggctactccaaagaacagatgtatcttctgctatcatgttgcccatgtgaaggaaggatttctggaatagtcgattctcctaatgctgttgccacctttgcaatcccaacatctatctttgaccaggatattcgtccaaaaacgaaggtgccagttggaccccgactggtgaggacaccagatgtgctaaagtgcacttatgatggaaacttgcccataactaagaacccctgcgccacgacttgaacagaaacaaggtgcttcatggaaacagaaggttttggctaaaccttttatgcctagtaagtaataatcataccaatgtctatatggatgagataaaacatggctgcaaaaccttcgatgtccgggttatgttcattataagctctttgtaataatgaagaggcatcgaacatcatttcatgaggtgatgatggccttttgcattaaatctattttatctaaattttatgcttttgttatgccactacaaatatgctgaacaataacccatcacaccatttacacttcatagagtaaatacttctcttctatatatattcttgatcaatgactcataattatacctaaaca

SEQ ID NO: 846 - DNA, 1645 bp, Phalaenopsis aphrodite
atctcaaaatcatgcataccttgatatagaaattgcagaattcaatgattatataacatataaggctgcctgcctagctcctcaacagagtgcagagatggctcctctaagcccacgattggtggtgccgatcgacatcaagaagaagccatgggaacagaagcaccctctccacaaccgttggcatcctcacataccggcagttgcggaggtgaccgagggagaggtatttagggtcgagatgatggactggtccggcggaagtgttgcagataatgattctgctatggacatcaaatccatcgacctcgccattacacattatctgagtggacctataagagttttagacaaaggaggagccccagcaaagccaggtgatcttctagcggtcgaaatctgtaacttgggtcctcttcctggagatgaatggggttacacagcaagttacgacagagaaaacggaggtgggtttttgacggaccacttccccagtgccacaaaagctgtctggtattttgaaggaatatacgcatactctccacatataccaggtgttcgctttccaggtttaactcacccaggaataattggaactgcaccatccattgaacttctcaatatttggaacgaaagggagaagaagttggttgaagatggccccaattctcttaagatatgtgaagttgtgcaccagaggccactggcttccctaccaacaaccaaaagttgcctccttggaatgattaatgaaggaacacctgaatgggagaagattgcaagtgaggctgcaagaactatccctggaagggaaaatggaggaaattgtgacataaaaaatctaagtactggatcaaaaatatatcttccagtttttgtggaaggtgcgaacttcagtacaggcgacatgcatttctctcaaggtgatggtgaaatttcactttgtggagcaatagagatgagcggattcctagaactcaagtgcgagatcataaaaggagggatgaaggaatacctaaccccaatgggtccaaccgagctgcacgtgaaccctatattcgagattgggccagtggagccgcgattctcagagtggctcgtgttcgagggcatcagcgtagacgagagggggagcagcatttcctggacgccacagtggcctacaagcgcgccgtgctgaacgccatcgattacctctccaagttcggctactcgaaggagcaggcttacctcctcctctcctgctgcccctgtgaaggccgcctctccggcatcgttgatattcccaatgccgtcgccaccattgctatccccaccgccattttcgaccaggatattcggccaaaagctggaagggtgccggtgggacccagggtcgtgaagagattgccagatgtcattcgatgctcttacgatggagaccttcccataactcagaacccaagcaaggccaaataaagcagattatcgacaattccgtcccgtttgattatgcgggtgaaataagctgaacttcatgattgtgaggtgatttctaaatatcacttttgtgaaaaaaataattgtgaggtggaaagaatggaacagaacagctgttattgtatggaatcagtactgaagcctaattaaaaacagttggtcatgc

SEQ ID NO: 847 - DNA, 1529 bp, Ambrosia trifida
ctaaaactaaaacctttcatcacaaaatggctcaacatggtccaagacttgtggtgccaatagatgtaaccaagaaaccaagggaacagaagcttccccttccataaccggtggcaccccgacataccacccgttgctgaggttcgtgtcggcgaggtttttcgcgtcgagatggttgattttctggtggtggtatcactaaagaatacactgctcaagatatcaaattctctgaccagtctgttgtgcattatctaagtgggccgattagagttgttgatgaggatggaccggctaaaccaggcgatcttcttgcggttgaaatatgcaatttgggtcctctgcctggtgatgaatggggttttacagctatttttgatagagaaaatggtggtggtttccttactgatcatttcccttgtgccacaaaagcaatttggtattttgaaggaatatatgcttactcgcctcatattccaggtgtacggtttccgggcttaacacacccgggaataatcggaacagcgccttcaatggagctcctaaacatatggaatgaaagggagagagagcttgaagaaaatggcttaaaatcactcaagttatgtgaagttttgcattcaaggccattggcaaacttgccttcaacaaaaggttgcctacttggaaagattgaggaaggaagtcgcgaatgggagaagatggctaccgaggctgcaaggactattcccggaagggaaaatggagggaattgtgacatcaagaatctaagcagaggttcaaagatataccttccagtgtttgtggaaggagctaactttagtacaggagatatgcatttctcacaaggagacggtgaagtttcattttgtggcgccatcgagatgagcggcttccttgagctcaagtgtgagataatacgcggagggatgaaagaatatctaactccaatgggacctactcgtcttcatgttaatcctatattcgagatcgggccagtagagcccagattctcagaatggctggtgtttgagggaatcagtgttgatgagagtggaagacagcattaccttgatgccagtgttgcttacaagcgtgcggtcctaaacgcgatagactacctgtcgaaatttgggtactccaaggaacaggtgtatcttttattgtcatgctgtccatgtgaaggaaggatttcaggaatagttgatgccccaaatgctgttgccacacttgcaatcccaactgctatatttgatcaggatattcgtccaaagccgaacaaggtgccaataggaccgcgtgttgtaagaaatccagatatcccaagatgcacttatgatggaaagctaccgataacaaagaacccgagtgcaataggaagttaataacaaaagggacatgctctatgctcttgtattgtcaatctgaatgcactcaagttagaacatacaatttccataactaactatatatttcatttcctaaggcttatgttgtcaatgttaaagatacttgctctaaaaaagaaa

SEQ ID NO: 848 - DNA, 1850 bp, Arnica chamissonis
ctaaaccctttatcacaaaatggctcaacatgctcctacactggtggtgccaatagatgtaaccaagaaaccaagggagcagaagcttccccttcataaccggtggcaccccgatataccacccgttgccgaggttcgtgtctccgaggtctttcgggttgagatggttgatttttcgggtggtggtatcactaaagaatacactgcacaagacatcaaatactctgaccaatcagttgtgcattatctgagtgggccgattcgagtcgttgatgaggacggaccggctaaaccgggcgatcttcttgcagttgaaatatgcaatctgggtcctctccctggtgatgaatggggttttactgctatttttgacagagaaaatggtggtggtttccttactgatcatttcccctgtgccacaaaagcaatatggtattttgaaggaatatatgcttactctcctcatattccaggtgtacggtttccgggtttaacacacccgggaataatcggaacagcgccttcgatggaactccttaatatatggaatgaaagggagagagagcttgaagaaaatggtttaaaatcattgaagttatgtgaagttttgcattcaagaccattggcaaacctgccttcaacaaaaggctgccttcttggcaagattcaggaaggaacccccgaatgggagaagatcgccatggaggctgcaaggacgattccgggaagggaaaacggagggaactgtgacatcaagaatctaagtagaggttcaaaaatataccttccagtgtttgtggaaggtgctaactttagtacaggagatatgcatttctcacaaggagatggtgaagtttccttttgtggagccattgagatgagtggcttccttgagctcaagtgtgagatcatacgaggcgggatggaagaatacttaactccaatgggacctactcgtcttcatgttaatcctatatttgagattggcccggtagagcccagattctcagaatggctggtattcgagggaatcagtgttgatgagagcggaagacaacattacctagacgcaagtgttgcttacaagcgtgcggtcctaaatgcaatcgactacctgtccaaattcggatactccaaagaacaggtgtatcttttattgtcatgctgtccctgtgaaggaaggatttcgggaatagttgatgctccaaatgctgttgccacacttgcaattccaactgctatctttgatcaggatattcgtccaaaggcgaacaagttgccagtaggaccgcgtgtggtgagaaatccagatattccaagatgcacttacgatggaaatttaccgatcacaaagaacctgagtgcaaagccaagttaagaacaagtgatgccatgctctattctcttacattgtcaagttacaacatacaatttccatacccaactatccttcatttcatgaacgaatatccgttatataagctcggatatattctcctcctttttatttctcatctttatttattataagattgtaccgtcgttatggatctgaagttgatgcgtgataagagtacgaagcctaaacaactcatgtcggttgacatggatgctagagatgatggtttgttggtgtcaatcccttcttgggggcttgaccgtaactatatatgttagtatgttacataactatcgtgcctagtttggtttagattattaataagaagattcttacgcatggccttttagcctagcgttatggtgattgcccctcaaatatataagtggcaatggttcaataagaaacaaatacaagtttcttaatccaaagatgctaaggtggagaccat

SEQ ID NO: 849 - DNA, 1723 bp, Artemisia annua
gcatatggcgcaacatggtccaaggatggtggtgccaatagatgtgaccaagaaaccaagagaacagaagctccctcttcacaaccggtggcaccccgatataccgcctgttgctcaggttagtgttggggaggttttccgggttgagatggttgatttttctggtggtcgcattacgcgggaatacactgctgaagacatcaaatatgcagaccagtcagttgtgcattatctaagcgggccgattagagttgttgatgatgaaggaatagcggctaaaccaggcgatcttcttgcagttgaaatatgcaacttgggtcctcttcctggtgatgaatggggttttacagcgatctttgacagagaaaatggtggtggttttcttactgatcatttcccatgtgccacaaaagcaatctggtatttcgaaggaatatatgcttactctcctcatataccaggtgtacgatttccgggtataacacatccgggaataattggaactgcgccttcaatggaacttcttaatatctggaacaaaagggaaagagagcttgaagaaaatggtctaaactcattgaagttatgtgaagttttgcattcaaggccattggcaaatctaccatccacaaaaggctgccttctaggacagattcctgaaggaactaatgaatgggagaagattgctaatgaggctgcaagaacaattccgggaagggaaaatggaggaaattgtgacataaagaatttaagtagaggttcaaaaatttaccttccggtatttgtcgaaggagctaactttagtacaggggatatgcacttctcgcaaggcgatggtgaagtttcattttgtggggccattgaaatgagcggcttccttgagctcaaatgtgagatcatacgaggtgggatgaaagaatacctaactccaatgggacctactcctcttcatgttaatcctatatttgagatcggaccagtagagccgagattctcagaatggttggtgtttgagggaatcagtgttgatgagagtggaagacagcattaccttgatgctagtgttgcttacaagcgtgcagtgcttaacgctatacttgtcaaagtttggatattccaaagaacaggtgtatcttttattgtcatgctgtccttgtgaagggaggatttcaggaatagtcgatgctccaaatgctgttgccacacttgcaattccaactgctatctttgatcaggatattcgtccaaaggctaacaagttgccaataggaccacgtctggtgagaaatccagatattccaagatgcacttatgatggcaatttaccaatcacacagaaccctggtgcatcaggaatttaataagaaaggtgtcgaatacatggcatattactatgtaactatatatgttgtcagttttaaacttttaacatatttgcaccgaaacattaagcatacaacatatttatgttaacggacactatcaatctattataagttcataactaaagttgatggtgcccacaagaattattttctaaacagccggccaaaccgaaaaccaggagcttctttatcttgtgtttgtaaacatttatttaagccggaattatgcttgtggtctataagaaacgagctaggaagcccgcgcgttgcggcgggtgagcttgtgtgcacgttttatgcttgttcacttttggaatgaaagatcaactcttcgattt

SEQ ID NO: 850 - DNA, 1514 bp, Actinidia deliciosa
  misc_feature (1247)..(1247): n is a, c, g, or t
actctccgctttaaaagtgacctcccatcgcgtgggctcaacaagatcaaaatttcacgacttggaatgagccatggctctacatggtccaagattggtgttgcccatagacctaaagaagaaggcatgggaacagaaacttccacttcacaaccggtggcacccggatatacctccggttgcagagattagaaccggagaagtgttccgggtggagatgatggacttcagtgggggtgggattacgcaggaatactctgccgaagacatcaaacatgccgatccctctattgtacattacatgagtgggccgattagagttgtggatgcagacggagccccggcaaagccgggagatcttcttgcagttgaaatctgcaacttgggtcctcttcctggggatgaatggggctatactgcaacatttgacagagaaaatggaggcggttttctgactgatcactttccctgtgcaaccaaagccatctggtattttgaaggaatatatgcttattctcctcatataccaggagtaagatttcctggcctaactcaccctggaataattggaactgcaccgtcgatggaactccttaatatatggaatgaaagggagagaaaacttgaagaaactggtcttcaaactctcaaattatgtgaagttctgcactcaaggccattggcaaacctaccatcacccaaaggttgccttcttggcaagatccaaaaggggactcctgaatgggaaaagattgctaatgaggctgcaaggacgattcctggaagagaaaatggaggaaattgtgacatcaaaaatctcagtagaggatcaaaagtataccttccagtatttgtagagggagcaaattttagtactggggacatgcacttttctcaaggcgatggtgaagtctcattctgcggggctattgagatgagtggttttctagaactcaagtgtgaaatcattagaggtggaatgaaagagtacctcacaccaatgggaccaactccactgcatgtaaacccaatattcgagataggcccagtcgagccaagattctcagaatggttagtatttgagggcatcagtgttgatgagagtgggagacagcactaccttgatgcaagtgtcgcttacaaacgtgcagtgctcaatgcaatcgactatctgtccaaatttgggtactctaaagaacagatctatcttcttctgtcatgctgcccatgcgaaggaaggatttcangaatagtcgattcccccaatgctgttgccacccttgccatcccaacatccatctttgatcaggatattcgtccaaaaaccaacaaagtcccagttgggccacgggttgtgaggactccagatgtcttaaaatgcgcttacgaagggaatttgccaaccacaaagaacccttgcaacaatatctgatcaccgctaaacatcgacagcaagaagaagcagattatgctcaatattcccgaaagcgtgtagacgtaattgaaatatatat

SEQ ID NO: 851 - DNA, 1587 bp, Helianthus annuus
caaaatggctcaacatggtcctagactggtggtgccaatagacgtaaccaagaaaccaagggaacagaagcttccgcttcataaccggtggcaccctgacataccacccgttgctgaggttcgtgtcggggaagtgtttcgggtcgagatggtagatttttctggtggtggtatcactaaagaatacactgctgaagacatcaaattctctgaccaatctgttgtgcattatctgagtgggccaattagagttgttgatgaggatggaccggctaaaccaggcgatcttcttgcggttgaaatatgcaatttgggtcctcttcctggtgatgaatggggttttactgctatttttgatagagaaaatggtggtgggttccttactgatcatttcccctgtgccacaaaagcaatttggtattttgaaggaatatacgcttactctcctcatattccaggtgtacggtttccgggtttaacacacccgggaataatcggaacagcgccttcaatggagctccttaagatatggaatgaaagggagagagagcttgaagaaaatggcttaaaatctttcaagttatgtgaagttttgcattcaagaccattggcaaacctgccttcaacaaaaggttgtctgctcggcaagattgaggaaggaagtcgcgaatgggaaaaaatggctaacgaggctgcaaggacgattccgggaagggaaaatggagggaactgtgacattaagaatctaagtagaggttcaaagatataccttccagtgtttgtggaaggagctaactttagtacaggagatatgcatttttcacaaggagatggtgaagtttccttttgtggggccattgagatgagtggcttccttgagctcaagtgtgagataataagaggagggatgaaagaatatctaactccaatgggacctactcctcttcatgttaatcctatattcgagatcgggccagtagagcccagattctcagaatggttagtatttgagggaatcagtgttgatgagagtggaagacaacattaccttgacgccagtgttgcttacaagcgagccgtcctaaatgcaatcgactacctgtccaaatttggatattccaaggaacaggtgtatcttttattgtcatgttgtccttgcgaaggaaggatttcaggaatagttgatgctccaaatgctgtcgccacacttgcaattccaactgctatatttgatcaggatattcgcccaaaggcaaacaagttgccaataggaccacgcgttgtcaggaatccagatatcccaagatgcacttatgatggaaatttaccgatcacaaagaacctgagtgcaacaggaagttaataacaaaagtgctaaacacatgccatgctctattatcttatattgtcaaaatgcactcaattaagaacaaacaatttccatacgttgtcaatgttaagctacttactctagattgatcaatcgaactgttcacaaataaataaagggttacaaaagatcttatgcgtgcacttttgaagcagctcagggtcgatttgtggcaatgctcatagatttaatgcaca

SEQ ID NO: 852 - DNA, 1808 bp, Populus trichocarpa
tgtcaatcatgggtgtcaagcttcaactgaaagtgaaggttgaagctgcagcactactccatgaacacacctccaagaaagatacaggatttataactctcttttcctttcaactacatcaagattgaaagttaagagagaaaggagccatggagcaacatggtgcacggctggtctttcccatagatgtcaaaaagaagccatgggaacagaaacttccacttcacaaccggtggcacccagacataccgccagtcgcagaggtaacagtcggagagcttttcagagttgagatggttgacttcagtggaggtcgtatcacgaaagaatactccgcagaggacatcaagaacgctgatccctctattgttcactatctcagtggcccaattagagttttggacgaggaagggaagccagcacagccaggtgatctacttgctgttgaaatatgcaacttgggtcctctccctggagatgaatggggttttacagcatcatttgacagagaaaatggaggtggtttcttgactgaccactttccttgtgcaaccaaagctatttggtattttgaaggaatctatgcctattcgcctcaaataccaggggttcgatttccaggtctgactcaccctggaatagttggtactgcaccatcaagggaactcctgaacatatggaatgaaagggagagagaagtagaggaaaatgggctcaaacatctgaagctatgcgaagttttgcattcaagaccactggcaaatctaccatcaacaaaaggttgccacctaggaaagatccaaaagggtacgcctgaatgggaaaagattgctactgaggcagcaagaacaattccaggaagagaaaatggaggaaattgtgacataaaaaatcttagtagaggttcgaaagtgtatcttccagtattcatagaaggagcaaatgttagcactggtgacatgcacttctctcagggagatggtgaaattgccttctgtggggcgattgagatgagtgggttcttggagctcaagtgtgaaatcataaagggtggaatgaaagagtaccttaccccaatggggccgactcttcttcatgtgaacccaatctttgagataggccctgtggagccaagattttcagaatggttggtatttgaaggcatcagtgtagatgagagcggaaggcagcacttccttgatgcaagtgttgcatacaagcgagcagtgctcaatgccatcgactacctctctaaatttggctactccaaagaacagatgtatcttctgctatcatgttgcccatgtgaaggaaggatttctggaatagtcgattctcctaatgctgttgccacctttgcaatcccaacatctatctttgaccaggatattcgtccaaaaacgaaggtgccagttggaccccgactggtgaggacaccagatgtgctaaagtgcacttatgatggaaacttgcccataactaagaaccccagcgccatgacttgaacagaaccaaggtgcttcatggaaacagaaggttttggctaaaccttttatgcctaataatcatatcaatgtctatatggatgagataaaacatggctgcaaaaccttccatgtccgggttatgttcattagctctttgtaataataagaggcatggagcatcatttcatgaggtgatgttggccttttgcattaaatctattttgtctaaattttatgcttttgttatgccactacaaatatgctgaacaataacccatcacaccatttacacttcatagagtaaatacttctcttctatat

SEQ ID NO: 853 - DNA, 1368 bp, Centaurea maculosa
caccaaaactagtagtacctgtagacctgaagaagaagccatgggagcaaaagcttcctctgcataaccgttggcatcccgagataccaccggttgcagaggtgaaaactggacagattttcaggatagatatggtggattggactggaggtgccataaaagatgatcattctgctactgatgtgaaacacatagacctttccactgtgcattatttgagtggaccgatcagggtcgtggatgaggaaggaattccggcgaaagcgggcgatcttctagcggttgaaatatgcaacttgggtcctcttcctggtgaagaatggggtttcacggcgatctttgatcgagaaaatggtggtggtttccttactgatcacttcccttgtgctactaaagctatttggtattttgaaggaatatatgcttactctccccatataccaggtgtaagatttccgggtttaacacatcctggaatcattggaactgcaccttcaatggagctacttaatatttggaatgaaagagaaagagagctggaagaaaatggtctaaagtcattgaaattatgtgaagttttgcattcaaggccattggcaaaccttccatcaacaaaaggatgtgttttgggcaagattccagaaggaagtgaggagtgggagaagatcgctaacgaagctgcaagaacaatccccggaagggaaaacggcgggaattgtgacatcaagaatctaagtagaggttcaaagatctaccttccagtgtttgtggaaggagctaactttagtacaggagatatgcatttctcccaaggcgatggcgaagtttccttttgtggggccatcgagatgagtggcttccttgagctcaagtgtgagatcataagaggcggtatgaaggaatacttgactccaatgggaccaacacctcttcacgttaatccgatatttgagatagggccggtagagccaagattctcggaatggcttgtatttgagggaatcagcgtggatgagagcggtagacaacattaccttgatgcaagtgtggcttataaacgcgcggttttgaatgcaattgactatctttccaaatttgggtactcaaaagaacaggtgtatcttttactgtcatgttgtccgtgcgaggggaggatttcgggaatagtggatgctccgaatgctgttgccacacttgcaattccaactgctatctttgatcaggatattcgaccaaaacgtagcaagttgccgataggaccacgggtggtgaggaatccagatattccaagatgcacttatgacggaaatttacccatcacaaaaaaccctggtttaacaggaagttgataagattaatggtaacact

SEQ ID NO: 854 - DNA, 1456 bp, Ambrosia trifida
ggcaaataaataaatatctactccaagatatgcatatcttcctctcagataagttcactaaaaaataacatctatacaaactaaaactaaaacctttcatcacaaaatggctcaacatggtccaagactagtggtgccaatagatgtaaccaagaaaccaagggaacagaagcttccccttcataaccggtggcaccccgacataccacccgttgctgaggttcgtgtcggtcgaggtttttcgtcgtcgagatggttgatttttctggtggtggtatcactaaagaatacactgctcaagacatcaaattttctgaccagtctgttgtgcattatctaagtgggccgattagagttgttgatgaggatggaccggctaaaccaggcgatcttcttgcggttgaaatatgcaatttgggtcctctgcctggtgatgaatggggttttacagctatttttgatagagaaaatggtggtggtttccttactgatcatttcccttgtgccacaaaagcaatttggtattttgaaggaatatatgcttactctcctcatattccaggtgtacggtttccgggcttaacacacccgggaataatcggaacagcgccttcaatggagctcctaaacatatggaatgaaagggagagagagcttgaggaaaatggcttaaaatcattgaagttatgtgaagttttgcattcaagaccattggcaaacttgccttcaacaaaaggttgcttgcttggaaagattgaggaaggaagtcgcgaatgggagaagatggctaccgaggctgcaaggactattcccggaagggaaaatggagggaattgtgacatcaagaatctaagcagaggttcaaagatataccttccagtgtttgtggaaggagctaactttagtacaggagatatgcatttctcacaaggagatggtgaagtttccttttgtggggccattgagatgagtggcttccttgagctcaagtgtgagataatacgcggtgggatgaacgaatatctaactccaatgggacctactcgtcttcatgttaaccctatattcgagatcgggccagtagagcccagattctcagaatggctggtatttgagggaatcagtgttgacgagagtggaagacagcattaccttgatgcaagtgttgcttataagcgtgcagtcctaaacgcgattgactacctgtcgaaatttgggtactccaaggaacaggtgtatcttttattgtcatgctgtccttgtgaaggaaggatttcaggaatagttgatgctccaaatgctgttgcaacacttgcaatcccaactgctatatttgatcaggatattcgtccaaagccgaacaaggtgccaataggaccacgcgtcgtcagaaatcctgatatcccaagatgcacttacgatggaaatctaccgataacaaagaacctgagtgcaa

SEQ ID NO: 855 - DNA, 1722 bp, Amsonia hubrichtii
tttgtaaaaactgagtggtgccatggctttgcgcggtgctagattggtgattcctatagatgtgaagaagaagccaggggaacaaaagcttccgcttcacaaccggtggcacccggacataccaccggttgccgaggttagaactggagaagttttcagggttgagatggtggactttagcggaggaggcatcacgcaggagttcaccgctgaagatatcaagaatgccgacccctctatcgtacattacctcagtgggccaatcagagtcacagatgctgatggcattccagccaaaccgggtgatcttcttgctgttgaaatttgcaacttaggtccgcttcctggggatgagtggggcttcactgcaatcttcgacagagagaatggtggtggttttctgactgaccatttccctcatgcgactaaagccatttggtactttgagggaatatatgcttactctcctcatataccaggtgtccgttttcctggtttgacccaccctggcataattggaacggcaccttccatggaacttcttaacatatggaatgaaagagaaagaactctcgaagaaactggtcatcaatctcttaaattatgtgaggttttgcactcacgacccttggccaacctaccatcaacaaaaggctgttatctgggcaagattcaagagggctctcctgaatgggaaaagattgcctgtgaggctgcaaggacaatccctggaagagaaaatggtggaaattgtgacatcaaaaaccttagcagaggctcaaaggtttaccttccagtgtttgtggaaggagcaaatcttagtactggagatatgcacttttctcaaggagacggcgaggtggcattctgtggggcaatcgagatgagtggctttctagagctcaaatgtgaaataataaggaatggaatgaaagaatacctcactccaatgggtccaactcccctgcatgtaaaccctatatttgagataggccctgtcgaacccaggttttcagaatggttggtatttgaaggaatcagtgttgatgaaagtggaagacaacactttcttgatgccagcgttgcctacaaacgtgcagtgctcaatgcaattgactatctgtccaaatttgggtattccaaggaacaggtttaccttctactttcatgctgcccctgtgaaggaaggatttcaggaatagttgatgcccccaatgctcttgctacccttgctattccaatcgctatctttgaccaggatattcgtcccaaaaccaataaagtgcctactggaccacaaattgtaaggaatccaggtctgccacagtgtccctatgaaggaaacttgccaacaacaaaaaatccttgtgctacagtttaatttccatcaaaggagaagcacaaaagcagaagcattatccgagacattttagcaagactttgagaagttttatgtatgccaagcaatagtatcaattcaaaagaagcaccctccaataccatcatcaaaaagtttcaagactcttcagcgagtaaacattacctatctggcttactttatagtggaggtgactaatttgaggaagatatggtttgcttaaattagtcaaattttacattcctcaaaaagaatgagaaaatcatggcgaacagaaatttaagttgattgtaaaagggcaagcagattgcttatggaaaaacaatttggtagtgaaatgaaca

SEQ ID NO: 856 - DNA, 1993 bp, Cannabis sativa
ccgaaaataaatgccaaaaattggattcattaggcaacatcaacgacacaaaccaacacgtgttcataaaataaaaatcccattaaaacattcaactccactaactaacatcctattgtcatttgtaatatttcttttcctttcttcctttgttttcctttgaaagattaagtaactaactacatctagttgggttatttaattcaagtccgggctattgggttggagcaagacatggcccaatacggcccaacagttatggtccccatcgacgtgaagaagaagccccgggaacagaaggttccacttcacaaccggtggcaccctgacatacctccggtggcggaggcggcggtcggagatgtatttagagttgaaatggtggattttagtggcggcggtattaccaaggagtactcggctaatgacatcaaatttgctgatccttttattgttcattatcttagtgggccaatcagaatagtggacaaagatgggataccggccaagccaggggatcttctagtggttgaaatatgcaacttgggtccactcccaggagatgaatgggggttcacagctacctttgatagagaaaatggaggtggttttcttactgatcattttcctgctgcaaccaaagctatttggtattttgaaggaatttatgcttactctcctcacataccaggagtaagatttcctggtttgactcacccgggaatagttggaacagctccatcaatggaacttcttaatatttggaatgaaagggaaagacagcttgttgagaatggagttgagtctttgaaactttgtgaagttgtgcatcaacggccaatggctagcttaccaacaccaaaaggttgtgttctaggaaagattcaagaaggtaccccagagtgggagaaaatagctagagaggctgcaaggacaataccaggaagagaaaatggtgggaactgtgacataaaaaacctaagtagaggatcaaagatctacctacctgtattcgtagaaggagccaatctaagtactggtgacatgcatttttctcagggagatggtgaagtctcattttgtggggcaattgagatgagtggctttcttgatcttaagtgtgaaattataaggggtggaatgaaagagtatttgacaccaatggggccaactcctcttcatgtaaacccaatatttgagataggccctgttgaaccaagattctcagaatggcttgtctttgagggtataagtgttgatgagagtgggagacagcattatctcgacgcaactgtggcttacaagcgtgcagttctcaatgctattgactacctctccaaatttggatacagcaaagaacaggcctaccttctcttgtcttgttgcccatgtgaagggagaatttctggaatagtagatgccccaaatgctatggctaccttggcaattccaacagctatatttgatcaggatattcgtccaaaagcaagtaaagtacccatagggccccgggtagtgaggaaaccagatgtactgaaatgtagttatgatggaaatttgcccacaacaaccaatctttcttctagctctacctcttaaatctcttcagggaaagggtaatgatatgaataaagaaagatagtggtaatgaaactttatctttctctttaatgatgctataataatgtatggtagaacttgttgttgttgttgttgaaataatctttcctttgggagaagaatgtaaataatgcaatgacaaagtacacataataatgtggttgatgataatcaaatatggccctgtttgaaattgtaaacgaataggaataaatgtaatatcctaatcttatataagattagtaagaaactggcataagaatcagtaatgagataactttcactacaaaacaagcttgtagctaagctctgttgttttttcccactgcatggaccaatttctttatcaagcctcagctgcagcataccaaat

SEQ ID NO: 857 - DNA, 1367 bp, Manihot esculenta
ctttatggctcaatacggttcaaggctggtgttccctatagatgtgaagaagaagccatgggagcagaaactcccacttcacaacaggtggcacccggacatacctccggtcgcagaggtcacggtcggagagtttttaaggattgagatggtggacttcagtggaggtggaattaaacaagaaaactcagcagaggacatcaaacatgctgatctttctattgttcattatctcagtggaccaattagagttctggacaaggaaggaattccagccatgccaggtgatctcctgatggttgaaatttgcaacttgggtcctcttcctggagatgaatggggtttcacagcaacatttgacagagaaaatggaggaggttttctgactgaccatttccctagtgcaacaaaagctatttggtattttgaaggaatatatgcctattctcctcatataccaggggtaagatttccaggtttgactcatcctggaatagttggaactgctccatcaatggaactcctcaaaatatggaatgaaagggagagagatgttgaagaaaatgggttaaagtctctcaaactgtgcgaagttttgcactctagaccactagcaaatttaccatcaacaaaaggatgccatctgggtaagatccagaagggcactcctgagtgggaaaggattgccaaggaggcagcaaggacaatcccaggaagagaaaatggaggaaactgtgatataaaaaatctcagtagaggttcaaaagtataccttccagtattcgtagaaggagcaaatcttagtacaggtgatatgcacttctctcaaggtgatggtgaagtatcattctgcggtgcaatcgagatgagtggttttctagagctcaagtgtgaaattatacggggtggaatgaaggagtaccttacaccaatggggccaactcctcttcatgtgaacccaatctttgagatagggccaacggagccaagattctcagagtggttggtgtttgagggaatcagtgttgatgagagtggaaggcagcattatcttgatgcaagcattgcttacaagcgagcagtgctaaatgccattgattacctctctaaatttggttactccaaggaacagatgtatcttctgctatcttgctgcccatgcgaaggaaggatttctgggatagttgatgctccgaatgctgttgcaaccttggcaatcccaacagctatctttgaccaggacatacgtccgaaagccagcaaggtgcctgttggaccccgggtggtgaggaaaccagatgtgctaaaatgcacttatgatggaaacttgcccatcacaaagaaccccagcgccatgtcataactac

SEQ ID NO: 858 - DNA, 1500 bp, Flaveria ramosissima
tcttaaataagtttagtaaaaaataactttggaaaccagactcaaccctttgtcacaaaatggctcaacatggtcctagagtggtggtgccaatagatgtaaccaagaagccaagggaacagaagctcccccttcataaccggtggcaccccgatataccgcccgttgctgaggttcgcgttggggaggtttttcgggtcgagatggttgatttttctggtggtggtatcactcgagagtacactgcccatgacatcaaatactctgatcaatcagttgtgcattatctgagtgggccggttcgagtcgttgatgatgatgggccggctcgaccgggtgatcttcttgcagttgaaatatgtaatttgggtcctcttcctggtgatgaatgggggtttactgctatttttgatagagaaaatggtggtggttttcttactgatcatttcccttgtgctacaaaggcaatatggtattttgaagggatatatgcttactctcctcatattccaggtgtacggtttccgggcttaacgcatccggggataatcggaacagcaccttcgatggaactcttgaatatatggaatgaaagggagagagagcttgaagaaaatggtttaaagtcattgaagttatgtgaagttttgcattcaagacctttggcaaacctgccttcaacaaaagggtgtcttcttggccagattcctgaaggaactcccgaatgggagaagatcgcgctcgaggctgcaagaacgattccaggaagggaaaatggagggaattgtgacatcaagaatctaagtagaggttcaaaaatataccttccagtatttgtggaaggagctaacttcagtacaggagatatgcatttctcacaaggagatggtgaagtttcgttttgtggcgcgattgagatgagtggtttccttgagctcaagtgtgagataatacgcggtgggatgaaagagtatttaactccaatgggacctactcgtcttcatgttaatcctatatttgagatcggtccggtagagcccaggttctcagaatggctggtgtttgaggggataagtgttgatgagagtggaagacaacattaccttgatgctagtgttgcttacaaacgcgcagtcctgaatgcaatcgactacttgtcgaaatttgggtactctaaagaacaggtgtatcttttactgtcatgttgtccttgtgaaggaaggatttcagggattgttgatgctcctaatgctgttgcaacacttgcaattccaactgctatctttgatcaggatattcgtccgaagcagaacaaggtaccgataggtcctcgcgtggtaagaaatccagatattccaagatgtagttatgatggaaatttaccaatcactaaaaaccttagtgcaaactaagttaaccacaaacgtgttgaatacatgccattctattctccgatcaagacactcaagttagaaaatacgagtttcaatacttaactat

SEQ ID NO: 859 - DNA, 1692 bp, Sesamum indicum
ctttctgacagggaatcctacaggtgcaagttcgtgtaataattagtagggttttgatgagatgagaggttttttgtgctgaacagaactgctgatttcactacagaattaaagttgtaatatttattgatggggtctgatcgtcatggtgcaagagtggtggtgccaatagatgtgaagaagaagccatgggagcaacagctgcccctccacaaccggtggcatcccgccatacctccggtggcggaggtctgcacaggagagctcttcagggttgagatggtggacttcagcggcggcggcataacaaaggactacactgctcaagatatcaagtttgctgatccttcgattgtgcattatcttagtggacctattagcgtggtcgacacggaagggaatccggccaagccaggtgatcttctagctgtcgaaatatgcaatttgggccctctaccgggagatgaatggggttttacagcaatcttcgacagggaaaacggtggtggatttcttacggaccatttccctcgtgcaacgaaagctatatggtattttgaaggaatatatgcctattctcctcatatacctggggtgagatttccgggcttgacacaccctggaatagttggaactgcaccttcaatggaattgctgaatatatggaacgagagggaaagggaactcgaagaaaccggtcttcagtctctaaaactatgtgaggtgttgcattcacgtccgcttgcaaacctcccgtcgacaaagggctgcgttcttggcaagattaaggaaggaactccagagtgggaaagaatagccagggaggcggcaaggacgattcctggaagagaaaatggaggaaactgcgacatcaagaacctcagccgaggttcaaaagtgtacctgccggtgtttgtggacggagcgaatcttagtaccggggatatgcatttctcacaaggtgacggtgaagtggcgttttgtggggcgatcgagatgagtggttttctggagctcaagtgcgaaatcattagggacggcatgaagaagtacttgacgccaatggggccgactccattacacgtgaatccgatctttgagatcgggcctgtcgagccaagattctcagaatggttagtttttgagggcattagcgtcgatgagagtggacgacaacattatcttgatgctagtgttgcttacaagcgtgcggtgctcaatgctatcgactatatttccagattcgggtactctaaggaacaggtctaccttctcctctcatgctgcccttgcgaaggaaggatttcaggcatagtggacgccccaaacgcggttgccacccttgcaattccagtggctatattcgatcaggatattcgtcccaaaactaccaccgtgcccaccggccccaggctcgtgaggaatccaggtctcccacagtgcacttacgatggaaacttgccgacgactagaaatccatgtgctacaacctgactgaaatggcaagcaagcaggccggggcataaatatgtagttagcaataaatggaaactcgtagtagaatatgcagaatgatgtgcctgattttctgtaattaaatgcatatgatgacatggaatgtgttcggtcagtatctcaacaggaaactctgttcaggaatcagcagtattaatcctgcaaaatataatgggg

SEQ ID NO: 860 - DNA, 1669 bp, Solanum phureja
agaacaccaagtcacactatggctcctccaactccaagactagtaatccccatagacctaaagaagaagccatgggaacaaaagttgccactccacaaccgttggcacccagagatacctcctgtaactgagattaaaacaggggagatgttccgaattgagatggttgattggacagcaggcgctatccaagataataactctgcaattgatgtaaaaactgttgatctatccactgtccattatctcagtgggccaataagagtagttgacacagatggaaatcctgctgaaccaggtgacctccttgctgttgaaatatgcaacttagggcctctccctggagatgaatggggttttacagcaatattcgacagagagaacggtggaggatttctaacagaccattttccccgtgcaactaaagctatttggtatttcgaaggcatatatgcctactcacctcatataccaggtgtaagatttcctggtttagttcatcctggaataattggaacagcgccttcaaaagaactactcaatatatggaatgagagggaaagaaagctcgaagaaactggtccccagtctctcaaattatgtgaggtcttgcattctagaccattggctaacctaccttcaacaaaagggtgcattcttggcaagattcaagatggaactgctgagtggaatagaattgccgatgaggctgcaagaacaatacctggacgtgaaaatggaggaaactgtgacatcaaaaatctcagcagaggttcaaaaatataccttccagtatttgtagaaggagcaaacctcagtactggtgatatgcatttttctcaaggtgacggtgaagtatcattttgtggggcaattgagatgagtggcttcctagagctcaagtgtgagattttaagaaacggaatgaaagaatatctcactccaatgggacccacaccactacatgtgaacccaatttttgagatagggcccatggaaccaagattctcagagtggttggtgtttgagggcatcagtgtagatgaaagtggacaacaacactatcttgatgccagtgttgcatacaagcgtgcagtactaaatgcaattgattacctctcaaaatttggctactcaaaggaacaggtttatcttttactttcgtgctgtccctgcgaaggaaggatttcaggaattgttgatgctcccaatgctgttgccacccttgccattccaactgctatttttgaccaggatattcgcccaaaggtcaataaagtgccccttgggccaagacttatgaggaatccaggaattccgcaatgtacttatgatggaaacctgccaatcaccaagaatccttcgctccatcaacaagggagcagctgcgacatggatgctagttcttgagctggggatgtgcatgtacagctactgaaggaagataagaccaaattgaaagaagcaaacctgagatgcataaagcctaactaggcattctaagcatctaaagatgaagacaagttcttcaaaatgtaatagcttggtatcaacagtgagaccataaataatttttgaatcgtaacacggtaaacttcatactaggactaatcatcctaatgttgctgcctttcgtgaattttaagttaataaattgcttaatttcaat

SEQ ID NO: 861 - DNA, 3158 bp, Solanum lycopersicum
tgagtgcacaatatgactagtgtgattcgtgcatctgcattcaaatatagtaagtaccaaggattttgtatgaagttcacctaattgatacgaggggaacacttctcacactggctaccaccaggatagaaagtaccttgagtaacatttttcaagtgaagatgtcccaatcaaactacggaacatgagtgaagtcatttcctttcttgattgaagacattgcaaccacatatgtgatatgtagaaaagtattctcagagatgagtaccacaagactacgttcagccgttgagggaccatcatccttgtgggcagacaaaaaaccaagcacttgcagtgaagtgaagccatcaaaagatattggcaaatcctaaagattttgatttgtgggtcctctacaaaaggcaattaggtccaggattagctttaggaccattatttctgtcctcaaaatgatgatacttgtgaaaaataacacttctttttgcactgtttcttggtgaatgcaactgatgtatctctgttaaatcactaaagataaatcaaaggttaaatcaagtcatcacactagaatttaatctagataacacgataaaacttttcccgttactccctgatgagtggctaatgtttgcttgcagagggattatggtagcttttacctgttaaccaacatttgtactgattttgcctctttggaagtaactgtgttgataggacaccaaaaggcagatagtccaattggtggaaaaatcctaaccatattctaacttatcatgaactttgaacaaataccatgtatcttgaatataagtgagagagtaagttatgcgctaaaaagcgaataagaaagcttaaagaagggcttttcgaccttttcgggtgaatccaagcttgagaatctagctagggctatttgatctctccccaattccatctccgcttcacgaagctctgcataggaaaaaaaaatatgaattcaatgggtccaaggttagtagtgcaggtagatttaaaaaagaagccatttgagcaaaatccacctactcacaaccggtggcacctggagatacctccagtagcagaggtgcgagttgggtaggtgttcagggttgagatgttggattttagtggaggcggcctaacaatagactatactgccgaggacatcaagcatgcggatctgtctgttgtgagttcttcacaacactcttatgtcattgttttcaagctagaaagggttatttcttgctctgattttactggcctggattgagctgagttttccaagttgaatatactcactaagcgataaatactaacgtcaagtctgtccactgtccaatatttattgtcattttcaagaaggcaaaccgtgacaattactgagatgtgacccccatttgtcaactagcaaccttgtcccaatcagctaggaaccttgtcagttgctttccttagagtgccatgtaatggaagtaaacaggctcagagattcacagaacactaagtcaccatggctcctccaactccaagactagtaatccccatagacctaaagaaaaagccatggcaacaaaagttgccactccacaaccgttggcacccagagatacctcctgtaacagagattaaaacaggggagatgttccgaattgagatggttgattggacagcaggctctatccaagataataactctgcaattgatgtaaaaaccgttgatctatccactgtgcattatctcagtgggccaatacgagtcgttgacacagatggaaatcctgctgaaccaggtgatctccttgctgttgaaatatgcaacttagggcctctccctggagatgaatggggttttacagcaatattcgacagagagaacggtggaggatttctaacagaccattttccccgtgcaactaaagctatttggtatttcgaaggcatatatgcctactcacctcatataccaggtgtaagatttcctggtttaattcatcctggaataattggaacagcgccttcaaaagaactactcaatatatggaatgagagggaaagaaagctcgaagaaacaggtccccgatctctcaaattatgtgaggtcttgcattctagaccattggctaacctaccttcaacaaaagggtgcattcttggcaagattcaagatggaactcctgagtggattagaattgccaacgaggctgcaagaacaatacctggacgtgaaaatggaggaaactgtgacatcaaaaatctcagcagaggttcaaaaatataccttccagtatttgtagaaggagcaaacctcagtactggtgatatgcatttttctcaaggtgacggtgaagtatcattttgtggggcaattgagatgagtggcttcctagagctcaagtgtgagattataagaaacggaatgaaagaatatctcactccaatgggacccacatcactacatgtgaacccaatttttgagataggacccatggagccaagattctcggagtggttggtgtttgagggcatcagtgtagatgaaagtggacaacaacactatcttgatgccagtgttgcatacaagcgtgcagtactaaatgcaattgattacctctcaaaatttggctactcaaaggaacaggtttatcttttactttcgtgctgtccatgcgaaggaaggatttcaggaattgttgatgcccccaatgctgttgccacccttgccatcccaacagctatttttgaccaggatattcgcccaaaggtcaataaagtgccccttgggccaaggcttataaggaatccaggaattccacaatgtacttatgatggaaacctgccaatcaccaaaaatcctttgctccatcaacaagggagcagctgcaacatggatgctagctcttgagcatggtatatgcatgtacagctactgctggaattgtatgaccaagttgaaagaagcaaaggtgagatgcatgaagcctaactagaccttcttaacatctaaagatgtagacatgttcttgaaaatgtaatagctcggtatcaccagtgagaccataaataatttttaaatcggaacatggtaaacttcatacttggactaatcatcctaatgttgctgcctctcgtgaattttcagagttaaaacattg

SEQ ID NO: 862 - DNA, 1542 bp, Centaurea maculosa
agcttatcatcaaatggctcatcatggtccaagactcctggttccaatagatgtcaccaagaaaccaacccaacagaagctcccccttcacaaccgatggcaccccgatataccacccgttgcccaggttagcgttggcgagctctttcgggtcgagatggttgatttctcaggaggtggtatcacacgagaatataccgcccacgatatcaaatacgcagaccaatcagtcgtgcattatttgagtggaccgataagggtcgtggatgaggaaggaattccggcgaaagctggcgaccttcttgccgttgaaatatgcaacttgggtcctcttcctggtgaagaatggggcttcacggcgatcttcgatcgagaaaatggcggtggtttccttaccgatcatttcccttgtgctactaaagctatttggtattttgaaggaatatatgcttactctccccatataccaggtgtaagatttccgggtttaacgcatcctggaatcattggaactgcaccttcaatggagctacttaatatatggaacgaaagagaaagagagctggaagaaaatggtctaaagtcattgaaattatgtgaagttttgcattcaaggccattggcaaaccttccatcaacaaaaggatgtgttcttggcaagattccagaaggaagtgaggagtgggagaagattgctaacgaagctgcgagaacgatccctggaagggaaaacggggggaattgtgacataaaaaatctaagtagaggttcaaagatctaccttccagtgtttgtggaaggagccaactttagtacaggagatatgcatttctcgcaaggcgatggcgaagtttcgttttgtggggccatcgagatgagtggcttccttgagctcaagtgtgagatcataagaggggggatgaaggaatacttgactccaatgggaccgacacctcttcacgttaatccgatatttgagataggcccggtagagccaagattctcggaatggctcgtatttgagggaatcagcgttgacgagagcggtagacaacactaccttgatgccagtgttgcttataaacgcgcggttttgaatgcaatcgactatctttccaaatttgggtactcaaaagaacaggtgtatctattactgtcatgttgtccatgcgaggggaggatttcgggaatagtggatgctccgaatgccgttgccacacttgcaattccaactgctatctttgatcaggatattcgaccaaaaggtaacaagttgccgataggaccacgggtggtgaggaatccagacattccaagatgcacttatgacggaaatttacccatcacaaaaaaccctgctgcaacaggaagttgataagatttatggtaacactactagtgattatataaatatgatatgtatatgtgtgtgtatggtcttatgggaactaaatatgtatttgtgaactagagttatattcagccaacttcttttagaattcatgatatgcttacaaaaacagatgtaaagacctttgtgaa

SEQ ID NO: 863 - DNA, 1329 bp, Centaurea maculosa
atggctcatcatggtccaagactcctggttccaatagatgtaaccaagaaaccaacccaacagaagctcccccttcacaaccgatggcaccccgatataccacccgttgcccaggttagcgttggcgagctctttcgggtcgagatggttgatttctcaggaggtggtatcacacgagaatataccgcccacgatatcaaatacgcagaccaatcagtcgtgcattatttgagtggaccgatcagggtcgtggatgaggaaggaattccggcaaaagctggcgatcttcttgcggttgaaatatgcaacttgggtcctcttcccggtgaagaatggggtttcacggccatctttgatcgagaaaatggcggtggcttccttactgatcatttcccttgtgctactaaagctatttggtattttgaaggaatatatgcttactctccccatataccaggtgtaagatttccgggtttaacgcatcctggaatcattggaactgcaccttcaatggagctacttaatatatggaacgaaagagaaagagagctggaagaaaatggtctaaaatcattgaaattatgtgaagttttgcattcaaggccattggcaaaccttccatcaacaaaaggatgtgttcttggcaagattccagaaggaagtgaggagtgggagaagattgctaacgaagctgcaagaacgatccccggaagggaaacgggggaattgtgacataaaaaatctaagtagaggttcaaagatctaccttccagtgtttgtggaaggagccaacttcagtacaggagatatgcatttctcgcaaggcgatggcgaagtttcgttttgtggggccatcgagatgagtggcttccttgagctcaagtgtgagatcataagaggggggatgaaggaatacttgactccaatgggaccgacacctcttcacgttaatccgatatttgagataggcccggtagagccaagattctcggaatggctcgtatttgagggaatcagcgttgacgagagcggtagacaacactaccttgatgccagtgttgcttataaacgcgcggttttgaatgcaatcgactatctttccaaatttgggtactcaaaagaacaggtgtatcttttactgtcatgttgtccgtgcgaggggaggatttcgggcatagtggatgctccgaatgccgttgccacacttgcaattccaactgctatctttgatcaggatattcgaccaaaacgtaacaaattgccaataggaccacgggtggtgaggaatccagatattccaagatgcacttatgacggaaatctacccat

SEQ ID NO: 864 - DNA, 1689 bp, Castanea mollissima
atactgaacttttgttccttcagctagctatagaccaaaagcctgaaattttagatagagccagccatggcacaatatggttcgagactaattgtgcctatagatgtgaagaaaaagccatgggaacagaaactccctcttcacaaccggtggcacccagacatacctccggttgctgaggttaaagtaggagagacttttagagtagagatggtggatttcagtggaggaggtataacacaggactacactgcagaggacatcaagcatgctgaacaatctattgtacattacctcagcgggccgattagggttgtggacgaggatgggacaccggccaagccgggtgatctcctagtagttgaaatattgaacttgggtcctcttcctggagatgaatggggttatacagcaacatttgacagagaaaatggaggtggttttctgactgaccattttccttgtgcaaccaaagcgatttggtactttgaaggaatatatgcctactctcctcacataccaggagtacgatttccgggcttaactcaccctggaatcattggaactgcaccatcattggaactgctcaacatatggaacgagagggaaagagagcttgaagaaaatgggctccaaacgctcaaactatgtgaggttttgcactcacgaccattagcaaacctaccaacaaccagaggctgtgtccttggaaagattgaaaagggcactccagaatgggaaaagattgccagggaggctgcgagaacaattccaggaagagaaaatggtggaaattgtgacatcaaaaatctcagtagaggttcaaagatataccttccggtatttgtagatggagcaaatttcagtactggtgacatgcacttctctcagggggatggtgaagtctcattctgtggggcaattgagatgagtggtttcctagaactcaagtgtgacattataaggggtggaatgaaagaataccttacaccaatgggtcccactcctcttcatgtaaacccaatctttgagataggccctgttgagcctagattctcagaatggttggtatttgagggcatcagtgttgatgagagtgggaggcaacactaccttgatgcaagtgttgcttataagcgagcggtactcaatgccatcgactacctctccaaatttgggtactccaaagaacaggtctatcttctgctgtcatgctgcccatgtgaaggaagaatatctggaatagttgattcccccaatgcttgtgctaccctagcaatcccaacagctatctttgaccaggatattcgtcccaaaaacaacaaggttccagttgggccccggctagtgaggaaaccagatgtcctaaaatgcacttacgatggaaatttgccaatcacaaaaaatcctagcacctcaacataaattctacaagccttgatctgcttagtcaaggagacactgggggtcacaatttcaatgccaactaggcttttatccatatctattacctgtattaagaaagaagggaggttttgttctcctctattcaaaaatactgttcatcagcactgtcttattgtgtaccagttctaccctcattaagtttatcaccatattattatactttgtgtatgttcttattggtgttcttacaaatcaataagcatcttatgttattaaaaaaaa

SEQ ID NO: 865 - DNA, 2189 bp, Lactuca sativa
gccacaacacccaacttttattacatcacaacttgatcaattttgtcattcatataaattccaattacaataagataaccgccgatatcaaaagtaaaaataaaaatcaccattacactagtaatcaaatacatacattccttaaactatatttactgatccaaccttacatttctaaaagtaaaactaagagagtactatttccaagtctagcttccactttcctactattgatttgagattatcttcatgtataattagatggtccatcatctcaatcaattctcctattcatccactcctaccacaaccaattaacggcagccaaccaatttccccaattgaaaacgatgtccaaaacagttttcaactccaagatgtcttctttctctcaaataaacattgacaaccattatcaccagactagactagaggtttaatcatcaaatggctcaacatggttcaagactcgtggtgccaattgacgtcaccaagaaaccacgacaacagaagctcccccttcacaaccggtggcaccccgacataccaccggtggctcaggtcactgtcggggaggttttccgggtagaaatggtggacttttccggtggtggtatcaccaaagaatacacagccgaagacatcaaatactccgatcagtctgttgtgcattatctgagtgggccgattagggttgttgatgaggaaggagaagcggctaaaccaggggatcttcttgtggttgagatatgcaatttaggtcctcttcccggcgatgaatgggggtttacggcgatttttgacagagaaaacggtggcgggtttctcactgatcatttcccttgtgccacgaaagcaatttggtattttgaaggaatatatgcttactctcctcatatacctggtgtacgttttccgggtataacacaccctggaataattggaactgcgccttcaatggaacttcttaatatatggaacgaaagggagagagagcttgaagaaaatggtctaaaatcattaaagttatgtgaagttttacattcaaggccattggcgaatctcccattaacaaaaggctgtcttcttggcaagattccagaaggaactcaagaatgggagaagattgccaatgaagctgcaagaacgattccaggaagagaaaatggaggaaactgtgacattaagaatcttagtagaggttcaaaaatttaccttccagtgtttgttgaaggtgctaactttagtacaggtgatatgcacttctcacaaggcgatggtgaagtttcgttttgtggggcgattgagatgagtggattccttgagctcaagtgtgagataatacgaggggggatgaaagaatacctaactccaatgggacctactcctcttcatgtaaaccctattttcgagatcggaccaatggagcctagattctcagaatggcttgtatttgaaggaataagcgttgatgaaagtggaagacaacattacctggatgcgagtgttgcttataagcgtgcagttctgaacgcgatcgattatctctccaaatttgggtactcgaaagaacaggtttatcttctactgtcgtgttgtccatgcgaaggaaggatttcgggaattgtggacgctccaaatgctgttgctactcttgcgattccaactgctatttttgatcaggatattcgtccgaagactaagaaggtgccagtagggccacgggtggtgagaaatccagatattccgagatgcagttacgatggggatttacccataacaaaaaatcctggtgcaacaggttgaatgggacatgatgtatttcgatgttgggaaaatgaacaaactatggaaactgttttaaaaataccattaaactaaattaatgctatcaaaaggtaaatatgaaaaactttggcctaaatatgaaaaacttgcataatcttcttctttctaggtttaaggctttaaccttctttttggtcttgacatttgaagtacctaaatatgaaaaacttgcattaactaatatttttcagcgggattaacgagtaggataggtcattttccttttttggacattttgatttgttatgacccccggctttgcaaatgctacaggtcataagcactcattcttggtaatctttggcctattttctaattgacaaaactgcacaaatggtccc

SEQ ID NO: 866 - DNA, 1768 bp, Quercus alba
aataatctgacttagtggttcctatcatgggtgtcaacttccaaatgaaaaagaatagctatgtgactctagcttcttttgaagaatcccttaagatactaaactttttttccttcagctagctatagaccaagcctgaaattttagatagagccagccatgtcacaatatggttcgagactaattgtgcctatagatgtgaagaaaaagccatgggaacagaaactccctcttcacaaccggtggcacccagacatacctccggttgctgaggttaaagtaggagaggcttttagagtagagatggtggacttcagtggaggaggtataacacaggactatactgcagaggacatcaagcatgctgaaccatctattgtacattacctcagcgggccgattagggttgtggacgaggatgggacaccggccaagccgggcgatcttctggcagttgaaatattgaacttgggtcctcttcctggagatgaatggggttatacagcaacatttgacagagaaaatggaggtggttttctgactgaccattttccttgtgcaaccaaagcgatttggtactttgaaggaatatatgcctactctcctcacataccaggagtacgatttccaggcttaactcaccctggaatcattggaactgcaccatcattggaactgctcaacatatggaacgagagggaaagagagcttgaagaaaatgggctccaaacgctcaaactatgtgaggttttgcactcacgaccattagcaaacctaccaacaaccagaggctgtgtccttggaaagattgaaaagggcactccagaatgggaaaagattgctagggaggctgcgagaacaattccaggaagagaaaatggtggaaattgtgacatcaaaaatctcagtagaggttcaaagatataccttccggtatttgtggatggagcaaatttcagtaccggtgacatgcacttctctcagggggatggtgaagtctcattctgtggggcaattgagatgagtggtttcctagaactcaagtgtgacattataaggggtggaatgaaagaataccttacaccaatgggtcccacccctcttcatgtaaacccaatctttgagataggccctgttgagcctagattctcagaatggttggtatttgagggcatcagtgttgatgagagtgggaggcaacactaccttgatgcaagtgttgcttataagcgagcagtactcaatgccatcgactacctctccaaatttgggtactccaaagaacaggtctatcttctgctgtcatgctgcccatgtgaaggaagaatatctggaatagttgattcccccaatgcttgtgctaccctagcaatcccaacagctatctttgaccaggatattcgtcccaaaaacaagaaggttccagttgggccccggctagtgaggaaaccagatgtcctaaaatgcacttacgatggaaatttgccgatcacaaaaaatccaagcacctcaacataaatcctacaagccttgatctgctaagtcaaggaaacacagggggtcacaatttcaatgccaactaggcatttatctatatctattacctgtaataagaaagaatggaggtattgttctcctttattcaaaaatactgttcatcagcactgtcttattgtgtaccagttctacccttatcaagtttatcaccatattattatacttttgtgtatgttcttatacgtgttcttacaaatcaataagcatctta

SEQ ID NO: 867 - DNA, 2194 bp, Vitis vinifera
tcgtccttttctagaagataatcagagactgtctaataaaaacgatacccaatttgtcagccactaattgtcagtcaactctccatcctgcggtagccccaatagtaaaattcatgagatccccaaagtctctggaattcacgacttcatccatggctccttcagctccaaggttaatagtaccaatagacctgaagaagaagccatgggagcagaagctacctcttcacaaccgttggcacccccaaattccaccggttgcggaggttatggctggcgaatattttagagtagagatggtagacgcaaatggaggcaatattaaggatgataattcttcactagatgtaaaactcattgattcctcatcttttcattttctcagtggacctatcagagttctggatgtggatggggttccagcgaagccaggagacctgcttgcagttgaaatatgcaacttgggtcctctgcctggtgatgaatggggttacacagcaacacttgatagagaaaacggtggcggatttttgactgaccattttccttgtgcaaccaaagctatttggtattttgaaggaatatatgcttactctcctcatataccaggagtgagatttccaggtttaactcaccctggagtaattggaactgcaccatcaatggaacttctgaatatatggaatgagagggagagacaactggaagaaaatggtctcaagacactgaaactatgtgaagtactgcattcaagaccattggcaaaccttccatcaaccaaaggctgtcatcttggaaagatccaacagggaactcctgaatgggaaaggattgctcgagaggctgcaaggacaactccaggaagggaaaatggaggaaattgtgacatcaagaatctcagtagaggttcaaaaatataccttccagtgtttgtagatggagcaaatcttagtacaggggacatgcacttctcccagggtgacggtgaagtttctttctgcggggcgattgagatgaatggttttctagaactcaaatgtgaaatcataagaggcggaatgaaagagtaccttacaccaatgggacccactccccttcacgtaaacccaatcttcgaaataggccctgttgaacccagattctcagaatggttggtttttgaaggcatcagtgttgatgaaagtggaagacagcactaccttgatgcaagtgttgcctacaagcgtgcagtgctcaatgccatcgactatctctccaaatttggctactccaaagaacagatgtatctgctgttatcatgctgcccctgtgaaggaaggatttcaggaatagtggactcccccaatgctgttgcaacccttgcaatcccaacagccatctttgaccaggatatccgtccaaaaaccaaagtgccagtaggaccccggttggtgaggaaaccagatgttctaagatgcacctatgatggaaatttgcccaccacaaagaacccggcttccataatgtaactgttatcaaaggagccaagtagaagaagaacctaatggaacacatattccatggtaatagacccttgctcctatctttacatctatggacaggatagagaaatgtggtaggagaaccttcaccttccagtaagtaaaggaaaccaattgcataatgccagctaagttaataaatttaggaaaggatgtttgtcaataataaaattttcatctatatatttagctaagctcatgtttcaattaatgtcactacaaatatggcggaagaaaatagactgtcctgagagctaggttagccacaattatgcctcaaacgaagtttaggcaaacaaaaaacaagttgagtagcaaatagaccagccacaacaatgcctcaaataaagtttaagccaccaaaaggaaggatggttatctaggcatcacttcagctttcttactgaatactttgaaatttgtttattttctggaaagcatgagctaccctcaatcttgtttttgataagtgaggggaataagatattaatgaaaaggcctatagaccaaggtaaacaggttgtatataagggaaaacaaaaggcctagccaaaacaagggaaaatatgaaaaactactccatagttttaaaaagcgtgctttaagcgcgcctaggctcaaggcacaaccactccctagttatagcaccttgc

SEQ ID NO: 868 - DNA, 1398 bp, Cirsium arvense
cctaaaagattcttactttctctcacacacagtcacagacagtaacagttgatcatctatggctcctccaacaccaaggctagtagtatctgtagacctgaagaagaagccatgggaacaaaagcttccattccataaccgttggcatcctgaaataccatcggttgccgtggtgaaaactggagaaattttcaggatagatatggtggattggactggaggtgccattaaagatgatgattctgctactgatgtaaaatacatagatctttcaactgtgcattatttgagtggtccgatcagagttgttgatgaggaaggaattccggcgaaccctggagatcttcttgcagttgagatatgcaatttgggtcctcttcctggtgatgaatggggtttcacggcgatctttgacagagaaaatggtggtggttttcttactgatcatttcccttgtgccacaaaagctatttggtattttgaagggatatatgcttactctcctcatattccaggtgtacggtttccgggtttaacacatcctggaatcattggaactgcaccttcaatggagctacttaacatatggaatgaaagagaaagagagctggaagaaaatggtctaaaatcattgaagttatgtgaagttttgcattcaaggccattagcaaacctgccatccacaaaaggatgccttcttggcaagattccagaaggaagtgaggaatgggagaagattgctaacgaagctgctagaacgattccgggaagggaaaacggagggaattgtgatataaagaatctaagtagaggttcaaagatctaccttccggtgttcgtggaaggagctaactttagtaccggagatatgcacttctcgcaaggtgatggtgaagtttcgttttgtggggcgatcgagatgagtggcttccttgagctcaagtgtgagatcataagaggagggatgaaggaatacttgactccgatgggaccgactcctcttcatgttaatccgatatttgagatagggccggtagagccaagattctcagaatggctcgtatttgagggaatcagcgtcgatgagagtggaagacaacattaccttgatgcgagtgttgcttataagcgcgcggttttgaatgcaatcgactatctttccaaatttggatactcaaaagaacaggtgtatcttttactgtcatgctgtccgtgcgaagggaggatttcaggaatagttgatgctccgaatgctgttgctacacttgcaattccgactgctatctttgatcaggatattcgaccaaaacgtaacaagttgccggtaggcccacgggtagtgaggaatccagatattccaagatgtagttatgacgggaatttacccatcacaaaaaa

SEQ ID NO: 869 - DNA, 1803 bp, Elaeis guineensis
cttattggtgccaggcttggcattatcatcttcctcgctctcaatttcttccgtctccatcatccctttgctcatctgctggatccttgaaatccagcggtgaatcatcccaaacggggattgcctattcttctctactatccccgcttctcactttctgcttcgcgtttccctgcgacccagccctctggacatggcaccacgaactccaagactggtggtgcccatcgacgtgaagaaaaagccatgggaacaaaagcttcccctccataatcgctggcacccacacataccccctgttgcagatgtaaaggaaggggagctctttcgagtggagatgatggattggacgggaggatgcgtgggggacaatgactcggctgcagacataaagtttttggacctcaccattacccattacctcagtgggcccttgagagttttagatacaaaaggagttccagctaaggctggtgaccttcttgctgttgaaatctgcaacttaggtccacttccaggtgatgaatggggctatacagcaacgtttgatagagaaaacggtggtggcttcttaaccgaccacttcccttccgcaacaaaagcaatctggtattttgaaggaatattcgcatactcccctcatattccaggtgttcgatttccaggtttaactcaccctgggatagttggaactgcaccttcacccaaacttttgtctatttggaatgaaagggaaaagaaattagcagaaggtggcgctggatctctgacattatgcgaagtcttgcatcaacggccacttgccaacctaccaactgggaagaattgccttcttggattgattgaagaagggacaccagaatgggaaaggattgcaaatgaggctgcaaggacaatccctggaagggaaaatggagggaattgcgacatcaaaaatctaagtaggggttcaaaggtatatcttccagtatttgtagatggagcaaatcttagtactggtgacatgcacttttcgcaaggtgatggtgaagtttcattttgtggagcaatagagatgagcggattccttgagctcaagtgtgagatcataagaggcggaatgagagagtatctaacacccatgggccccagcccactgcatgtgaatccaatctttgagataggacctgtggagcctaggttctcagagtggttagtctttgagggcatcagtgtggatgaggctgggcggcagcactacctcgatgccacagttgcctacaagcgtgcagtcctccatgccatcgactacctctcaaaatttggatactccaaagagcaggtttatctgctactgtcttgctgcccctgtgaagggaggatttcaggaattgtggactcgcccaatgctgttgcaacccttgccatccctactgccatttttgatcaggacgtacggccaaaatctgggaaaataccagcaggaccgcaaattgtgaagagaacaccagacatcctaaagtgcacatatgatggaaatttgcccatcacaccaaacccagcggcaggtctacttactgatgattgatgttgttgctttgtattaatttttggatggaaggtagctcctgatatggttcctagtgctactgtcatcaattgcctcatgcataaattgctgcttgctccctttcagaagggggaaaaagaaacagggttcaaaaatattattggttaaatgtgccatttttctcttatggcaaatgcaaaattttattctctgttgtggacctatggtagttatttaaattaatagagatactt

SEQ ID NO: 870 - DNA, 1968 bp, Flaveria ramosissima
ggctcaagtgataagaacttaattgttgcaacttttaaggtgccaaaccgtgaatcaactaaagtcaaaaccgatctttagtggaataggttcggcttaaaaattagtttttgagagggaaaagatcggttctcttcggattatcggaccagtttgaatcaaacaggtttgaacgaggaaatttacaaacgtaccgtttggattcaatcctaatctgtttctgttcgggtcgggtcaggtcctaaaccagctcctttgtgcatctctagagggaaaagaatctaatggacaaaattaagctgaatgaaagaatttattaacagatgcttgggttagatcccaaaagattcacacacacacacacccctgtttctcacctacacactatcacttcatatatggctccatcaacaccaaaactagtaataccaatcgacctaaagaagaagccatgggagcaaaagctacccctgcacaaccggtggcaccccgacataccaccggttgcaaccgttcaaaccggtcagtttttcaggatagaaacggtggattggaccggaggtgctattaaagatgataattctgctactgatgttaaacacttagacctttcaactgtgcattatctaagcggtccgattcgagtcgttgatgatgatgggccggctcgaccgggtgatcttcttgcagttgaaatatgtaatttgggtcctcttcctggtgatgaatgggggtttactgctatttttgatagagaaaatggtggtggttttcttactgatcatttcccttgtgctacaaaggcaatatggtattttgaagggatatatgcttactctcctcatattccaggtgtacggtttccgggcttaacgcacccggggataatcggaacagcaccttcgatggaactcttgaatatatggaatgaaagggagagagagcttgaagaaaatggtttaaagtcattaaagttatgtgaagttttgcattcaagaccattggcaaatctgccttcaacaaaagggtgtcttcttggccagatttctgaaggaactcccgaatgggagaagatggcgctcgaggctgcaagaacgattccaggaagggaaaatggagggaattgtgacatcaagaatctaagtagaggttcaaaaatataccttccagtatttgtggaaggagctaacttcagtacaggagatatgcatttctcacaaggagatggtgaagtttcgttttgtggcgcgattgagatgagtggtttccttgagctcaagtgtgatataatacgcggtgggatgaaagagtatttaactccaatgggacctactcgtcttcatgttagtcctatatttgagatcggtccggtagagcccaggttctcagaatggctggtgtttgaggggataagtgttgatgagagtggaagacaacattaccttgatgctagtgttgcttacaagcgtgcggtcctgaatgcaatcgactacttgtcgaaatttgggtactctaaagaacaggtgtatcttttactgtcatgttgtccttgtgaaggaaggatttcagggattgttgatgctcctaatgctgttgcaacacttgcaattccaactgctatctttgatcaggatattcgtccgaagcagaaaaagtaccgataggtcctcgcgtggtaagaaatccagatattccaagatgtacttatgatggaaatctaccaatcactaaaaaccttagtgcaaactaagttaaccacaaacatgttgaatacatgccattttattctcttaaattctacgatcaaggcatttaagttagaaaatacgaggttcatacttaaccatctttcatttcttgaatgtatatctatcacatggattccgatctttctgatctctattgtaattgtactatatgatatgaagtaacaatacaaataagatgaatgagagaacaacaaataac

SEQ ID NO: 871 - DNA, 2098 bp, Ricinus communis
gctcaagcatgtggtaaatgatagacgataggcgaccaatgagaaggcatctttcctctgctacaatttgtaaaccattctatgaccccatgtttaatcagactaataccccacatcaacaagtacaggtatcattccttaatgagtggctattttttgttatcacctaagctgctaagcataaaattttttatggggttggtttttcaccatcttttcttgaattacaagattacccattctactccctattgttttaccctaataaacgtccaagaatatgaagttcaatcaactttataagtggtccatccactatgatatgaaaaaagaaaaagaaaagtctatggctcaaatcatggctgtcgatgcagcaagtgatagtgaaggtagcaatagcaatatttgagttactccagtgaaaccccttattgacatgcctaacttcccttgcttcctgatcaccgtttcaagattgaaaattggtgagagctatggctcaatacggtgcaagactggtctttccggtagacgtgaggaaaaagccatgggagcagaaacttcctcttcacaatcggtggcacccagacatacccccagttgcagaggtcacagctggagagcttttcagggttgagatggtggacttcagtgggggtggtattacgcaacagaacactgcagaggacatcaaacatgctgatccttctattgtccattatctcagtggaccaatcaaagttgtggacaaggaaggaattccagcgaagccgggtgatctccttgtggtcgaaatatgcaacttgggtcctctccctggggatgaatggggttacacagcaacatttgacagagaaaatggtgggggatttttgactgatcattttccttgcgcaacgaaagctatttggtactttgaaggaatatatgcccactctcctcacataccaggggtacgatttccaggtttgactcaccctggaataattggaactgcaccgtcagcagaactcctaaatatatggaatgaaagggaaagagaagttgaagaaaatggccttaaatctttcaaactatgtgaggttttgcattctagaccgctagcaaatcttccgtcaacaaaaggatgccatctgggaaagatccagaaaggaactccagtgtgggaaaagattgccaaggaagcagcaagaacaataccaggaagagagaatgggggaaactgtgacataaaaaatctcagtagaggttcgaaaatatacctcccagtgtttgtagaaggagctaatcttagtactggtgacatgcacttctctcagggggatggtgaagtctcattctgtggggcaattgagatgagtggtttcctagagctcaagtgtgaaattataaggggtggaatgaaagagtaccttacaccaatggggccaactcctcttcatgtgaacccaatttttgagataggccccgttgagccaagattctcagagtggttggtatttgagggcatcagtgttgatgagggtggaaggcagcactacctagatgcaagtgttgcttataagcgtgcagtgctcaatgccattgattacctctctaaattcggttactccaaggaacagatgtatctcctactatcatgctgcccatgtgaaggaaggatttctgggatagttgattctccaaatgctgttgcaactctggccgttccaacagccatctttgaccaggatattcgtcctaaagcaagcaaggtgcccgttgggccccggctagtgaggaggccagatgtcctcaaatgtacctatgatggaactttgccaatcacaaaaaatcccagtgccatggcatgactacaattgaagtgcttctcaaaagcagcagaagattcaggctacatattccttgccatattgcataaatttacgaatcaatgacacgtgtttgtatgtatagatggatgaacaaagacatggtcaaaaggccttcaatgcctgtcaagtatgtaaacatctgaaaggcaactgtttttaaaagctccctatctttttaacatttctcatgcttttataatgccatagcaccgcaaagcatgttt

SEQ ID NO: 872 - DNA, 1638 bp, Centaurea maculosa
  misc_feature (99)..(99): n is a, c, g, or t
  misc_feature (125)..(125): n is a, c, g, or t
  misc_feature (134)..(134): n is a, c, g, or t
  misc_feature (143)..(143): n is a, c, g, or t
  misc_feature (180)..(180): n is a, c, g, or t
  misc_feature (188)..(188): n is a, c, g, or t
  misc_feature (227)..(227): n is a, c, g, or t
  misc_feature (1574)..(1574): n is a, c, g, or t
  misc_feature (1581)..(1581): n is a, c, g, or t
ggcgggggaacacataaaaataatttgttttctttctttttgttttctatcaactaaaataaattgccaaaagaaacagtgaaaaacagaggttttagnttatcatcaaatggctcatcatggtncaagactcntggttccantagatgtcaccaagaaaccaacccaacagaagctccnccttcacnaccgatggcaccccgatataccacccgttgcccaggttngcgttggcgagctctttcgggtcgagatggttgatttctcaggaggtggtatcacacgagaatataccgcccacgatatcaaatacgcagaccaatcagtcgtgcattatttgagtggaccgataagggtcgtggatgaggaaggaattccggcgaaagctggcgatcttcttgcggttgaaatatgcaacttgggtcctcttcccggtgaagaatggggtttcacggccatctttgatcgagaaaatggcggtggtttccttactgatcatttcccttgtgctactaaagctatttggtattttgaaggaatatatgcttactctccccatataccaggtgtaagatttccgggtttaacgcatcctggaatcattggaactgcaccttcaatggagctacttaatatatggaacgaaagagaaagagagctggaagaaaatggtcttaaatcattgaaattatgtgaagttttgcattcaaggccattggcaaaccttccatcaacaaaaggatgtgttcttggcaagattccagaaggaagtgaggagtgggagaagattgctaacgaagctgcaagaacgatccctggaagggaaaacggggggaattgtgacataaaaaatctaagtagaggttcaaagatctaccttccagtgtttgtggaaggagccaactttagtacaggagatatgcatttctcgcaaggcgatggcgaagtttcgttttgtggggccatcgagatgagtggcttccttgagctcaagtgtgagatcataagaggtggtatgaaggaatacttgactccaatgggaccgacacctcttcatgttaatccgatatttgagatagggccagtagagccgagattctcggaatggctcgtatttgagggaatcagcgtggatgagagcggtagacaacattaccttgatgcaagtgttgcttataaacgcgcggttttgaatgcaatcgactatctttccaaatttgggtactcaaaagaacaggtgtatcttttactgtcatgttgtccatgcgaggggaggatttcgggaatagtggatgctccgaatgccgttgccacacttgcaattccaactgctatctttgatcaggatattcgaccaaaaggtaacaagttgccgataggaccacgggtggtgaggaatccagacattccaagatgcacttatgacggaaatttacccatcacaaaaaaccctgctgcaacaggaagttgataagatttatggtaacactactagtgattatataaatatgatatgtatatgtgtgtgtatggtcttatgggaactaaatatgtatttgtgaactagagttatnttcagcnaacttcttttagaattcatgatatgcttacaaaaacagatgtaaagacctttgtgaa

SEQ ID NO: 873 - DNA, 1794 bp, Tropaeolum majus
gtaataccataaataatcaaaattcataagatacgcgtgtattttgttagacctacataaaaaaatatccttgctagaatgaaaacaaacctgcattattgacgttggaaatctctatcttttccctgagatagtagggaccatcaaagaaattttgtcacttcatttgtcaggtataggtgtgcaagtcaacttccttcctccaatgttcatccaatgttcaacgatcaccaccttggtgcaaaagaataggttgtcaatttgtcaggaaccatttaagtgatcactgcattctctcctttaatgaaaccatggctcctccaactccaagagtagttgtacccatagacttgaaaaagaaaccttgggagcaaaagttgcctctccacaatcgatggcaccctcaagtaccctcggttgacgatgtgatcacaggtgaggtctttcgggtagagatggtagactggactggaggtgccatcagtgataatgattctgcagcagatatcaaacatatagacctttctacagtgcattacctcagtggaccgataagaattttggacgaggatgggattccagccttgccaggtgatcttcttgtagttgaaatatgtaacttgggtcctcttccaggggatgaatgggggttcacagcaacatttgacagagaaaacggaggttgcttcttgactgatcattttccttgtgcaacaaaagctatttggtattttgaaggaatttatgcttactctccacaaatacctggtgtgcgattccctggcttaactcaccctggaataatcggaacggccccatcaatggaacttctgactatatggaatgagagggaaagagagctagaggaaaatggtccccagaatctaaaactatgtgaggttctgcatcaacgaccactagcaaacctccctgtaacaaaaggatgtagtctaggaaagatccaagagggtgctcctacttgggacaagattgctagggcagctgcaaggactattccaggacgagaaaacggaggaaattgtgacatcaaaaatctaagtaagggttcgaaaatatacctccctgtatttgtggaaggagcaaatcttagtacaggtgacatgcacttctctcaaggtgatggcgaggtttcattctgcggaggaattgagatgagtggttttctagaactcaaatgtgaaattataaggaatgggatgaaagaatactttacaccgatggggcctactgcacttcatgtaaacccaatttttgagataggccctgttgagccaagattctcagaatggttggtatttgaaggtatcagcgttgatgagagaggtaaacaacattatctcgatgcaagtgttgcttacaaacgtgcagtactcaatgctattgactacctctctaaatttgggtactctaaagaacaggcataccttctgctttcatgttgtccttgtgaaggaaggatctctgggatagttgattctcctaatgctgttgcaacccttgctatcccaacttctatcttcgaccaggacattcgtccaaaacctggaaaggtgccagttggtccccggctaatgagaaaaccagatgtgatgaaatgtacttatgatggcagtttgcccatgacaaaaaatcccagtgcctcaacatagctttattcaaggatttgcaaatgagagtgggaacagacgccttgtcgaataaatggaataacctggcttctgaggctatattcagcaaacagttgtgggagtaacaatatatctacattcttat

SEQ ID NO: 874 - DNA, 1537 bp, Lippia dulcis
ttaatagttccaatagaccttaagaaaagccatggcatcaaaagctgccacttcacaaccggtggcacccggagataccgccggtggcggaagtcgaaaccggcgaggtatttagggtggagatggtggattggacagctggtgcagtttcagatgatcatagttctgcacttgatgtaaaaaccttagacctctcaactgttcattatcttagcgggcctgttagagtggttgacacggacgggcaaccagcgaagcctggagatcttcttgccgttgagatatgcaatttggggcctctacctggagatgaatggggttttactgcaattttcgacagggaaaatggtgggggatttctaacagatcacttccctcgtgcgaccaaggctatatggtattttgaaggaatatatgcgtactctccacatattcccggggtaagatttccgggtttgacccaccccggaatcgttggaactgcaccttccatggagttgctcaatatatggaaccaaagggaaagggaacttgaagaaactggtcctgagtctctaaaattgtgcgaggttttgcattcacggccactggcaaatcttccatccactaagggatgtgttcttggcaagattaaggaagggactcctgaatgggaaagaatagcacgggaggctgcacggaccattcccggaagagaaaatggtggaaattgtgacatcaaaaatctcagcagaggttcgaaagtgtaccttccggtatttgttgagggggcaaatcttagcaccggagatatgcatttctcacagggcgatggtgaagtggccttttgtggagcaattgagatgagcggttttctagagctcaagtgtgagatcctgagggatggcatgaaaaagtacctgactccaatggggccgactactctacatgtcaacccgatatttgagataggaccggtcgagccaagattctccgaatggctagttttcgagggcattagcgttgatgagagtggacggcagcattatctggatgctagtgttgcttacaagcgtgccgtgctcaatgcaatcgactacatttccaaattcggatactctaaagaacaggtttatcttctactctcatgctgcccttgcgaaggaaggatttcaggaatagtggatgctcctaatgctgtagccacacttgcgattcccactgcaatatttgaccaggatattcgtccaaagaaaaccgatgtacctactggacctaggctcgtgaggaatccaggtcttccacaatgcagttatgatggaaatttgccgactcaaaaaacccttgtgctgcagccgattataacatcaaattagcgatgtagttacaacttacaagtttaattcttgtatttcaattgatgtcgcaccttttattccactttcataaatatgtattgttataataaattaaggaacttattttgataaataattggccacttaagtgttgccttaacatttaataatgtaatgcaataattagaaggaaaaaagaa

SEQ ID NO: 875 - DNA, 1943 bp, Prunus mume
cttgaatgaaaagaaaagtatgattaagtggtgcacctatcagggctgtcaaactccatctcaagatgaaagatgcatttgatgacttcagccacaacaaggaatctttgcatctttttatcttacctttcccaattgccttcatcaaaatcaaaacagcaaaacttggacatagttatggcatcttatggaccaagattggttgtgcctatagatgtgaagaagaaaccatgggaacagaagcttccacttcacaaccgatggcacccggacataccaccggtggcagaagttacagttggagatgtttttcgagtcgaaatggtggattttagtggaggtggtattaccaaagaatacacagcagaggacatcaaacatgccaatccctccattgttcattatcttagtgggccaattagagttttggacaaggatggcactccagcaaagccaggtgatcttctggcagttgagatatgcaacctgggtcctctcccaggagatgaatggggtttcacagcaacatttgacagagaaaatggagggggttttctcactgaccattttccttgtgcaaccaaagctatttggtactttgaagggatatatgcgtactcacctcaaataccaggagtgagattcccaggtttaacccaccccggaatagttggaacagcaccatcaatggaactcctgaatatatggaatgaaagggagagagaacttgaagaaaatggactcaactctatgaaactatgtgaggttttgcatcaacgaccattggctaacctaccatcaacaaaaggttgcgtcctcggagggatcaaggagggcactcctgaatgggaaaagattgccttggaggctgcaagaacaattccaggaagagaaaatggtggcaattgtgacattaaaaatcttagtagtggttcaaagatataccttccagtattcattgaaggagcaaatcttagcactggtgacatgcacttttcccagggcgatggtgaaatttcattctgtggagcaattgagatgagtggtttcctggagctcaagtgtgaaattataagggatggaatgaaagaataccttacaccaatggggcccactcctcttcatgtgaacccaatctttgagataggccctgtcgagccaagattttcagaatggttggtgtttgagggcatcagtgttgatgagagtgggaagcagcattacctagatgcaactgttgcatataagcgtgcagtactgaatgctattgactacctctctaaatttggatactccaaagagcagagctaccttctgttgtcatgctgcccatgtgagggaagaatttctggaatagtggactctcccaatgccattgcaaccttagcaatcccaacagctatctttgaccaggatatacgtccaagagcaaacaaggtgccagttgggcctcggatagtgaggaaaccagatgtcctgaaatgtacttatgatggaaatttggcaactacaaggaaccttagctcagcaacataactattgtcaagagtgctcagtaaataaaagcagacactttgcctgtatcttccatgcctaccaaatcatgcatgtactgggatatacagaaagtagaactgaattgtcaaagtaaaccatccaaattctatataagcaacacaaacacattgcacacaggggaaaagaacatgaataaatcgtgcagaaaaattcaacactatttagcctatcacttaatgaataaaccatgctcttagccattttgtcatcactccgatgtcaaccaagctgctaattctaagttctaatcagctgagtccacttacacattgacttatattggcaataatttttgcaagcctgcatcttatggttgattttcactattcatcttctaaagagcctatatataacaagtttatgaa

SEQ ID NO: 876 - DNA, 1472 bp, Arabidopsis lyrata
tttttactgtaacaaggacaaaagaaagagagaaaataaaagagatatatagagagaaaacgtgaatagagagaccactgtacttattgggttttgatgtttgatggctccactgagtccaagagtagtggtgaaggtggatttgaagaagaagccatggcagcagaaccagccactgcacaatagatggcatccggagataccaccagtagcagaggtcaaggctggtgagtttttccgggtggaaatgattgattgtatgggaggtgttgtcaaagacaatgactctgcaagcgatatcaagaacgcagacctaaccactactcatcacctaagtgggccgattagagttgtggatgaggatggtgttgcagctatgccaggtgatcttcttgctgttgagatatgcaacttaggtcctcttccaggagatgaatggggattcactggttcgtttgatagagagaatggtggcggtttcttgactgaccatttcccttgtgcgaccaaagctatttggtactttgaagggatctatgcctactctcctcaaattcctggagtacgatttccgggtttgacacacccaggagtcattggcaccgcgccatcgatggaactcctgagaatatggaatgaaagggaaagacaattagaagaaagtggtctcaagtccccaacactatgtgaggttgtgcatcaacggccattggcaaacctaccaacagctaaaggatgcctcctagggaacattgaagaaggaacaccggaatgggaaaggattgcaaacgaggctgcgaggacgataccaggaagagaaaacggaggaaactgtgacattaaaaacctaagcagaggctctaaaatatatcttccagtgtttgtagaaggggctaatctaagcacaggagacatgcatttctcgcaaggtgatggtgagatctcattctgtggggccatcgagatgagtggatttctagaactcaagtgtgaaatcataaggaatgggatgcaagaataccttacgccaatgggaccgaccccgctccatgtaaacccaatctttgagatagggccagttgaaccgagattctcagaatggcttgtcttcgaaggtatcagtgtcgatgagagcgggagacaacattacctggatgcaacagttgcttacaaacgggcagttctcaacgccatagactatctcttcaaatttggttactcaaaagaacaggtgtacctcttgctctcatgttgtccatgtgaaggaagactatctgggatagttgattctccaaatgccgttgctacactagcaatacctacagccatctttgatcaggatattcggccaaagactcggaaggttccagtaggacctcggatagtgaggaaaccagatgtactgaagagcacatatgatggaaagcttccaattacaaagaatccaagttcttcgacaagctactagaaat

SEQ ID NO: 877 - DNA, 1574 bp, Arabidopsis thaliana
aatgatcactcttttcactgtatcaaggacaaaagaaagagagaaaacaaaagagttatacagagagaaaacgtgaatagagagatcactgtacttattgggttttgatctttgatggctccactgagtccaagagtagtggtgaaggtggatttgaagaagaagccatggcagcaggaccagccattgcacaatagatggcatccggagataccaccagtagcagaggtcaaggctggtgagtttttccgggtagaaatgattgatgcaatgggaggtgttatcaaagacaatgactctgcaagcgatatcaagaacctagtcctaactactactcatcacctaagtgggccgattagggttgtagatgaggaaggtgttgcagctaaagcaggtgatcttcttgctgttgagatatgcaacttgggtcctcttccaggagatgaatggggattcactggttcgtttgatagagagaatggtggcggtttcttgactgaccatttcccttgtgcgaccaaagctatttggtactttgaagggatctatgcctactctcctcagattcctggagtacgatttccgggtttgacacacccaggagtcattggcactgcaccatcgaatgaactcttgagaatatggaatgatagggaaagacaattagaagaaagtggtgttgagtccctaacactatgtgaggtagtgcatcagcggccattagcatgcctaccaacaactaaaggatgtctcctcgggaatattgaagaaggaacaccagaatgggaaaggattgcaaacgaggctgcgaggacaataccaggaagagaaaacggaggaaactgtgacattaaaaacctaagcagaggctctaaaatatatcttccagtatttgttgaaggggctaatctaagcacaggagacatgcatttctcacaaggtgatggtgagatctcgttctgcggagccatcgagatgagtggatttctagaactcaagtgtgaaatcataagaaatgggatgcaagagtaccttacgccaatgggacctacccctctccatgtaaacccaatctttgagataggaccagtggaaccgaggttctcagagtggcttgtcttcgaaggtatcagtgtcgatgagagcggaaaacagcattacctagatgcaacagttgcttacaaacgggcagttctcaacgccatagactatcttttcaaatttggttactcaaaagaacaggtgtacctcttactctcatgttgtccatgtgaaggaagactatctgggatagttgattctccgaatgccgttgctacactagcaatacctacagccatctttgatcaggatattaggccaaagaatcggaaggttccagtaggacctcgggttgtgaggaaaccagatgtactgaagagcacatatgatggaaagcttccaattacaaagaatccaagttcttcctcttagcttctacaaaaaaattaaaattaaaatttagaagctaataccaagattgtataatcaagcatatgttccaataataaagcaataacttggtgttttcttta

SEQ ID NO: 878 - DNA, 1501 bp, Flaveria ramosissima
gactaaaccctttgtcacaaaatggctcaacatggtccaagactggtggtgccaattgatgtaaccaagaaaccaagggaacagaagctcccccttcataaccggtggcaccccgatataccgcccgttgccgaggtttgcgttggagaggtttttcgggtcgagatggttgatttttctggtgggggtatcactcgagagtacactgcccatgacatcaaatactctgaccaatcagttgtgcattatctgagtgggccgattcgagtcgtagatgatgatgggccggctcgaccgggtgatcttcttgcagttgaaatatgcaatctgggtcctcttcctggtgatgaatgggggtttactgctattttgatagagaaaatggtggtggttttcttactgatcatttcccttgtgctacaaaggctatatggtattttgaaggaatatatgcttactctcctcatattccaggtgtacgatttccgggcttaacgcacccggggataatcggaacagcaccttcgatggaactactgaagatatggaatgaaagggagagagagcttgaagaaaatggtttaaagtcattgaagttatgtgaagttttgcattcaagaccattggcaaacctgccttcaacaaaagggtgtcttcttggacagattcctgaaggaactcccgaatgggagaagatggcgctcgaggctgcaagaacgattccaggaagggaaaatggagggaattgtgacatcaagaatctaagcagaggttcaaaaatataccttccagtatttgtggaaggagctaacttcagtacaggagatatgcatttctcacaaggagatggtgaagtttcgttttgtggcgcgattgagatgagtggtttccttgagctcaagtgtgatataatacgcggtgggatgaaagagtatttaactccaatgggacctactcgtcttcatgttagtcctatatttgagatcggtccggtagagcccaggttctcagaatggctggtgtttgaggggataagtgttgatgagagtggaagacaacattaccttgatgctagtgttgcttacaagcgtgcggtcctgaatgcaatcgactacttgtcgaaatttgggtactctaaagaacaggtgtatcttttactgtcatgttgtccttgtgaaggaaggatttcagggattgttgatgctcctaatgctgttgcaacacttgcaattccaactgctatctttgatcaggatattcgtccgaagcagaacaaagtaccgataggtcctcgcgtggtaagaaatccagatattccaagatgtacatatgatggaaatctaccaatcactaaaaaccttagtgcaaactaagttaaccacaaacatgttgaatacatgccattttattctcttaaattctacgatcaaggcattcaagttagaaaatacgaggttcatacttaaccatctttcatttcttgaatgtatatctgtcacat

SEQ ID NO: 879 - DNA, 1662 bp, Orobanche aegyptiaca
aggaaattccatcagattccaataattgaattttagcactgttttccccctttacaaaatatacaaaaacatccgaaacaaacattgaattgataagttgattccataatgagtggtcatggtgctagattagttgtgccgatagacgtgaagaaaaagccatgtgaacaagctcttcctctacacaaccggtggcaccccgccataccgccagtggcggaggtccgaaccggagagcttttcagggtggagatggtggatttcagcggcggcggcataaccaaagagtacacggcggaggacatcaagtttgcagatgcctctattgttcattatcttagtggacctattagagttgtcgacgtggacgggaaaccggccaagcctggcgatctacttgctgttgaaatttgcaatttaggtcctctaccaggtgatgaatggggttttactgcaatttttgacagggaaaatggtggtggatttctcactgaccattttccttgtgcgaccaaagctatttggtattttgaaggaatatatgcctactctcctcatatacctggcgtaagatttccaggattgacacaccctggaatagttgggactgcaccttcaatggaattgctaagtatatggaacgaaagggaaagggaactcgaagaaaatggtcttcaatctctcaaattgtgtgaagttttgcattcaagaccacttgcaaaccttccatccacaaagggatgcgttcttggcaagattaaagaaggaaccccggaatgggaaaaaatagcaaatgaggctgcaaggaccatccctggaagagaaaatggaggaaattgtgacataaaaaatctgagcagaggttcaaaagtataccttcctgtatttgttgatggagcaaatcttagcactggggatatgcatttttcacaaggtgatggtgaagttgcattttgtggagccattgagatgagtggttttctagagctcaagtgtgaaatcataagatggcatgaaaaagtacctcaccccaatgggcccaactcctttacacgtcaacccgatatttgagatcgggtccgtcgagcccagattctcggaatggttggtgttcgaaggcattagcgttgatgagagcggacggcaacactaccttgatgctagtgttgcttataagcgtgcagtactaaacgcgatcgattacatctccaaattcggatattccaaagaacaggtgtatctattgctttcatgctgtccttgtgaaggaaggatctcaggaatagtggattctcccaatgctgttgctacccttgcaatcccagttgctatatttgatcaggatattcgtccgaaatcttcgaacgtgcctagtggagcaaggcttgtgaggaatccaggtctcccgcagtgtacttatgatggtaacttgcctaccactaaaaatccctgtactactacaaagtgattatcacaagccaagcagattatcagtggaaataagtgaaaaaatgtaattagagtgcagctctaatttgcaatttgggatgtggtcttatggactcatccttagatataacagtcataagatctgcttcactaattatgtatccagagttttgaatatcgttgcacgataaagcccgaagtcatatttgtttg

SEQ ID NO: 880 - DNA, 1531 bp, Prunus persica
caaaacttggacatagttatggcatcttatggaccaagactggttgtgcctatagatgtgaagaagaaaccatgggaacagaagcttccacttcacaaccgatggcacccggacataccaccggtggcagaagttacagttggagatgtttttcgagtcgaaatggtggattttagtggaggtggtattaccaaagaatacacagcagaggacatcaaacatgccaatccctccattgttcattatcttagtgggccaattagagttttggacaaggatggcactccagcaaagccaggtgatcttctggcagttgagatatgcaacctgggtcctctcccaggagatgaatggggtttcacagcaacatttgacagagaaaatggagggggttttctcactgaccattttccttgtgcaaccaaagctatttggtactttgaagggatatatgcgtactcacctcaaataccaggagtgagattcccaggtttaacccaccccggaatagttggaacagcaccatcgatggaactcctgaatatatggaatgaaagggagagagaacttgaagaaaatggactcaactctatgaaactatgtgaggttttgcatcaacgaccattggctaacctaccatcaacaaaaggttgcgtcctaggagggatcaaggagggcactcctgaatgggaaaagatagccttggaggctgcaagaacaattccaggaagagaaaatggtggcaattgtgacattaaaaatcttagtagtggttcaaagatataccttccagtattcattgaaggagcaaatcttagcactggtgacatgcacttttcccagggcgacggtgaaatttcattctgtggagcaattgagatgagtggtttcctggagctcaagtgtgaaattataagggatggaatgaaagaataccttacaccaatggggcccactcctcttcatgtgaacccaatctttgagataggccctgtcgagccaagattttcagaatggttggtgtttgagggcatcagtgttgatgagagtgggaagcagcattacctagatgcaactgttgcttataagcgtgcagtactgaatgctattgactacctctctaaatttggatactccaaagagcagagctaccttctgttgtcatgctgcccatgtgagggaagaatttctggaatagtggactctcccaatgccattgcaaccttagcaatcccaacagctatctttgaccaggatatacgtccaagagcaaacaaggtgccagttgggccccggatagtgaggaaaccagatgtcctgaaatgtacttatgatggaagtttggcaactacaaggaaccctagctcagcaacataactattgtcaagagcgctcagtaaataaaagcagacactttgcctgtatcttccatgcctaccaagtcatgcatgtactgggatatacagaaagtagaactgaattgtcaaagtaaaccatccaaattctatataagcaacacaaacacattgca

SEQ ID NO: 881 - DNA, 1658 bp, Fragaria vesca
acaacaaggaatcttcaatctatcatcttacctttgctcaccttcaacaagaccaaaaatggctgcttcttatggagcaagactggttgtgccgatagatgtgaaaaagaagccatgggaacaagagcttccacttcacaaccggtggcacccggatataccacctgtggcagaagctacggtgggagaggtttttcgagttgagatggtcgatttcagcgggggaggtatcactaaggaatacactgcagaggacatcaagaatgccaatccttcaattgttcactatctcagcggaccaattagaatttcggacaaggatggaatcccagcacagccaggcgatcttctggtagttgagatatgcaacttgggtcctcttccaggggatgaatggggtttcacagcaacatttgacagagaaaatggagggggttttctgactgaccattttccttgtgctacaaaagctatttggtattttgaaggaatatatgcctactctcctcagataccaggagtgagattcccaggtttaacacaccctggaatagttggtacagcaccatcaatggaactcctgaacatatggaataagagggagagagaacttgaggaaaatggagttgagtctctgaaactatgcgaggttgtgcaccaacggccactggctagcctaccatcgacaaaaggttgcgtccttggagggatcaaagaaggcactcctgaatgggaaaagatagccgtggaggctgcaagaacaattccaggaagagaaaatggtggcaattgtgacatcaagaatcttagtagaggttcaaaggtgtaccttccggtatttgttgaaggagcaaatcttagcactggtgacatgcacttttcccagggagatggtgaaatatcattctgtggtgcaattgagatgagtggtttcctagagctcaagtgtgatattataagggatggaatgaaagaataccttacaccgatggggccaactcctcttcatgtgaatccaatctttgagataggccctgtcgagccaagattctcagaatggttggtatttgagggcatcagtgttgatgagagtgggaagcagcattacctagatgcaacagttgcttacaagcgcgcagtactcaatgccatcgactacctctctaaatttggatactccaaagaacagagctaccttctgctgtcatgctgtccatgtgagggaagaatttcgggaatagtcgacgctcccaatgctgttgcaaccctagcaatcccaatagctatctttgaccaggatattcgaccaaaaacgaacaaggtgccggttggtccccggatagtgaggacaccagatgtcctaaaatgtacttatgatggaaatttgccaacgacaaggaaccctagcgcagcaacataagctttgtcaaaggtgctcaggaaaacaaagcaaacatttcagcctatattgattatgcctctactaagtcatgcatgtatgactacagattgtgaaatcataaaactagcaaccaagtaaaacatatagaatggagctgataggctaaagaagatataaattcccatatattgcccgtcatatacttgtaccagccaccttatatggaatttaagaatccatcctcatttcttttgct

SEQ ID NO: 882 - DNA, 1414 bp, Eutrema halophilum
agagagaataaataccactgtacttactgagttcggtttgatggctccagcaagtccacgtgtggtggtgaaggtggatttgaagaagaagccatggcagcagaatcagcctctgcataatagatggcatcctgagatccaaccagttgcagaggtcaaggttggtgagttgtttagggtggaaatggttgactggaccggaggtgcagtcaaagacgatggttctgctgatgatattaagagcatagacctctctactgttcattacctgagtgggccgatcaaagttgtggatgaggatggtgttgcagccaagccaggtgatcttcttgttgttgagatatgcaatttgggtcctcttccaggagatgaatggggattcactggttcatttgatagagagaatggtggcggtttcttgactgaccatttcccttgtgcgaccaaagctatttggtactttgaaggcatttatgcttactctcctcaaattccaggagtacggtttccgggtttgacacacccaggaataattggcacagctccaacaaaagaactcctgagaatatggaatgaaagggaaagacaattagaggaaagtggtgtcaagtccttaacactatgtgaggttgtgcatcagcggccactggcaaacttaccaacaagtaaaggatgccttctagggaatattgaagagggaacagtggaatgggaaagggttgcgaaggaggctgcgaggacaatcccaggaagagaaaacggaggaaactgtgacataaagaacctaagcagaggctctaaaatataccttccagtgtttgtagaaggggcaaatttaagcactggtgatatgcatttctcgcaaggtgatggtgagatctccttctgcggtgccatcgagatgagtggatttctagaactcaagtgtgaaatcataagaaacgggatgcaagagtaccttacaccaatgggaccaacccctctccatgtaaacccgatctttgagataggtccagtggaaccgagattctcagagtggctggtctttgagggtatcagtgtcgatgagagtgggagacaacactacttagacgcaacagttgcttacaaacgagcagttctcaacgccatagactatctcttcaaattcggctactcaaaagaacaggtatacctcttactctcatgtttcccatgcgaagggagaatatctgggatagtcgattctccaaatgcagttgctacacttgcaatacccactgccatctttgatcaggatattcggccaaagactcgaaatgttccggtaggacctcgaatactgaggaaaccagacgttctgaagagcacatatgatggaaaacttgcaatcacaaagaatccaaattcttcctcttagcttctacaacaaaaa

SEQ ID NO: 883 - DNA, 1701 bp, Tripterygium wilfordii
actttcaagattatgaagtttgcaagacttagtcactccagggaatcttattattcacataactaagacttcttcagccatacaaaaacaggatctcagtgcagagcaatggctcagcatggagctcgcttggtgatccccatagatgtgaagaaaaagccatgggagcagaaacttgcccttcacaaccggtggcacccggagattcctccggttgtagatgtcaccgttggagaggtttttagggttgagatgatggatttcagcggaggaggtattacacaggaatactctgcggaagacatcaaaactgctgacaattctattgttcattatctcagtggaccgatcaaagtcatagacaaggatggcattccagccaagccaggtgatcttcttgtggtagaaatatgcaacctgggtcctctcccaggagatgaatggggttatacagcaacatttgacagggaaaacggaggtggttttttgacagaccattttccttgtgcaactaaagccatttggtattttgaaggaatctatgcttattcccctcacataccaggggtaagatttccaggcctgactcaccctggaataattggaacagcaccatcaatggaactcctcaacatatggaatgaaagagaaagagaactggaagaaaatggtcttcagtctatgaaactatgtgaggttctgcattcacgaccactagcaaatctaccatcaaccaagggttgtcgactagggaagatccaagaaggcacccctgaatgggaaaagattgctagagaggctgcaagaacaattcctggaagagaaaatggaggaaattgcgatataaaaaatcttagtagaggctcaaaagtgtacctccctgtatttgtagaaggagcaaatctgagtactggtgacatgcacttctctcaaggcgatggcgaagtttcattttgtggggcaattgagatgagtggttttctagaactcaagtgtgatattataaagggaggtatgaaggagtacctgacaccaatgggacctacatctcttcatgtgaacccaatttttgagatcggacctgttgaaccaagattctcagaatggttggtatttgagggaattagtgtagatgagactggtagacaacattaccttgacgcaaccgtagcttacaagcgtgctgtgctgaatgccattgactacctctccaaatttgggtactccaaggaacaggcttatcttctactttcatgctgcccgtgtgaaggaagaatttctggaatagttgattctcccaatgctgttgcaacactggctattccaacatctatttttgaccaggatattcgtccaaaaactagcaaagtgccagttgggcctcacctggtgcggaaaccagatgttctcaaatgcacttatgatggaaaattgaccaccacaaagaacccaagtgccacaacataactaacaaaaaaaaaggtagcaacagcagcagacaaggggtcatagtgcatatggctactcctatatatacctgtaataataactgtgactgagcattgagcaagcactgctagtctacttttagttgtgctttgttaagaacatccatggtagttggctgcaggttatacagacatttttccgataagactgcctgtaattgatcccttgcatgacaatagaaatgtgttgagt

SEQ ID NO: 884 - DNA, 1616 bp, Triphysaria pusilla
aagacgacaaatatttcacgtttccttgtgaagtgcaaatccaaaatgcaaagactgatttttgtgtgacatattgacatttcaaataaatatctctcatcggaattaactaaaactttaccaaaatgagtactaataatcatggcgctagattggttgtgcccattgacgtgaagaaaaagccatcggaacaaaagcatcctctccacaaccggtggcacccagagataccggcggtggcggaggtccagactggtgagcttttcagggtggagatggtggatttcagcggcggcggcataactaaagagtacactgcggaggacatcaagtttgcagatgcttctattgttcattatctaagtggacctattagagtggtcgacactgacgggagaccggccaagccaggggatcttcttgttgttgaaatatgcaatttggggccattgcccggagatgaatggggcttcactgcaatatttgacagggaaaatggtggtggctttctcactgatcacttcccatgtgcaaccaaagctatttggtatttccaaggcatatatgcctattctcctcatatacctggtgtacgtttcccgggtttgacacaccctggaatagttggaaccgcaccttcaatggagttactaaatatatggaacgagagggaaagagaacttgaagaaaccggtcatcagtctctcaaactgtgtgaggttttacattctcgacctctagccaaccttccatcgacaaagggatgcgttctaggcaagattaaggaagataacccggaatgggaaaggatagcgaacgaggcagcaaggacgatccccggaagagaaaacggaggcaattgcgatataaagaatctcagcagaggctcgaaagtgtaccttcctgtgtttgtggatggagcaaaccttagcaccggggatatgcatttttcacaaggtgatggcgaggttgcattttgcggggctattgagatgagtgggtttttagagctcaagtgtgaaatcataagggatggcatgaaaaagtacctcaccccaatgggcccaactactttacatgtcaacccgatatttgagatcgggcctgttgagcccagattctccgagtggttggtgttcgagggcattagcgttgatgagagcggacggcaacacttccttgacgcgagtgttgcttacaagcgtgcggttctgaacgcaatcgactacatctccaaattcggatactccaaggaacaggtgtatcttctactatcatgctgcccttgtgaaggaaggatctcagggatagttgatgctcctaatgcagttgccactctggcaatcccacttgctatttttgaccaggatattcgtccgaaaatctcagatgtgccgactggaccaagggttgtgaggaatccaggtcttccacaatgtagttatgatggtaacttgcctataaccaaaaatccctgtactacaaagtgaccatttataaaaattgtgtattgtatttactttccactctttatttgtaacttatgtaaaacccgctattttcgtgttcaaatatatataagaattgcaagacacgtaaaaaaaaaaaaaaaaaaa

SEQ ID NO: 885 - DNA, 1683 bp, Olea europaea
gtaatttaaggaatcctaaattccagtaggtagttgactcattcttgtagtggaggtatagtgaagtttgccatcaatggaggcgtcgcgtggttgtagagtggtggtgccaattgatttgaagaagaaaccacgggaacagaaactccctcttcacaaccgatggcatcccgacatacctcctgttgccgaggttagaactggagaggtattcagggtagagatggtggatttcagtggaggtggcataacaaaagagtacactgctgaagatatcaagtatgcagatccctctattgtgcattatcttagtggacctattagagttcttgatgtagatggtaatccagccaagcctggtgatcttcttgctgttgaaatttgcaatttggggccgctacctggggatgaatggggatttacagcaatatttgatcgggagaatggaggtggattcctcactgaccactttccttgtgcaaccaaagccatatggtattttgaaggaatatatgcttactctccgcatatacctggtgtacggtttcctggtttaacacaccctggtatagttggaactgcaccttcaatggaacttcttaacatctggaatgagagggaaagagaagtcgaagaaaccggacttcagtctctaaaattgtgtgaggttctgcattcaaggccactagcaaacttaccatcaacaaagggatgctttctaggcaagattgaggaagggactcctgaatgggaaagaattgcacgagaggctgcaaggacaattcctggaagggagaacggaggaaattgtgacattcaaaaatctcggtagaggttccaaagtataccttccagtatttgtcgatggagcaaacctgagtactggggatatgcacttttcacaaggagatggtgaagttgcattttgtggcgcaatcgagatgagtggttttctagaactcaagtgtgaaatcattagggatggtatgaaagaatacctcactccaatggggccaactcctctacatgtcaaccctatttttgagataggccctgttgagccaagattttcagaatggttagtatttgagggcattagcgttgatgagagtgggcgacaacactttcttgatgcttccgttgcttacaagcgtgcagtgctaaatgctattgactacttgtccagattcggatacactaaagaacaggtctatcttctactctcatgctgcccctgtgaaggaaggatttcaggaatagttgattctcccaatgctcttgccactcttgcaattccaacttccatcttcgaccaggatattcgtccaaaaatcaacaaggtgcctaaaggacctcgtcttgtgaggaaccctaatatcccacagtgtagctatgatggaaagttgccaaccaccaaaaatcccagtgctacgacatgactatcatcaattgacacatgaaaagcagcactacaacatgagtactcgaggatattggcagaaacaataaaacacttatagcaggagacgttaataatattattttgagaagtattttgatatttcatgtttttcaatagtcaaattgcttggcataaactccatgacaaatatttgaacaggttatgctatatgtatattacaacttatttgtttaccaacagatgatgtgaccaaattattt

SEQ ID NO: 886 - DNA, 1757 bp, Eucalyptus grandis
gtccctcaaaatcttccacctaattctgcatatctaaagcacctcttcttgagtccttgtgccatctcctgcttaccaagaaatagccacacttccatgaggtttcggctccccaagtaatcttatcaattcttgaactgggagagaagacagaaatggctcaacgacatggtccgaggctggtcatcccaatagatgtgaagaagaagccccacgagcaggcgctccccctccacaaccggtggcacccggagatcccgccggtcgcggaagtccggaccggcgagttcttccgggtggagatggtggacttcagcggcggcgggatcacgcgcgagtataccatcgacgacatcaagcatgccaacatgtccatcgttcattacctgagtggaccgatcagagtcctggatacagatggaattcctgcgaagccgggtgatcttctcgctgtcgagatatgcaacctgggtcctctaccaggtgatgagtggggtttcacagcaacattcgacagagaaaatggaggcggatttctgacagatcatttcccaagtgcaaccaaagctatatggtattttgaaggaatctatgcatactcaccgcaaataccgggtgtgaggtttccaggtttgactcaccctggaatagtaggaactgcaccatctaaggagctcctaaaaatatggaacgacagggaaagggaggttgaagaaaatggactgcagacactcaagctatgcgaggttttgcattcaaggccactagcaaacttaccatcaaccaaaggctgtgtccttggcaagattcaaggagacactcccgaatgggaaaggatcgcgagggaagctgccagaacaattccgggaagagagaacgggggaaactgcgacatcaaaaatctaagtagaggttcaaaggtttatctccctgtttttgtggaaggagcaaacctcagcactggcgatatgcacttctctcagggtgatggtgaggtctccttctgtggggcaatcgagatgagtggcttcttagagctcaaatgtgaaatcatcaggggagggatgaaagagtacctgacaccaatgggaccaactcttctccacgtgaacccaatcttcgagataggaccagtggagccgagattttcagaatggctggtgttcgaggggatcagtgtcgatgagagtgggaggcagcattacctcgacgccagcgttgcatacaagcgggctgtactcaatgccatcgactacctctctaaattcggctactccaaggagcagatgtatcttctactatcctgctgcccatgtgaaggaagaatatccggaattgtggattcccctaatgctgtagcaacacttgccatccccacatcaatctttgatcaggatattcgtccgaagaacaagattccagtcgggcctcggctagtcaggaagccagatgtcctgaaatgcacttatgatgggaatctacctataactaagaaccttagtgccactatgtagtcctcgctcaggtggccaaaatcacaatagttaagtataacatatgtacttgcccctcttcctattccacatttacaaaacataagtagaactgtgaaagcaagaaatatgttatttctggacaacctgtacatctcggttgaataatggatgagcctcttactgagaaaggcacaatccaatacagatatgtctgctgatatttgctcttaaaataatgcacatagcccacaagaaagaaaa

SEQ ID NO: 887 - DNA, 1625 bp, Fagopyrum esculentum
tatgagagactacaataaagggttagatattgttaaaaagagaataacataggatttgtgtgtgatgggttctcatggtgcaaggatggtgattcccatagacctaaagaagaagccatgggagcagaaacatagacttcataacaggtggcacccggaaatacccgcagttgcagaggttaaagtaggggaagttttcagggttgagatgatggacttcactggaggtcgtataaccagcgatttctctgccgatgacgtcaagaacgctgatccctccattgttcattacctaagcgggccaattagggtttcggatgcaaatggacttcccgcacatccaggtgatcttttagtagtagaaatctgcaacttaggccccttacctggagatgaatggggctacacagcaaccttcgatagagaaaatggcggggattcttgacagatcatttcccttgtgctaccaaagctatatggtactttgaagggatatatgcctactctccccacataccaggagtgcgatttccgggtctaactcaccctggaatcgttggtactgctccatcaatggaacttctgaacatatggaatgaaagggaaaggaaggtggtagaagaaggcctaagcactttgaagttatgtgaggttcttcatacacgaccactggcaaatttgccgtcaacagaaggatgtctattgggaatgatcgacaaagataatcccgactgggaaaagattgctttggaagcagcaaggacaattccaggaagagaaaatggaggaaactgtgacattaagaatcttagcagaggttcaaagatttaccttcctgtatttgtggaaggagcaaatcttagcactggagatatgcatttctctcagggtgatggtgaagtctcattctgtggtgccattgaaatgagcggtttcctagagctcaagtgtgatatcataagaggtggaatgaaagagtatcttacacctatggggccaactcctctacacgtcaatccgatcttcgagataggcccaatggagccaaggttctcagagtggttggtgtttgagggcatcagtgttgatgaaggaggaagacaacactttcttgatgcatctgttgcctacaaacgtgccgtgcttaatgccatagactatatttccaagtttggatactccaaagaacaggtttatctccttctttcttgctgcccatgtgaagggagaatctctggaatagtagactctccaaacgccgtcgccacactagcaatcccaactgccatttttgatcaggatattcgtcctaaagtcggaggtgtaccggttggaccaagattggttagaactcctgatgtcctcaaatgcacttatgatggcaatttgccagtaacaagaaaccttgctgcaaatgaatgatgatactcctctaagaagtctgtgtgagaagaataatggtcaataataaccaaaacatctttcataatccctgtttcatttgatacatgcttgtaaggtctgaagaagttttttccaagaactttgattgattattggattatactgttataataatgacaggaattcttggatcaagaacgtctacaatatatggtttagcg

SEQ ID NO: 888 - DNA, 1588 bp, Fraxinus spp
tggagttatactgaagtttgctctcaatggagtcgtcgcatggttgtagagtggtggtgccgattgatttgaagaagaaaccacggcaacagaaaccccctcttcacaatcgatggcatcccgacatacctccagttgcagaggttagaaccggagaggtattcagggtagagatggtggatttcagtgggggtggcataacaaaagagtacactgctgaagacatcaagtatgcagatccctctattgtgcattatcttagtggacctattagaattctcgatgtagatggtaatccagccaagcctggtgatcttcttgttgttgaaatttgcaatttgggtcctctacctggggatgaatggggatttacagcaatatttgatcgggagaatggaggtggattcctcactgaccacttcccttgtgcaaccaaagccatatggtattttgaaggaatatatgcttactctccgcatatacctggtgtaaggtttcctggtttaacacaccctggtatagttggaactgcaccttcaatggaacttcttaacatatggaatgagagggaaagagaactcgaagaaactggacttcaatctctaaaattgtgtgaggttctgcattcaaggccactagcaaacttaccatcaacgaagggatgcttccttggcaagattgaggaagggactcctgaatgggaaagaattgcacaagaggctgcaaggacaattcctggaagggagaatggaggaaattgtgacatcaaaaatctcagtagaggttccaaagtataccttccagtatttgtcgatggagcaaacctgagtactggggatatgcatttttcacaaggagatggtgaagttgcattttgtggcgcaatcgagatgagtggttttctagaactcaagtgtgaaatcattagggatggtatgaaagaatacctcactccaatgggtccaactcctctacatgtcaaccccatttttgagataggccctgtcgagccaagattttcagaatggttagtatttgagggcattagtgttgatgagagtgggcgacaacacttccttgatgctagcgttgcttacaagcgtgcagtgcttaatgctattgactacctgtccagatttggatacactaaagaacaggtctatcttctactttcatgctgcccctgtgaaggaaggatttcaggaatagttgattctcccaatgctcttgccactcttgcaattccaacttccatcttcgaccaggatattcgtccaaaaaccaataaagtacctataggacctcgtcttgtgaggaaccctaatatcccacagtgtagctatgatggaaagttgccgaccaccaaaaatccctgtgctacaacatgactatcatcaagtaaggagctgacgcatgaaaagcaacactacaacacgagtgctcaaggatgtttgcagaaataataaaaaagacataaataatattactttgagaagcattatgatatttcatgtttttcaatagtcaaattgctcggcctaaattccatggagtgattgaccaatatctgaacatcaaacatttcatc

SEQ ID NO: 889 - DNA, 1869 bp, Medicago truncatula
gaggagcccattgcatagtaggtagcctcatcagtttataaactactactactactactatatttatcagtgtgtgcctagtaaaagatatcacactagaaatggctcgttatggttcaagaatgttagttcccgtagacttaaagaagaagccatgggagcaggaactacctcttcacaacaggtggcatccagatatacctccagttgcagaggctacaactggtgaacttttcagagttgagatgatagatttcagtggaggtgctatcactaagaattatactgctgaagatgccaaatatgttgatctctcagctgtccatcaccttagtgggccaataagaattgtagacagtgatggtattccagcccagcccggagatttgcttgcagttgaaatatgcaacttgggtcctctccctggtgatgaatggggctttacagcaacatttgacagagaaaatggaggaggtttcttgacagaccattttccttatgccacaaaagctatctggtactttgaaggaatatatgcttattcacctcagataccaggagtgaggtttccaggtataacacatcctggtataattggaactgcgccatcaatggaactcctaaacatatggaatgaaagggaaagagatgttgcagaaaatggtattcattctctcaaactatgtgaggttttgcatagcagacccttggcaaacttaccaacagaaaaaagttgtctccttggaaagattgaaaaagatactgatgaatgggagaagattgcaagggaagcagcaagaacaataccgggaagagaaaacggtggaaattgtgacataaaaaatctaagcagaggttcaaaggtatatcttcctgtttttgtagaaggagcaaatctcagcacaggtgacatgcatttctcacagggtgatggtgaggtctcattatgtggtgcaatagaaatgagtggtttcttggaactcaagtgtgaaattataaggggaggaatgaaagagtaccttacaccaatgggccccactccccttcatgtaaatccaatatttgagataggccctgttgaaccaagattctcagagtggttagtgtttgagggcattagtgtggatgaaagtgggagacaacactacctagatgcaagtgttgcatacaaacgagcagtactcaatgctattgactacatatccaagtttgggtactcaaaagaacaggtgtaccttctactatcttgttgtccttgtgaaggaagaatatctggaattgttgatgcccctaatgcttgtgcaacattggccatccctacagctatatttgaccaggatattcgtcctaaaaataacaaagtaccaattggaccccgccttgtaaagaaaccagatgtcttcaaatgcacttatgatggaaacttgcccatcacaaaaaatctcagtgcctcatcttgatttgtattagcttggatttaaatcacatgcttctgtaacatatctcataatcttgtgatttaagccacaaaaataaagtctgtaggaaacattatgacatttgtattgtatgcaactgttttccatagaattgctggaataatgtcagtaatttaattatggcatagttgggttgaaagttgaatttatttttgatttagtgtctgtttgattctgcgtttgcaagccgagttcaaatcaaagctgcattttgcagcttcctattaatgacacgtttgtgggtttcaacaacttgtaccggcatcgacatcgaacaattagtgttgaggacttgagtcatccagttggatgctttggaagtttgcaatgataaagtcttgaattgtttagtaaatgagagctttggaaa

SEQ ID NO: 890 - DNA, 1609 bp, Vinca minor
gaaaattgagaggtttgtgatggcttcacacggtgctagattagtgattccaatagacgtgaagaagaagccaagagaacaaaagcttccacttcataaccggtggcaccctgacataccaccggttgtcgaggttaaaaccggagaacttttcagggttgagatggtagacttcagtggaggagctataacccaggacttcactgcccatgatatcaagcatgctgacccctctatcgtgcattacctcagtgggccaatcagagtgacagatgctgaaggtattccagccaagccgggcgatcttcttgctgttgaaatttgcaacttaggtccgcttcctggggacgaatggggcttcactgcaatatttgatagagagcatggtggtggttttcttactgatcactttcctaatgcaactaaagccatttggtattttgagggaatatatgcttattctccccatataccaggtgtacgttttcctggtctgacccaccctggtataattggaacggcgccttcaatggaattacttaccatatggaatgatagagaaagaactcttgaagaaactggtcatcaaacgtttaaattatgcgaggttttgcacgcacgacccttggccaacctaccatcaacaaaaggctgctatctaggcaagattcaagagggtactcctgattgggaaaagattgccagggaagctgcaaggacaatccctggtagagaaaatggtggaaattgtgacatcaaaaacctcagcagaggctcaaaggtctaccttccggtgtttgtggaaggagccaatctaagcactggtgatatgcacttttctcaaggagatggcgaggtagcgttctgtggggcaatcgagatgagtggctttttagagctcaaatgtgaaataatacgaaatggaatgaaagaatatcttactccgatgggtccaactcccctgcacgtaaaccccatatttgagataggtccagttgaaccaagattttcagaatggctggtctttgaaggtataagcgttgatgaaagtggaagacaacactttcttgatgccagtgtcgcctacaagcgcgccgtgctcaatgcaattgattatctgtcgaaattcggatattccaaggaacaggtttaccttctactttcgtgctgcccctgtgaaggaagaatttcgggaatagttgattcccccaatgctgttgctacccttgctgttccaatctctatctttgaccaggatattcgccccaaaacgaataaagtccctagtggaccacgtattgtaaggaatccaggtctaccgcagtgtccttatgaaggaaacttgccaacaacgaaaaatccttgccctgcagtttgattaccatcaaggtagaaacacaaaagcagcagcattatctaagatattcaaacaatacttttgagaagtttttttatgtatgcttatcactactgttgattcagaagatacaaccttaaaaatatgtctagggacaggtttgttttgccatacccatcatcaatcaattggcgtggaaaaagattgtaaacaaaacggaaaaacaatggatgcaataatcaaaagttggca

SEQ ID NO: 891 - DNA, 1566 bp, Phaseolus vulgaris
atggctctctatggtccaagattggtggtgcccatagacttgaagaagaaaccgtggcagcagaaaaaccctcttcacaaccgctggcatccagatataccaccggttgcagagtggccattacggccggggaagtttttagagttgagatggtagacttcagtggaggtgccatcaccaagaatcacactgcccacgatgtcaaacacgttgatccgttaactgtacattatcttagtgggccaattagaattctggataatgatgggatcccagccaagcctggagatctgcttgccgttgaaatatgcaacttgggtcctctacctggtgatgaatggggttttacagcaacatttgacagagaaaatggaggtggcttcttaacagaccattttccttgtgccacaaaagctatctggtattttcagggaatatatgctcattcacctcagataccaggagtacgatttccaggtttaacacaccctgggataattggaactgcaccatcaatggaactcctgaacatatggaatgaaagggagagagatatagaagaaaatggtgtgaagtctttcaaactctgtgaggttttgcatactcgacctttggcaaacttgccatcaacaaaaagttgtctccttggaaagatcgaaaaaggcactagtgaatgggagaggattgcaaaggaagctgcaagaacaataccaggacgagaaaacggtggaaattgtgacataaaaaaccttagtagaggggcaaaggtatacctcccagtttttgtggaaggagcaaatctcagcaccggtgacatgcacttttcccagggtgatggcgaggtctcattctgtggtgcaatagaaatgagtggtttcttagaactcaagtgtgaaattataaggggtggaatgaaagagtaccttacaccaatggggcccactcccctgcatgtaaacccaatatttgagataggccctgttgaaccaagattctcagagtggctagttttcgagggaatcagtgttgatgaaagtgggaggcaacactacctagatgcaagtgttgcatacaagcgagcagtgctcaatggcatcgactacttatccaagtttggatactccaaagaacaggtgtacctgttgctgtcttgcattccttgtgaaggaagaatatctggaatagttgatgcccccaatgctgtggcgaccctggccattccaactgctatatttgaccaggatattcgtcctaaaattaacaaggtaccagttggaccccgccttgtaagaaaaccagatgttttcaaatgcagttatgatgggaacttgcccattacaaagaatcctagtaccacataaactcagcaaaaataaagttcatgagattttttttatgcatgctattgttcctgaacatgattaaaatcaatttgcaacatagtatttggatccctcttacatcttcttgtgtcaaattaaatattaactaaatttcattaaactatgatacaatataaatggtgaagttatcatggaatccaatatgagacaaattgttctcaaa

SEQ ID NO: 892 - DNA, 1622 bp, Phaseolus vulgaris
tccctcaaactgattctgttcacaagatctgtctcagataatattgcccacaagaaatggctctctatggtccaagattggtggtgcccatagacttgaagaagaaaccgtggcagcagaaaaaccctcttcacaaccgctggcatccagatataccaccggttgcagagtggccattacggccggggaagtttttagagttgagatggtagacttcagtggaggtgccatcaccaagaatcacactgcccacgatgtcaaacacgttgatccgttaactgtacattatcttagtgggccaattagaattctggataatgatgggatcccagccaagcctggagatctgcttgccgttgaaatatgcaacttgggtcctctacctggtgatgaatggggttttacagcaacatttgacagagaaaatggaggtggcttcttaacagaccattttccttgtgccacaaaagctatctggtattttcagggaatatatgctcattcacctcagataccaggagtacgatttccaggtttaacacaccctgggataattggaactgcaccatcaatggaactcctgaacatatggaatgaaagggagagagatatagaagaaaatggtgtgaagtctttcaaactctgtgaggttttgcatactcgacctttggcaaacttgccatcaacaaaaagttgtctccttggaaagatcgaaaaaggcactagtgaatgggagaggattgcaaaggaagctgcaagaacaataccaggacgagaaaacggtggaaattgtgacataaaaaaccttagtagaggggcaaaggtatacctcccagtttttgtggaaggagcaaatctcagcaccggtgacatgcacttttcccagggtgatggcgaggtctcattctgtggtgcaatagaaatgagtggtttcttagaactcaagtgtgaaattataaggggtggaatgaaagagtaccttacaccaatggggcccactcccctgcatgtaaacccaatatttgagataggccctgttgaaccaagattctcagagtggctagttttcgagggaatcagtgttgatgaaagtgggaggcaacactacctagatgcaagtgttgcatacaagcgagcagtgctcaatggcatcgactacttatccaagtttggatactccaaagaacaggtgtacctgttgctgtcttgcattccttgtgaaggaagaatatctggaatagttgatgcccccaatgctgtggcgaccctggccattccaactgctatatttgaccaggatattcgtcctaaaattaacaaggtaccagttggaccccgccttgtaagaaaaccagatgttttcaaatgcagttatgatgggaacttgcccattacaaagaatcctagtaccacataaactcagcaaaaataaagttcatgagattttttttatgcatgctattgttcctgaacatgattaaaatcaatttgcaacatagtatttggatccctcttacatcttcttgtgtcaaattaaatattaactaaatttcattaaactatgatacaatataaatggtgaagttatcatggaatccaatatgagacaaattgttctcaaa

SEQ ID NO: 893 - DNA, 1633 bp, Olea europaea
aggctcgttgtagtggaggtgtagtgaagtttgccatcaatggaggcgtcgcgtggttgtagcgtggtggtgccaattgatttgaagaagaaaccacgggaacagaaacttcctcttcacaaccgatggcatcccgacatacctccggttgccgaggttagaactggagaggtattcagggtagagatggtggattgcagtggaggtggcataacaaaagagtacactgctgaagatatcaagtatgcagatctctctattgtgcattatcttagtggacctattagagttcttgatgtagatggtaatccagccaagcctggtgatcttcttgctgttgaaatttgcaatttggggccgctacctggggatgaatggggatttacagcaatatttgatcgggagaatggaggtggattcctcactgaccactttccttgtgcaaccaaagccatatggtattttgaaggaatatatgcttactctccacatatacctggtgtacggtttcctggtttaacacaccctggtgtagttggaactgcaccttcaatggaacttcttaacatctggaatgagagggaaagagaagtcgaagaaaccggacttcagtctctaaaattgtgtgaggttctgcattcaaggccactagcaaacttaccatcaacaaagggatgctttctaggcaagattgaggaaggggctcctgaatgggaaagaattgcacgagaggctgcaaggacaattcctggaagggagaacggaggaaattgtgacatcaaaaatctcagtagaggttccaaagtataccttccagtatttgtcgatggagcaaacctgagcactggggatatgcatttttcacaaggagatggtgaagttgcattttgtggcgcaatcgagatgagtggttttctagaactcaagtgtgaaatcattagggatggtatgaaagaatacctcactccaatggggccaactcctctacatgtcaaccccatttttgagataggccctgtcgagccaagattttcagaatggttagtatttgagggcattagcgttgatgagagtgggcgacaacactttcttgatgcttccgttgcttacaagcgtgcagtgctaaatgctattgactacttgtccagattcggatacactaaagaacaggtctatcttctactctcatgctgcccctgtgaaggaaggatttcaggaatagttgattctcccaatgctcttgccactcttgcaattccaacttccatcttcgaccaggatattcgtccaaaaatcaacaaggtgcctaaaggacctcgtcttgtgaggaaccctaatatcccacagtgtagctatgatggaaagttgccaaccaccaaaaatcccagtgctacgacatgactatcatcaattgacacatgaaaagcaacactagaacacgagtactcgaggatattggcagaaacaataaaatacttatagcaggatttgagaagtattttgatatttcatgtttttcaatagtcaaatcgcttggcaaaaactccacagagcgattgacaaatatttgaacaggttatgctatatgtatattacaacttatttgtttaccaacagatgatgtggccaaatt

SEQ ID NO: 894 - DNA, 1925 bp, Brassica rapa
tcgatgcattgccacacatacacaaagatgaaagaaagttaaaggccataaagaaaagtctattgtcctttagtttgtggataaggaatctgccaaaccaatgattcctctcttcccattacaagagaaaaaagaaaagagagaatagaagttgctgtacttactgtaatcggttttaatggctcctgcaactccgagagtggtggtgaaagtggatttgaagaagaggccatgggagcaggaacagcctctgcataacagatggcatcctgagatacaaccagttggtgaggtcaaggctggtgagttctttagagtggaaatggttgactggactggaggtgcagtcaaagatgatgactctgctgaggatattaagagcttagacctctccactgttcattacctaagtggaccgatcaaagttgtggatgaggaaggtgttgcagcaaagccaggtgatcttcttgctgttgagatatgcaacttaggtccattaccaggagatgagtggggcttcacagcttcgtttgatagagagaacggtggcggtttcttgactgatcatttcccttgtgccaccaaagctatttggtactttgaagggatctatgcctactctcctcagattcctggagtaaggtttccaggtttgacacacccaggcatcattggcactgcaccatcaaaagaacttttgagaatatggaatgaaagggagagacaattagaagaaagtggtctcagttccctaacactatgtgaggttgtgcatcaacgcccacttgcaaacctaccaatagctaaaggatgtctcctagggaacatggaagaggggacaccggaatgggaaaggattgcaaaggaggctgcgagaacaatcccaggaagagaaaacggaggaaactgtgacataaagaacctaagcagaggctctaaaatatatcttccagtgtttgtggaaggagctaacttaagcactggtgacatgcatttctctcaaggtgatggtgagatctctttctgcggagccattgagatgagtggattcctagaactcaagtgtgaaatcataagaaacgggatgaaggagtaccttacaccaatgggacctacgcctctccacgtgaacccgatattcgagataggtccagtggaaccaagattctcagagtggctggtctttgagggtatcagtgtagatgagacagggagacagcattaccttgacgcaacagttgcttacaaaagagcggttctcaatgctatagactatctattcaagtttggttactcaaaagaacaggtatacctgttactctcatgttgcccatgtgaagggagaatatctgggatagtcgattctccaaacgcacttgctacacttgcaatacccacatccatctttgatcaggatatacggccaaagactcaaaaggttccagcaggacctcggatagtgagaaagccagacgttatgaagagtacatatgatggcaaacttgaaactacaaggaatccaagttcttcgtcttatagctaacacgtagaccgtataaggctataagcaatcatatgtttggataacataataaaggcaaaacaaataaaactatacattccttcttctacatatagacatctacataatctatcgttaaacagatgatagctcgctctgtttcaaaacacggagctgctgaaacatggtgatccaagacgagacttttagctactgcccagaaacgctaggaatggaagatgaagaacaaagctccattgcttcatcaaattcgaactattcgattgataaacgtctctgctttgatgttttggcaacgaagaagatggcattgttcaattgataaatgtctctctagcaaagcccgtaaacgcccattggggatcctcaaatctattacgca

SEQ ID NO: 895 - DNA, 1528 bp, Cichorium intybus
tgtcagactagtgataccaatagacgtcaccaagaaaccacgacaacagaagctaccccttcacaaccgatggcaccccgacataccaccggtggctgaggtcaccgtcggggaggttttccgggttgagatggtggatttttccggcggtggtatcacgaaagaatacacagccgaagacatcaaatacgccgatcagtctgttgtgcattatttgagtgggccgattagggttgtcgatgaggaaggaatagcggctaaaccgggagatattcttgcggttgaaatatgcaatttgggtccacttccgggtgatgaatggggttttacggcgatttttgatagagaaaacggtggtggttttcttactgatcatttcccttgtgccacgaaagcaatttggtattttgaaggaatatatgcttcctctccccatataccaggtgtaaggtttccaggtataacacaccctggaataattggaactgcaccttcaatggaactccttaatatatggaacgaaagggagagagatctcgaagaaaatggtctaaagtccttaaaattatgtgaagttttgcattcaaggccgttagcaaatctcccatcaacaaaaggctgccttcttggcaagattccagaaggaactcaagaatgggagaagattgctaatgaggctgcaaggacaattccaggaagagaaaatggaggaaactgcgacattaagaatttaagtagaggttcaaaaatttacctaccagtatttgtggaaggcgctaatttcagtacaggtgatatgcatttctcacaaggcgatggtgaagtttcattttgtggggcgattgaaatgagtggattccttgagctcaagtgtgagataattcgaggcgggatgaaagaatacctaactccgatgggacctacacctcttcatgttaaccctatttttgagatcggcccaatggagccgaggttttcagaatggcttgtatttgagggaattagtgtagatgagagtggaagacagcattaccttgatgcgagtgttgcttataaacgtgcagttctgaatgccattgattatctctccaaatttgggtactctaaagaacaggtttatcttctactgtcgtgttgtccatgcgaaggaaggatttctggaattgtggatgctcctaatgctgttgccacacttgcgattccattggctatctttgatcaggatattcgtccaaagtctaacaaggtgccagtaggaccacgtgtggtgagaaatccagatattcctagatgcagttatgatgggaatttaccgataacaaaaaacccgggtgcaactgggtgagttaataatcatggttgttgaaacttgaaagtgaagacatggtgtgtttcgatttgtagcaactgttttgaagtttgatgtcgttattcattttctctcaagaagtttgaatacacgtcaatttagaagctgaaatataacctaattgatgcaaagataatgaatctgattcaattctacatg

SEQ ID NO: 896 - DNA, 1897 bp, Cajanus cajan
gttttgaaccattgaagtcatgtacacattcctttccaatgaagaagaaccaaaagagcagaaacagctagtggacttttccaatcatggcgtaagtagtggtccagctgaaggcgccagaaaagggtgatgaagagtcaaatcaagaggctttcaatggctataaaacgtaactcgaaatgcaaagatcatcagagtggaacaccatcaaaagaagctccctcaccactgttttaatttgtgcacaatatcatctttgagatactattaattgctcataactaatggctcggtatggtccaacactagtagtgcctatagacttgaagaagaagccttgggagcagaaacaccctcttcacaaccggtggcacccagatatacccccagttgcagaggttaaagctgatcaactttttagagttgagatgatagatttcagtggaggagctatcaccaacaatcacactgctcatgatgtcaagcatgttgatcccttaactgtccattatcttagtgggccgatcagaattctggataatgatgggatccctgccaagcctggagatctgcttgcagttgaaatatgcaacttgggtcctctacccggagatgaatggggttttacagcaacatttgacagagaaaatggaggtggttttttaacagaccattttccttgtgccacaaaagctatatggtactttgagggaatatatgctcattcgcctcagataccaggagtacggtttccaggcttaacacaccccgggataattggaactgcaccatcaatggaactcttgaacatatggaatgaaagggagacagatgtggaagaaaatggtattaagtctttcaaactatgtgaggttttgcattcacgacccttggcaaacttaccatcaacaaaaagttgtctccttggaaagattcaaaagggcactactgaatgggagaagattgcaaaggaagctgcaagaacaataccaggacgagaaaacggtggaaattgtgacataaaaaacctcagcagaggagcaaaggtatacctcccagtttttgtagaaggagcaaatctcagcactggcgacatgcacttctcacagggtgatggagaggtctcattctgtggtgcaatagagatgagtggtttcctagaactcaagtgtgaaattataaggggtggaatgaaagagtatcttacaccaatggggcccactcccctgcatgtgaacccaatatttgagataggccctgttgaaccaagattctcagagtggctagtatttgaaggcatcagtgtggatgaaagtgggaggcaacactacctagatgcaagtgttgcatacaagcgagcagtactcaatgccattgactacatatccaagtttggatactccaaagaacaggtgtacctccttctgtcttgcatcccttgcgaaggacgaatatctggaatagtcgatgcccccaatgctgtggcaacccttgccattccaacagctatatttgaccaggatattcgtcctaaaaataacaaggtaccagttggaccccgactcgtaaagaaaccagatgtcttcaaatgcacttatgatgggaacttgcccattacaaggaatcctagtgccacaccatgattcatattagctacaaatcacataatactgtgacgtatcccaggaaaataaagttaatatggacatttgtatcgtatgctacgtactgttcgctggacagtggaaagcatgttagtaatctaaattataataaaacattaaaatctgttcaataccaacaaattgacttacaatatgttgttataaatatctgtccatttgattttaatgaaaaaaatattaaataatttttaaattttataaaaatttataaa

SEQ ID NO: 897 - DNA, 2766 bp, Theobroma cacao
accatattttaattatgaatcacgaatatgttagaaaatctgtaaaaggatgacggttggccaagctgacaggcatggtacaatgactttatagtacaagaggcatcaatttctacatattttaacaaatcagtgtcagacacgactcaatttcacttccatcatgtgaaaaaacttccatcaagtacagggcataggttagaatcaatttggtcatctcctaagcacaagctttagtcgtagatttagcattttatcattggaaattaccctcaaatcactgttattttgtcctaagagaaatccaaggtaatgtgtcaaaacccacatcaattccaagtggtccatccatcaaagaaaaagtcccaactcatggctgtcaaagttaaaggtttgccgtatgttggcaattgtgatgagtctctgattatcatcatacctaactgtttcttgcattcagctaaaccaaggctgcaattctagactgagccatggctgggtatggtgcaagagtagtggtgcccatagacttgaagaaaaagccatgggaacagaaacatcccctccacaaccggtggcaccccgacataccggctgttgcagaggttaaggagggagagcttttcagagtcgaaatggtggatttcagtggaggtggaattacaaaggactactctgctgatgatgtcaagcatgctgatccatctattgtgagttatagttcaatcttctgtctttcagtttctaattccaacttctactgctggtgcttaaaagcaaatacctccatgaaaaataatagctccaaatcgaatgtcaggcacaaatttacgctgctagaacataggacttttcctatagactttctcccaaccttctcatccatggctccaactccaagactggtggtgccaatagacttgaagaagaagccatgggaacaaactctgcctcttcacaaccgttggcaccctgaaataccctcggtagcggatgttgaagtcggtgaggtctttagagtagagatggtagactggactggaggtatcataaaagatgatgattccgcaactgatgtaaaatttatagacctctccactgtccattatctcagtgggccaattagagttgtagacaaggatggcatacctgccaagccaggtgatcttcttgcagttgaaatatgtaacctgggtcctttgccgggggacgaatggggttatacagcaacgtttgacagagaaaatggaggaggtttcttgacagaccattttccatgcgcaactaaagctatttggtattttgaaggaatttatgcctactctccccatataccaggggtgagatttccgggtttgactcatcctggaataattgggactgcaccatcaatggaacttctgaatatatggaatgaaagggaaagagaagtagaagaaaatggccataagtccctaaaactatgtgaagttttgcattcaagaccgttggcaaaccttccatcaaccaaaggctgccatttaggaaagataactaaggggactgctgaatgggaaaagattgctaaggaagcggcaaggactattcctggaagagaaaatggaggaaattgtgacatcaagaaccttagtagaggttcgaaaatatatcttccagtgttcgtagaaggagcaaatttcagcaccggtgacatgcatttttctcaaggtgatggtgaagttgccttctgcggagcaattgagatgagtggttttctagagctaaagtgcgaaatcataagagatggaatgaaagagtaccttactccaatggggccaaccccacttcatgtaaacccaatcttcgagattggcccagttgaacccagattctcagaatggctggtgtttgaggggataagcgtggatgagaccggaaggcaacatttccttgatgcaagtgttgcatataaacgtgcagtactcaatgctattgactacctctctaagtttgggtactccaaagaacagatataccttctgctatcctgctgcccatgtgaaggaaggatatctggaattgtggattcaccaaatgctcttgcaactcttgcaattccaactgctatctttgaccaggacattcgtccaaaaactggaaaggtaccagtagggcctcggctagtgagaaaaccagatgtcttaagatgcacttacgatggaaatcttcccacaacaaagaacccagctgccttgatgtaactcaagtccatggagctaaaagcaagaaacagctatgtcgggttacacttctatgcctagtggggctttatgcatatgaaaacaattatgggtggaaaaacagtaatgtgacagaataaactccaatttctggctgagctgtgacagtttccatcatgggccaaaactcatattcgtaagagaatgttgtacgttacaggattttctacacactgtagccaacaaaagaacaccaacattgcgatcacaaatatgttggaaaaagaacgatattagttgacccttttcaaagaagcagcccagttatctatggactagcataaaagccatctaaatataaataaatacacgcatggaaatgccatttacgtttggtgaacagatgcattatgagcaactatttcatttagcaactaaacacatgaacagattttttaattagatctttccagttgatactgaatcaactgaacagttaaatattaaaactgtgatccttgagacctgataaacattaaaggatgtc

SEQ ID NO: 898 - DNA, 1505 bp, Catharanthus roseus
agcagagtgggcatgggaatgggtactagattggtgattcccatagatgtgaagaagaagccaagggaacaaaagcttccacttcacaaccggtggcaccctgacataccaccggtaacggaggttacaaccggagaagttttcagggttgagatggtggacttcagcggcggaggaatcacacaggagtttactgctcaagatatcaagcatgttgataactcaatagtacattacctcagtgggccaatcagagtgacagatgttgatggaattccagccaagccgggtgatcttcttgccgttgaaatttgcaacttaggcccacttcctggggatgaatggggcttcactgcaatatttgacagggagaatggtggtggttttctaaccgatcactttcctcatgcaactaaagctatttggtactttgagggaatatatgcttactctcctcatataccaggtgtacgttttcctggtttgacccaccctggcataattggaacggcaccttcaatagaactacttaccatatggaatgaaagagaaagaactcttgaagaaactggtcatcaatctctgaaattatgtgaggttttgcatgcacgacccttggccaacctgccatcaacaaaaggctgttatctgggcaagattcaagagggtactccggaatgggaaaagatggccagagaggctgcaaggacaatccctggaagagaaaatggtggaaattgtgacatcaaaaaccttagcagaggctcaaagatttacctcccagtgtttgtggaaggagcaaatcttagtactggagacatgcacttttcacaaggagatggtgaggtggcattctgtggggcaatcgagatgagtggctttttagagctcaaatgtgaaataatacggaatgggatgaaggaatacctcactccaatgggtccaactcccctgcatgtaaaccctatatttgagatagggccagttgaaccgaggttttcagaatggttggtatttgaaggtataagtgttgatgaaagtggaagacaacattttcttgatgccagtgttgcctacaagcgtgcagtactcaatgcgattgactatctgtcaaaatttggatattccaaggaacaggtttaccttctactttcatgctgcccctgtgaaggaagaatatcaggaatagttgattccccccaatgctgttgccacccttgctgttccaactgcatttttgtaccaggatattcgtcccaaaataaataaaagtgcctactggaccacgtgttgtgaggaatccaggtctcccgcagtgtccttatgaaggaaacttaccaacaacaaaaaatctctgccccacagtttgattaccatcaatggagaagcaaaaagacagaagcactatccaagaaatttaaaaaatgtttttgggaagtcttatgtatgctaccaatacttttgatccaaaagatgcaaccttaaaaagataacctagaggcaag

SEQ ID NO: 899 - DNA, 1524 bp, Fraxinus spp
gctccacaattttaggaacctaaattcagcaagtggttgattcatccttttggtggaggtatactgaagtttgctctcaatggagtcgtcgcatggttgtagagtggtggtgccgattgatttgaagaagaaaccacgggaacaaaaaccccctcttcacaatcgatggcatcccgatatacctccagttgcagaggttagaactggagaggtattcagggtagagatggtggatttcagtggaggtggcatacaaaagagtacactgctgaagacatcaagtatgcagatccctctattgtgcattatcttagtggacctattagaattcttgatgtagatggtaatccagccaaacctggtgatcttcttgttgttgaaatttgcaatttgggtcctctacctggggatgaatggggatatacagcaatatttgatcgggagaatggaggtggattcctcactgaccactttccttgtgcaaccaaagccatatggtattttgaaggaatatatgctcactctccgcatatacctggtgtaaggtttcctggtttaactcaccctggtatagttggaactgcaccttcaatggaacttctcaacatatggaatgagagggaaagagaacttgaagaaacgggacttcaatctctaaaattgtgtgacgttctgcattcaaggccactagcaaacttaccatcaacaaagggatgcttccttggcaagattgaggaaggaactcctgaatgggaaagaattgcacgagaggctgcaaggacaattcctggaagggagaatggaggaaattgtgacatcaaaaatctcagtagaggttccaaagtataccttccagtatttgtcgatggagcaaacctgagtactggtgatatgcattttttcacaaggagatggcgaagttgcattttgtggcgcaatcgagatgagtggttttctagaactcaagtgtgaaatcattagggatggtatgaaagaatacctcactccaatggggccaactcctctacatgtcaaccccatttttgagataggccctgtcgagccaagattttcagaatggttagtatttgagggcattagtgttgatgagagtgggcgacaacacttccttgatgctagcgttgcttacaagcgtgcagtgcttaatgccattgactacctgtccagatttggatacactaaagaacaggtctatattctactttcatgctgcccctgtgaaggaaggatttcaggaatagttgattctcccaatgctcttgccactcttgcagttccaacttccatcttcgaccaggatattcgtccaaaaatcaataaagtacctacaggacctcgtcttgtgaggaaccctaatatcccacaatgtagctatgatggaaagttgccgaccaccaaaaatcccagtgctacaaaatgactatcatcaggtaagtagccgacacatgagaagcaacgctacaacatgagtactcaaaggatgtttgtagaaatattgaaaaa

SEQ ID NO: 900 - DNA, 1721 bp, Aquilegia formosa
ttcatccatggctcctggtactccaaagctggttgtgcccatagacctaaagaagaagccatgggaacagaaggttccccttcacaatcgttggcacccacatatacctgcagtcacagaagttacagtaggagacttcttcagagttgagatggtagactggactggtggtgtcattcaagataatgactctgccatggatgtaaaatccataaatctttctacagtacattatcttagtggacccatcagagttgttgacacagatggtattccagccaagcccggagatctccttgcagttgaaatctgcaacttggggcctcttcccggagatgaatggggatatactgcaacatttgacagagaaaatgggggtggatttctgacagaccatttcccttgtgcaactaaagccatttggtactttgaaggaatatatacttactcacctcaaataccaggtgtacgatttccgggtctaactcaccctggcataattggaactgcaccatcaatggaactgctaaacgtatggaatgagagggaaagagaactcgaaaagaatggccttcagtctctaaaattatgtgatgtcctgcacacacgaccattggcaaacctaccaacagccgaaggttgccatcttggactggttaaagcggatacttctgaatgggcaaatatcgcatcggaggcagcaaggactattccaggaagagaaaatggaggcaattgtgacataaaaaatcttagcaaaggctcaaaaatatatctacccgtatttgtagaaggtgctaattttagtacaggtgacatgcacttctctcaaggcgatggtgaagtctcgttctgtggagcaatagagatgagtggattcctagagctcaagtgcgatatcataaggaacggaatgcgagaatacctgactccaatggggccaactccacttcatgtgaacccaatctttgagataggtccagtcgagccaagattctcagagtggttggtgtttgaaggcatcagtgttgatgaaagtggaaagcagcactaccttgatgcgactgtggcatataaacgtgcagtcctcaatgccattgactacctctcgaggtttggatactccaaagagcagatctatcttctgctctcttgctgcccttgcgaaggaaggatttcaggaattgttgattcccctaatgcttgtgctacccttgcaattccaacagctatctttgaccaggatattcgccccaagtccagcaaagtaccagtcgggcctcgtgtggtgaaaaaaccggatgtcttaaaatgcacttatgatggaaacttgcctgtcacaaagaaccctggtggtgcaacataatttgcacaaagggaacatagtcaaagtttgcatcattgatcatatctctccaggctccagtttatagacacaatgtgttttgaaatctacagacggatcatggtcgaacgaactaaaataaaggttcagattatctgaaccataggtcttaggtgggttgatgttagccaccaagtaaaatgaaaattctgttagtgagtgtgtaactacttatccaaatgttcttagttacctgaatattgaaagggttcgaaatgtaggatgaatcagaaggatggttgcatcataatttccactatggcctgaaactgcaagatcatatgcaaacttttaatataaaggaatgttcatctgg

SEQ ID NO: 901 - DNA, 2160 bp, Triticum aestivum
cacacgtggtgtgggcgccccacgtcagggtgacttccgaactcatttctgcgtgcggttgaagtcacccgattccgtccgcgactcctcccgtccctccctcctggtgtggagtccaggtcggactcaccgcgcctccgattcgatccccccacgccggggttcatcaggaatcctaagcttggaagggcggaggaatcctgcacacacatagcttcggaatcccgcaagcgcgagaacgcccggagctaaacccgagttactgctgcgacatgaagcccaaggttgccgcagccgctgccggcggcgagaagggccggggagtggacccgtcgctgccgcggtttaagtgccaggaatgccaccgggcgctagtcgtcgtcggcgtagagtcattccccgataggttgcccgctcacgccaactccggtatacatgcatcctctgttcagggcagcattatgggggcgagcaggatggacagttcttacgttgtgttgtccaagcagaacagatctcaaggccccgggattcccccacggccacctagtgcagcagcccggcatgttgagcctaaccaatcaacaagagcaatagaggggtcatatataatgcttccacctgccgctgcttccatatacaagacatctacctccgaaggaggtggcgcgcatctgtcgcctccaaatgttaactctactagcccttcaccaggcaacaattctggatttcactctagtgtgactgtcttaaagcgggcatttgagattgctagttcacaaactcaggttgagcagccactctgtctggaatgtatgagggtgctttctgataagatggacaaggagattgaggatgtaaatactgacatcaaagcttatgatgcatgtcttcaacgtttggagcaggaatcctacaacgtccttagcgaaactgatttcctcaaggagaaagagaagatagaggaagaagaaaagaaactaaaagctgctattgaagaagcagaaaagcaatattcagaagttagctctgagatgaaggatcttgaaacaaagtctaaacaatttgaagaattagaagagcggtattggcatgaattcaacagcttccagtttcagctgacatctcaccaggaagaaagagatgcggttttggccaagatagaagtttcacaggtccacctggaactgttaaagcgcacaaatgttctcaatgatgcattctatatttcacatgatggagtgattggaacaataaacaacttccgtctcggtcgtctgcctaatgtacaggttgagtgggatgagataaatgctgcttggggtcaggctgctcttctgttacacaccatggctcagtacttcccgaaatttcaatatcgaatcaagattcaccctatgggaagctacccaagagtaacagacatcaacaataatacctatgaactgtttggtcctgtgaatttattctggagcacccgatttgacaaagccatgacatggttcctcacttgcctgcaagagttctccgagtttgccataagtttggataaagagaacaatgttccatctgataagtcattgaagctcccctacaagattgatggtgacaaagtagggagctacacaatcttcttaagttttaataaactggagaactggacaaaggctctaaaatatatgctttgcaacctgaagtgggttctctactggtttatcggcaatacaagtttcgcgccgccatctgcatctttgtacttggcgcagtctccaaacaagaagggttgatgtgatgtttaaaagcagatggaatcactgacctcagatgctggatcgttgattgtagccgcatgttgaccaatcacaatacaatatgaaattgatgtacataaataccaggcatagctagttttcttgttgcttccaagtcatccatgcgtgtacctgcccaatgtatataaatatggactggagtgagttccattaatatgtactccctctgtaaagaaatagatcgtttagatcagtattatcagctttgcgctacaagtgcagagaaattggaatgacagcgaatgcagtttcaatgtacctgcgttgcatctgacacctatattcgtacgtgtatttctttagaagtacctgtagctttagttatact

SEQ ID NO: 902 - DNA, 1853 bp, Triticum aestivum
aagggccgcggagtggacccgtcgctgccgcggtttaagtgccaggaatgccaccgggcgctcctcgtcgtcggcgtggaatcattccctgataggttgcctgctcacgccaactccggtatgcatgcatcctctgttcaaggcagtattatgggggcgagcaggatggacagttcttatgttgtgttgtccaagcagaacagatctcaaggccctgggattcccccacggccaccaaatgcagcagcccggcatgtcgagcctaaccaatcaacaagagcaatagagggatcatatataatgcttccacctgccgctgcttccatatacaagacatctacctccgaaggtggtggcgcgcatctgtcgcctccaaatcttaactctactagcccttcaccaggcaacaatactggatttcactctagtgtgactgtcttaaagcgggcatttgagattgctagttcacaaactcaggttgagcagccactatgtctggaatgtatgagggtgctttctgataagatggacaaggagattgaggatgtaaatactgacatcaaagcttatgatgcatgtcttcaacgtttggagcaggaatcctacaacgtccttagcgaaactgatttcctcaaggagaaagaaaagatagaggaggaagaaaagaaactaaaaactgctattgaagaagcagaaaagcaatattctgaagttagctctgagatgaaggatcttgaaacaaagtcgaaacaatttgaagaattagaagagcggtattggcatgaattcaacagcttccagtttcagctgacatctcaccaggaagaaagagatgcggttttggccaagatagaagtttcacaggtccacctggaattgttaaagcgcacaaatgttctcaatgatgcattctatatttcacatgatggagttattggaacaataaacaacttccgtctcggtcgtctgcctaatgtacaggttgagtgggatgagataaatgctgcttggggtcaggctgctcttctgttacacaccatggctcagtacttcccgaaattccaataccgaatcaagattcaccctatgggaagctacccaagagtaacagacatcaacaataatacctatgaactgtttggtcctgtgaatttattctggagcacccgatttgacaaagccatgacatggtttctcacttgccttcaagagttctctgagtttgccataagtttggataaagagaacaatgttccggctgacaagtcattgaagctcccctacaagattgatggtgacaaagtagggagctatacgatcttcttaagttttaataaactggagaactggacaaaggctctaaaatatatgctttgcaacctgaagtgggttctctactggtttatcggcaatacaagttttgcgccaccatctgcatctttgtacttggcgcagtctccaaacaagaagggttgatgtgatgtttaaacgcagatggaatcactgacctcagatgctggatcgctgattgactgattgtagccgcatgttgacaaatcacaatacaatatgaattgatgtacataaataccaccaggcatagctagttttcttgttgcttccaagtcatccatgcgtgtacctgcccaatgtatataaatatgaactggagtgagttccattagtatgtactccctctgtaaagacatataagatcgtttagatcagtgcatcagctttgcgctacaagtgcagagaaattggaatgacagcgaatgcagtttcaatgtacctgcgttgcatccgacacctaaattcatacgtgtatttctttagaagtacctgtagcttta

SEQ ID NO: 903 - DNA, 2477 bp, Brachypodium distachyon
gttgcatgtacgtctagcgttactgacacggctgcccaaccaacaggaaatcttcccctcggaagaaattagaaatccaccaagcggagccccgatccccttcccatcccttcttctccttcttgcctggagccgccaccgcccgctggccgccccgcgcagtcctgtcctctcgtctccgccttgtcccttctccccgccgctcggtggccgccatcgtcctcgaccttttttttttggccgggctctcccgtaaataccgctctacgcccgccgacaggcggggccaagacgttgtgtttaggccacatgtcagtcacttccgtgcttatttctgcgtgcggttaaagtcacccggtaccgttcgcgactagtcctggtgtggaggtggagtccaggtcgggctcgccgcctccgattcgatcccctcacagcggaactcatcagggatcaattgctgcttcaaagcgcggacaaattcagcagatagataactttggaatcccacaggcgcgagagcagcgaccgcagagtcccgactgtctgctgcgacatgaagcccaaggctgccggcggcggcggcgataagggccgtggcgtggacccttcgctgccgcggttcaagtgccaggagtgccaccgggcgctcgtggtcatcggcgtggagtccttcgccgataggcttcccgctcacgccaactccggtatgcatgcatcctctgttcagggcagtattatgggcgcgagcaggatggatagttcttacgtggtactatccaagcagaacaaatctccaggccctggaatccccccacgcccaccaagtgcagcagcccggcatgttgagccaaaccaatcaacaagagcaatagaggggtcatatataatgcttccacctgctgctgcttccatatacaatacatctgcctctgaaggaggtggtgcacatctgccacctccaaatcttaactccactagcccttcaccaggaaacaattcgggatttcactctagtgtgactgttttgaaacgggcatttgagattgctagttcacaaactcaggttgagcagccactgtgtctggaatgtatgagggtgctttctgataagatggataaggaggttgaggacgtaaatactgacattaaatcttatgacgcttgtcttcaacgtttggagcaagaatcgtacaacatccttagtgatgctgatttccacaaggagaaacaaaagatagaggaggaagaaaagaaacttaaggctgctattgaagaagttgaaaagcaatattcagaagttacttctgagatgaaggatcttgaaacaaaatctaaacaatttgaagaattagaagagcggtattggcatgaattcaacagctttcaatttcagctgacatctcaccaggaagaaagagatgccgttttggccaagatagaagtttcacaggttcacctggaattgttaaagcgtacaaatgtccttaatgatgcattctatatttcacatgatggagtgatcggaacaataaacaacttccgtctcggtcgcctccctaatgtacaggttgagtgggatgaaataaatgctgcttggggtcaggctgctcttctgctgcataccatggctcagtacttcccaaaatttcaataccggatcaagattcaccctatgggaagctatccaagagtcacagacatcaacaataatacctatgaattgtttggtcctgtgaatttattctggagcacccggtttgacaaagccatgacatggtttctgacttgccttcaagagttcgctgagtttgccataagtttggatcaagagaacaatgttccaagtgacaagtcattgaagcttccttacaagattgataacgacaaagttgggagccacaccatcttcttaagttttaataaacttgagagctggacaaaggcgctaaaatatatgttgtgcaacctgaagtgggttctctactggtttattggcaatacaagttttgcaccaccctctgcatctttgtacttggcgcagtctccaaacaaaacgagctgacgtcgtgtttaaacactgacgatgtcactgacattagaccccaagtctctcatggtagctgtgatgttgaccaatgacaatgacatgtgcatttgatgtacagtacataatataccaggtatagctagccttcttcttccttgcaagtcatggatttatgtacctgcccattgtgtgtgtatatggactgcatgaatcccattactatgcatcagttgcccacaaaatagtaccgtactgaattccctgtttgaagtgcacttcaaattactttttttttgttgacatgtttgaatttgagtcaatttcattgtggcgcgacttatcaagaaacatgttgaaagaatttattggattggcgcaaaccaatctttcctgcacaagatttcatatctaaattcatgagcatggggaa

SEQ ID NO: 904 - DNA, 1939 bp, Setaria italica
acagaaagaaagaaagaaagaaagaaattctccccgtctcgtctcgctgctgcgtgcctgcggggacactccatctccaccacgatcccccaccctcctcctctcgccggccgaggacgagccgccgccggcagcagggcgcgggctacagctagtccgttcgattcttcggagcctgcaagcgggagcggcgtccttggcgaggaggcgacatgaagcccccggccgccgccggcaagggcggcgcggtggacccgtcgttgccgcggttcaggtgccaggagtgccgccgcgcgctcgtcgtcgtcggggtcgactcgtacgccgacaggctgcccgcccacgccgcgtccggtaatcatgcatcttctgttcagggcagtgttatgggtgcaagcaggatggaaaattcctatgtcgtgttatccaggcagaacagatctcaaggtcctagaattcccccacgcccaccaagtgcggcagccccacatactgaacccagccaaccaacaagagcaatagaggggtcatatatagtgcttccacctcctgccgcttccatatacaagacacctgcctccgaaggaggtggtgcacagcttacaccaccgggggtaaactccagtagcccttcaccaggaaacaattctggatttcactctagtgttacagtactgaaaagggcttttgagattgctagctcacaaactcaggttgagcagccactttgtttggaatgcatgagggttctttctgataagatggataaggagattgaagatgttaatgctgatattaaagcttatgaggcttctcttcaacgtttggagcaggaaccctacaacatactcagtgaaacagactttcagaaggagaaacaaaagatcgaggaagaagaaaagaaacttaaagctgctattgaagaagctgaaaagctatattcagaagttacttctgaaatgaaagatcttgaaataaagtctaaacaatttgaggaattggaagagcggtattggcatgaattcaacagttttcagtttcagttgaaatctcaccaggaagaaagagatgcagtttttgccaagatagaagtttctcaggttcatctggaactgttgaaacgtactaatgttctcaatgatgcattctatatttcacatgatggagtaattggaacaataaacaatttccgcctcggacgtctctctaatgtggaggttgagtgggatgagataaatgctgcttggggtcaagctgcactgttgttgcataccatggctcagtatttcactccgaaatttcaataccggatcaagattcaccctatgggaagctatccaagagtcacagatatccacaacaatacatatgaactgtttggtcctgtgaatttgttctggagcacccgatttgacaaagccatgacatggtttctgacttgcctgcaagagtttgctgagtttgccgtaagtttggataaggagaataatgttccatctgagaaatcattgaagcttccctataagatagatggagacaaagtagggagccatacaatcgtcctaagtttcaataagaatgagaactggacgaaggcgctaaagtacatgctgtgcaatctgaaatgggttctctactggttcattggcaacacaagttttgcgccaccctcagggccagtgcgcgcacaatctctgaagaacaagagctcatgatgttttaacttgtacatagtttaaaataccaaccaaggtattgaccctagtcgttagactctagccgtagtgacaataacgacacagttgatgtacatacatgtagcacataatgtctattacttcaagtctgccgtcttgtccgaaccctcttgtatgtggattccaattccatcggccgttccattcaagtagcagtaataagattgttcagtcttttaaga

SEQ ID NO: 905 - DNA, 1920 bp, Zea mays
aacagcgagaaagaggggaaataaaatctccccgtctcgctgctgcgtgcctgcggggacactccatctcctcctccagacctccacgatccggcctcccccacctctcgccggccgaggacgatccgccggcatcagagcgcgcgccccggagccgaaaagcggggggcgtcatgaagcccccggccggcgccagcggcaagggcggcgcggtggacccctctctgccgcggttcaggtgccaggagtgccgccgcgccctcgtcgtcgtcggggtcgagtcctacgccgacagactgcccgcacacgccgcgcccggtaatcatgcatcttctgttcagggcagtgttatgggtgcaagcaagatggacaactcttatgttgtgctatctagacagaacaaatctcagggtcctagaattcctccacgcccaccaagtgcagcagcggcacatgctgatcccagccaatcaacaagagcgatagaggggtcatatatagtgcttccacctcctgccgcttccatatacaggacatctgcctctgaaggtggtgcacagctcacaccatcaggtgtaatctccagtagcccctcgctgggaaacaattctgggtttcactctagtgttactgtgctgaaaagggcctttgagattgctagctcgcaaactcaggttgaacagccactttgtctggaatgtatgagggttctttctgataagatggataaggagattgaagatgttaatgctgatattaaagcttatgaggcttgtcttcaacgtttggagcaggaaccttacaacatcctcagtgaaacagattttcaaaaggagaaacaaaagattgaggaagaggaaaagaaacttaaagctgctattgaagaagctgaaaaacaatattcagaagttagatctgagatggaaaatcttgaaataaagtctaaacaatttgaggaattggaagagcggtattggcatgaattcaacagttttcagtttcagttgacatctcaccaggaagaaagagatgcagtttttgccaagatagaagtttctcaggttcatttggaactgttgaagcgtactaatgttctcaatgatgcattctatatatcacatgatggagtaatcggaacaataaataactttcgcctaggacgtctttctaatgtagaggttgagtgggatgagataaatgctgcatggggtcaggctgcactgctgttgcataccatggctcagtatttcaccccaaaattccaataccggatcaagattcaccctatgggaagctatccaagagtcacagacatccagaataacacatatgaactgtttggtcccgtgaatttgttctggagcacccgatttgacaaagccatgacatggtttcttacttgcctgcaagagtttgctgagtttgccataagtttggataagcagaacaatgttccccctgaaaaatcactgaagcttccctacaagattgatggtgacaaagtagggagccacacgatcgtccttagtttcaataagaatgaaaactggaccaaggctctaaagtacatgctgtgcaatctgaagtgggttctctactggtttattggcaatacaagttttgcaccaccctctgtatcactgcacacacaatctctgaagaacaagagttgatgctgttctctctctgcaacaactgtacatagtttgtgtactcgaccctattcgttggatatagccgcagtgacaataatgacacgtttgatgtgcatttgtttattgcttgaaatctgccatgatgtgtttattgtacaatctaaatctcaggaactacattttcacccttaggtaacgcctccaacattacgttttgaaaaaacaatgcaaaaacagtgttttaggtgacatgagtgaaatgctg

SEQ ID NO: 906 - DNA, 2097 bp, Sorghum bicolor
aaaaaaaagaaattccctcgaataagaaaaactctcccccgtctcgcttctcgctgctgcgtgcctgcggggacactccatctctcctccacgatcccgccttccttccccacacctctcgccgagtcgccggcggaggacgatccgccggcagcagagcgagcgccgcgcgggcctcagatcgcccctttggttccttggagccgaaaagcgggggccggcatgaagcccccggccggcagcagcggcaagggcggcgcggtggacccttccctgccgcggttcaggtgccaggagtgccgccgcgccctcgtcgtcgtcggggtcgattcctacgccgacaggctgcccgcacatgccgcgcccggtaatcatgcatcttctgttcagggcagtgttatgggtgcaagcaagatggacaactcttacgttgtgttatccaggcagaacaaatctcagggtcctagaattcccccacgcccaccaagtgcagcagcggtgcatactgatcccatccaatcaacaagagcgatagaggggtcatatatagtgcttccacctcctgccgcttccatatacaagacacctgcctctgaaggaggtggtgcgcagctcacagcaccaggtgtaaactccagtagcccctctcagggaaacaattctgggtttcactctagtgttactgtgctgaaaagggcttttgagattgctagctcgcagactcaggttgaacagccactttgtctggaatgtatgagggttctttctgataagatggataaggagattgaagatgttaatgctgatattaaatcttatgaggcttgtcttcaacgtttggagcaggagccctacaacatcctcagtgaaacagatttccaaaaggagaaacaaaagattgaagaagaggaaaataaacttaaagctgctattgaagaagctgaaaaacaatattcagaagttagttctgagatgaaagatcttgaaataaagtctaaacaatttgaggaattggaagagcggtactggcatgaattcaacagttttcagtttcagttggcatctcaccaggaagaaagagacgcagtttttgccaagatagaagtttcccaggttcatctggaactgttgaagcgtactaatgttcttaatgatgcattctatatttcacatgatggagtaattggaacaataaataatttccgcctcggccgcctttctaatgtagaggttgagtgggatgagataaatgctgcttggggtcaggctgcactgctgttgcataccatggctcagtatttcaccccaaaattccaataccggatcaagattcaccctatgggaagctatccaagagtcacagacatccacaataatacatatgaactgtttggtcccgtgaatttgttctggagcacccgatttgacaaagccatgacatggtttctgacttgcctgcaagagttcgctgagtttgccataagtttggataaggagaacaatgttccacctgaaaaatcactgaagcttccctacaagattgatggtgacaaagtagggagccacacgatcgtcctaagtttcaataagaatgaaaactggaccaaggcgctaaagtacatgttgtgcaatctgaagtgggttctctactggtttattggcaatacaagttttgcaccacactcgggatcgctgcacacacaatctctgaagaacaagagttgatgctgttttttttctcgttgactgtacatagtttatatactccctagccgctggatgtagccctagtgacaataacgacacatttgatgtacatgtgtttattgctcgaagtctaccgtgttgtcttgaggccctcgtgcatgtgtttattgtactaagcccagcaactccattttcgcccttaggtcagagttggtggaaggccctcgtgcttgtccacacagcttagcaggatggaaggctgagctgatgggatcagaacttcagaagagtagccggcccatacaattgggccagtgcactatgcacagatgacagatcaactggaatccatgtcacatgaggtgcttcttcctttgttggtctgtgctg

SEQ ID NO: 907 - DNA, 2476 bp, Oryza sativa
acaaccacaggcctgagcccacccacacaaactttacagtttacacgctacgcaaacgtacgcccacacgcacgctacctctctctctctcgactcccgagcaggcgactcctccctccccggcgattccgccgctccgaccgccgtctctccgcgccgcgcacgtgagccccccgtcgccttcctcgcacggactctgcccccgccggaatctcatctcctacgcctcaaacccccaccccgcgacgccgcctagccgcgattttcctgcggggtactccaccgcccctggaggctggagccgtgctctccggatcggcgttggattggtagcgctcgcgtcctgctctgtcgggcggcgatatgaagccccctgcatcctccgccgccgctgccggcgacaagggcggcggggtcgacccgtctctgccgcggttcaagtgccaggagtgccaacgcgcgctcgtcgtcgtcggcgtcgagtccttcaccgataagctccccgctcatgccgtctccggtatgaacgtgtcctctgttcagggcagcgttatgggtgctagcaggatggacaactcttatgtcgtgctatcgaagcaaaatagatcacatagccatggaattcccccacgcccgccaagcgcagggatcccgcgtgccgagccgaaccaaccaacaagagcaatggagggatcatatatagtgcttccacctgctgccgcttccatatacaagacatctgcctctgaaggaggtggtgcgcagttgtcaccaacaagtatgaaccccggtagccctttaccaggaaataattttcactctagcgtgactgtattaaaacgggcatttgagattgctacatcacaaacacagattgaacagccactctgtctggactgtatgaggttgctgtctgataaaatggagaaggaaattgaagatgttaatactgacaataaagcttatgaggcctgtcttcaacgtctggagcaggaaacctataacatcctcagtgaaactgactttcagaaggagagacaaaagattgaggaagaagaaaagaaacttaaagctgcaattgaggaagctgaaaagcaatattcagaaatttgttccgagatgaagtgccttgaaacaaaatctaaacagttcgaagaactggaagaaaggtattgccatgatctcaatagctttcagtttcagtggatatctcaccaggaagaaagagatgcggttttggccaagatagaagtttcgcaggttcatctagaattgttaaagcgtacaaatgttctcaatgatgcattctatatttcacatgatggggtgatcggaacaataaacaactttcgtcttggccgccttcctaatgtacaggtggagtgggatgagataaatgctgcttggggccaggctgctcttctgttgcataccatggctcagtacttcttcccaaaatttgaataccggatcaaaattcaccctatgggaagctatccaaaagttacagacatcaaccaaaatacatatgaactgttcggtcctgtgaatttattctggagtacccgatttgacaaagccatgacatggtttctgacttgcttgcaagaatttgctgattttgctgttagtttggataaagagaacaatgtaccacctgacaagtcattgaagctcccatataagattgaaggtgacaaagtagggagctatacaatcttcttaagtttcaataaacttgacaattggacaaaagcactaaaatacatgctgtgcaacttgaagtgggttctctactggtttatcggcaatacaagttttgccccaccctctggatctttacacgtagcacagtcttccaagggatgaagtcactggcttgtgatgctgattataagcgcatattggcaaatggcattgactaggctcgtttgtaatttacagtagtacatacagctagttttttttttccttttggccgccttcagttgtacttcctccgtttcacaatgtaagtcatcatagcatttcccatatttataatgatgttaatgaatctatatagatatatatgtctagatttattaacgtcaatatgaatataggaaatgctagaatgacttacattgtgaaacggggggagtatatatggttgaaatctgcacaggagaaattgcagatgatggtgcaactcagcttatagtcggcttgatcattattcatgtaattatttagccatgtgtgacagaaaatgcgagtgatacgagatcctagagcaattcatgcagctctggttaggtgagtttgtgatggtgcaatcaacagcatatccaatcaacattaagatttataagagatgaaatgtcttcagcaacacatacttgagatgaaactaaagttatcttgcgaaactcagggagatgctctatttctgaataatcaacaaatagtagatgaattaacaacccaaatctta

SEQ ID NO: 908 - DNA, 1784 bp, Panicum virgatum
gcgatccccactcctctctccggccgagaacgagccgcaggccagcagcagggctcgggccacagctcgtccattcgattcgttggagatcgctcaagcgggagcggcgtcctcagcgaggaggcaggctacatgaagcccccggccgccgccaccggcggcaagggaggcgctgtcgacccgtcgctgccgcggttcaggtgccaggagtgccgccgcgccctcgtcgtcgtcggggtcgactcgtactccgacaggattcccccccacgccgcggccggtaatcatgcaccttctgttcagggcagtgttatgggtgcaagcaggatggacaactcttatgtcgtgctatccaggcagaacagatctcaaggtcctggaattcctccgcgcccaccaattgcagcagcaccacacactgaacctaaccaatcaacaagagcgatagaggggtcatatatagtgcttccaccgcctgctgcttccatatacaagacacctgcctctgaaaaaggtggtgcccagctgacaccaccgggtgtaaactccagtagcccttcaccaggaaacaattctggatttcactctagtgttactgtgctgaaaagagcttttgagattgctagctcacaaactcaggttgagcagccactttgtctggaatgtatgagggttctttctgataagatggataaggagattgaagatgttaatgctgatattaaagcttatgaggcttgtcttcaacgtttggagcaggaaccctacagtatactcagtgaaacagactttcagaaggagaaacaaaagatcgaggaagaagaaaagaaacttaaagctgctattgaagaagctgaaaagctatattcagaagttagttccgagatgaaagatcttgaaataaagtctaaacaatttgaggaattggaagaacggtattggcatgaattcaacagctttcagtttcagttgacatctcaccaggaagaaagagatgcaatttttgccaggatagaagtttctcaggttcatctggaactgttgaagcgtactaatgttctcaatgatgcattttatatttcacatgatggtgtaattggaacaataaacaatttccgcctcggacgtctttctaatgtagaggttgagtgggatgagataaatgctgcttggggtcaggctgcactgttgctgcatactatggctcaatatttcactccgaaatttcaataccggatcaagattcaccctatgggaagctatccaagagtcaccgacatccacaacaatacatatgaactgtttggccctgtaaatttattctggagcacccgatttgacaaagccatgacatggtttctcacttgcctgcaagagtttgctgagtttgccataaatttggataaggagaacaatattccacctgagaagtcattgaagtttccctataagatcgatggtgacaaagtagggagccatacaatcgtcttaagtttcaataagaacgagaactggaccaaggcgctgaagtacatgctgtgcaatctgaaatgggttctctactggttcattggcaacacaagttttgcgccaccatcggggccagtgcacatacaatctctgaggaacaagaactaaagctgtttttacctcaactgtacatagtttaaatgcaacagagttactgaccctagtcaatggattgtagtgacaataacgacacatttgatgtacatacatgtagcaacataccgtctatactatacttgaaggcttccgttctg

SEQ ID NO: 909 - DNA, 1961 bp, Panicum virgatum
gcggggacactccatctcctccgcgatccccacccctctctccggcggagaacgagccgcaggcagcagcagggcgcgggccacagctcgtccgttcgattcgttggagatcgctcaagcgggagcggcgtcctcagcgaggaggcaggcgccatgaagcccccggccgccgccagcggcggcaagggaggcacggtcgacccgtcgctgccgcggttcaggtgccaggagtgccgccgcgccctcgtcgtcgtcggggtcgactcgtacgccgacaggctgccgccccacgccgcggccggtaaccatgcaccttctgttcagggcagtgtcatgggtgcaagcaggatggacaattcttatgtagtgctatccaggcagaacagatctcaaggtcctggaattcccccgctcccaccaactgccgcagcaccacacactgaacctaaccaatcaacaagagtgatagaggggtcctatatagtgcttccacctcctgctgcttccatatacaagacacctgcctctgaaggaggcggtgcacagctgacaacaccgggtgtaaactccagtaaccattcaccaggaaacaactctggatttcactctagtgttactgtgctgaaaagagcttttgagattgctagctcacaaactcaggttgagcagccactttgtctggaatgtatgaggattctttctgataagatggataaggagattgaagatgttaatgcggatattaaagcttacgaggcttgtcttcaacgtttggagcaggaaccctacgacatactcagtgaaacagactttcagaaggagaaacaaaagatcgaggaagaagaaaagaaacttaaagctgctattgaagaagctgaaaagctatattcagaagttagttccgagatgaaagatcttgaaataaagtctaaacaatttgaggaattggaagaacggtattggcatgaattcaacagctttcagtttcagttgacatctcaccaggaagaaagagacgcagtttttgctaagatagaagtttctcaggttcatctggaactgttgaagcgtactaatgttctcaatgatgcatttcatatttcacatgatggtgtaattggaacaataaacaacttccgcctcggacgtctttcaaatggagaggttgagtgggatgagataaatgctgcttggggtcaggctgcactgttgctgcataccatggctcaatatttcactccgaaatttcaataccggatcaagattcaccctatgggaagctatccaagagtcaccgacatccacaacaatacatatgaactgtttggccctgtaaatttgttctggagcacccgatttgacaaagccatgacatggtttctcacttgcctgcaagagtttgctgagtttgccataaatttggataaagagaacaatgttccaccagagaagtcattgaagcttccctataagattgatggtgacaaagtagggagccatacaatcgtcctaagtttcaataaggacgagaactggaccaaggcgctgaagtacatgctgtgcaatctgaaatgggttctctactggttcattggcaacacaagttttgctccaccatcgggaccagtgcacacacaatctctgaggaacaagaactaatgctgtttttacttcaactgtgcatagtttaaatacaaaccgatttactgacactagtcattggactctagccgtagtgacaataacgacatatttgatgtacatacatgtatcaatattaccgtctattacttgaagtctgccgttgtgtatgaaccctatcgtctgtgaattccaagggcctggccatctgcatgcaaattgtaacaataaaaagatttttcagtcttcagttgatgcaacttgtcacgggggaaggatgcaacataacaaagcaaacgcaacatcttcctttgatggac

SEQ ID NO: 910 - DNA, 2378 bp, Oryza sativa
tagtattatgttattatccctgacaggtgggctccacgtgtcagcgactgtttgctcgttgctgtttgctcccgcgacgacgaatccgtgccgacctcgcttccccgccggccgccatgaaattggagcttccgagaggagaaaatctcgagaagtagagagagaaaaccacagcgtgagcgagcgtgggcgtccttgattccggcgacatgaaggcccccgccgcggccgcggccgcggtcggcaacagggctggtggggtggatccgtcgattccgcggttcaagtgccaggagtgccaccgcgcgctcgtcgtcgtcggcgtggattccttcgccgataagctcccggctcaggccacctctgcgcatgcatcctctgttcatggaagtattatgggagctagcaggatggataattcttatgtcgtgctatccaagcaaaacaaatctcatggccatggaattcccccacgcccaccaagtgcagcagccccacatatcgaacctaaccagccaacaagagcgatggagggttcatatatagtgcttccacctgctgctgcttccatatacaagacatctacttctgaaggaggtggtgcgcagttgccaccaccaagtatcaattccagtagtttgttaccaggaaatagttttcactctaacgtgactgtattaaaacgggcatttgagattgctacgtcacaaactcaggttgagcagccaatgtgtctggactgtatgaggttgctctctgataagatggataaggagattgaagatgttaatgctgacattaaagcttatgaagtctgtcttcaacatttggagcaggaatcccacactgtcctcagcgatgctggttttcagaaggagaaactgaagattgaagaagaagaaaagaagcttaacgccgctattgaagaagctgaaaagcaatattcagaaattagttctgagatgaaggatcttgaaataaaatctaaagaatttgaagaattggaagaaaggtattggcatgaattcaatagctttcagtttcagttgacatctcaccaggaagaaagagatgcaattttggccaaaatagaagtttcacaggttcatttggaattgctgaagcaaacaaatgttctcaatgatgcattctatatttcacatgatggagtaattggaacaataaacaacttccgactcggacgccttcctaatgtacaggttgaatgggatgagataaatgctgcttggggtcaggctgctcttcttttgcataccatggctcagtacttcaccccaaaatttgagtaccggattaagattcaccctatgggtagctacccaagagtcacagatatccacaaaaatacatatgaactgtttggtcccgtgaatttattctggagcacacgttttgacaaagccatgacatggtttctaacctgcctgcaagattttgctgagttcgctattagcttggataaagagaacaatgtaccacctgagaagtcattaaagctcccatacaagattgatggtgacaaggtagggagccacacaatcttcttaagttttaataaagtggagaactggacgaaagcactaaaatacacgctgtgcaacttgaagtgggtcctctactggtttatcggcaatacgagtttcgcaccaccatctggatctttgtgtgcagcgcaatcatctaagagatgatgatgtcactgacctattaaggtggtgtttggatccagggacttaactttagtccctatatttagacactaatttagagtattagatatagactacttacaaaactaattacataaatgaaagctaattcgcgagacaaatttttaagcctaattaatccataattagagaatgtttactgtagcatcacataggctaattatggattaattagactcaatagattcgtctcgcgaattagtctaagattatgaatgggttttattaatagtctacgtttaatatttgtaattagtgtccaaacatccaatgtgataaggacttgaaagttttagtcccatctaaacatggtctaaactgattgtagccgcacattgaacagatagtagcattgacgtgacatattcaaagatgaatagtttatacaactaactcttcgcttcttttaagtggtcactgtatacttgtcccttgtatgtatagtctcctttggcatctaatcaggtctgcagtcaaattggaatgtcgataaaatactgtagtgccgtggtcttctcttttccgaaaaaaagatggacaagtgtttgtactgacttcctcaatgccctccctttcacaaacttctttgcttcccgtatttgatatgatttctttacatgttttaat

SEQ ID NO: 911 - DNA, 1621 bp, Saccharum officinarum
aaaactccgactcgcttctcgctgctgcgtgcctgcggggacactccatctctcctccacgatcccgcctcccacacctctcgccgagtcgccggccgaggacgatccgccggcagcagagccagcgccgcgcgggcctcagatcgcctgtttggttgcttggagccgaaaagcggggggcggcatgaagcccccggccggcggcagcggcaagggcggcgcggtggacccctctctgccgcggttcaggtgccaggagtgccgccgcgccctcgtcgtcgtcggggtcgaatcctacgccgacaggctgcccgcacatgccgcgcccggtaatcatgcatcttctgttcagggcagtgttatgggtgcaagcaagatggacaattcttatgttgtgctatccaggcagaacaaatctcagggtcctagaattcccccacgcccaccaagtgcagcagcggcgcatactgatcccagccaatcaacaagagcaatagaggggtcatatatagtgcttccacctcctgccgcttccatatacaagacacctgcctctgaaggaggtggtgcgcagctcacagcaccaagtggaaactccaataacccctcgcagggaaacaattctgggtttcactctagtgttactgtgctgaaaagggcttttgagattgctagctcgcaaactcaggttgaacaaccactttgtctggaatgtatgagggttctttctgataagatggataaggagattgaagatgttaatgctgatattaaagcttatgaggcttgtcttcaacgtttggagcaggaaccctacaacatacttagtgaagcagattttcaaaaggagaaacaaaagattgaggaagaggaaaagaaacttaaagctgctattgaagaagctgaaaagcaatattcagaagttagttctgagatgaaagatcttgaaataaagtctaaacaatttgaggaattggaagagcggtactggcatgaattgaacagttttcagtttcagttgacatctcaccaggaagaaagagatgcagtttttgccaagatagaagtttcccaggttcatttggaactgttgaagcgtactaatgttctcaatgatgcattctatatttcacatgatggagtaattggaacaataaataacttccgcctcggacgcctttccaatgtagaggttgagtgggacgagataaatgctgcttggggtcaggctgcactgctgttgcataccatggctcagtatttcaccccaaaattccaataccggatcaagattcaccctatgggaagctatccaagagtcacagacatccacaataatacatatgaactgtttggtcccgtgaatttgttctggagtacccgatttgacaaagccatgacatggtttctgacttgcctgcaagagtttgctgagtttgccataaggttggataaggagaacaatgttccacctgaaaaagcactgaagcttccttacaagattgatggtgacaaagtagggagccacacgatcgttctaagtttcaataagaatgaaaacttgaccaaggcgctaaagtacatgttgtgcaatctgaagtgggttctctactggtttatt

SEQ ID NO: 912 - DNA, 2467 bp, Zea mays
gctaccaagcgccatacaccgaccgccgcgctccagtttagtgcgtcgcaagccttagccggccggatcgggatcccctgcagtactgcatgggctactgccgcgtgggctccgcgtgcgacagggcccacgcgcagtgacccaactgcacggtgcagtacgtcagaggatccgtgtcccggccggccgggacggcgtgcgcaatgcgcgcggcagctactagtaaatactctccctgcgccgcttttcgctgctgcagtgctggcgactggcgtgctgcgtgcctgcggggatactccgtctcctccacctccagtcctcctccacgatcccgcctcccccacctctcgccggccgacgacgacgacgatccgccggcagcagcccgcgcgccgcagatctcccgttcggttccttggagccgacaagacgagggcagcatgaagcccacggccggcgccagcggcaagggcggcgccgtgtatccttctctgccgcggctcaagtgccaggagtgccgccgtgccctcgtcgtcgtcggggtcgagtcctacgccgacaggctacccgcacacgccgcgcccggtaatcatgcatcttctgttcaggacagtgttatgggtgcaagcaagatggacaattcttatgttgtgctatcgaggcagaacaaagttcagggtcctagaattcccccacgcccaggaagtgcggtggcggcacatactgatcccaaccaatcaacaagagcgatagaggggtcatatatagtgctaccacctccttccgcttccatatacaagaaatctgcctctgaaggaggtggtgcgcagctcacaccaccaggtggaaactccagtagtcccttgtcgggaaacaattctgggtttcactctagtgtaactgtgctgaaaagggcttttgaggttgctagctcacaaactcaggttgaacaaccactttgtctggaatgtatgagggttctttctgataagatggacaaggagattgaagattgtaatgctgatattaaatcttatgaggcttgtcttcaacgtttgcagcaggaaccctacaacatcctcagtgaaacagattttcaaaaggagaaacaaaagattgaggaagaggaaaagaaacttaaatgtgctattgaagaagctgaaaagcaatattctgaagttagttctgagatgaaagatcttgaaataaagtctaaacaatttgaggaattggaagagcggtactggcatgaattcaacagttttcagtttcagttgacatctcatcaggaagaaagagacgcagtttttgccaagataggagtttctcaggttcatttggaaatgttgaagcatactaatgttctcaatgatgcattctatatttcatgtgatgaagtaattgcaagaataaataactttcgcctcggacgccttcctaatgtagaggttgagtgggatgagataaatgttgcgtggggtcaggctgcacttctgttgcataccatggcccattatttcactccaaaattccgataccggatcaagattcaccctatgggaagctatccaagagtcacagacatccacaatcatacatatgaactgtttggtcccgtgaatttgttctggagcacccgatttgacaaagccatgacatggtttctgacttgcctgcaagagttcgctgagtttgccataagtctggataaggagaacaatgttccacctgaaaaaacactgaagcttccccacaagatcgatggtgacaaagtagggaaccacacgatcgtcctaagtttcaatcaggatgaaacctggaccaaggcgctcaagtacatgctgtacgatctgaagtttgttctctcctggtttattggcaatacaagttttgcgccaccttcgagatcactgcacacccaatttctgaagaacaagagttgatgttgttctctctctctctctctctctctctctctctctctctctctctctctctctctctctctctctctctctctctaagggcatgtttgggagcaagaaggggattttagccccttctccaatcctttggcttagtaaccaggttcccggatcgatgggatcgaggaacgggaacgtggtacgcggtacgctacaaaaagtaggatttaacactaccggaacgagattgttcccacgttcccggaacgaggaacgtggccaagttcccagttcccggttgttcccggaacgaggaacgtggccaagttcccagttcccggttactaagtcctttggtcccaaacatgtcgtgactgtacatagtttatatacttgaccctagctagccgttggatgtaaccgtagtgacaatgacgacatgtttgatgtacatatgtttactgtactatctaaagctcagcgactccattttcgctgcgctctttaaaaacctctgctgcgctcttattcttggcagccac

SEQ ID NO: 913 - DNA, 858 bp, Secale cereale
ccccctctcccaaacccaccaatttccatagccgccgccaagccgaagcgccggacccttcagccccgccgaactcgccgactgctctcaccaaggccgagatggatacttcagctccttcgccatttgtcaatggagagactttgaagacgtttcttgggcgacgagtgcgcacagtggttcaagtccaacacaatgaaggtggagttcttcttgggctgtccactgatgggcagcagttgactatcagaggcgcccctggtgcccccgaaccaccacactacattgaggttatagggatcgctgacagcagcttgtccatccgtgctgaatcttgcactgattttggtgaaaactttgatggtgtggcattcaatgggctatgcaagcttgcgaacgacaagtacaagtacctgttcctgtagaattcagcatcacacagaagacgtttgggaaatcaagcatgctcctaatcaaacgatgtgtttgccgctttaaatgttacttcactcgcatcagtaatctgttacttagggtcaactttacgcacttatcaggacatgttaacctaatctatgtagctgtgtgagggcaagtgtgtgtgcgccccttgcagttggagagcttattgcttttgctgcttctaagcaaagtgaaacaaagctttatgttgctatcacatggatttggaccctggaaggtttacacttgcgtgtgacgatcctgtatgcgtcttgatgatttctgataaatcattcaaagtagtccagactacttgcaagctgaatgctttgatgtcccttgatcaaacaggtcctattaaacatgtcgatcatttgtaaactctactgaatgtct

SEQ ID NO: 914 - DNA, 931 bp, Triticum aestivum
ctcatctcgagcccgcccagccccctcgctctctctcccaaacctcccagtttccatagccgccgccaagccgaagcgccggacccttcagcgccgccgaacccgccgactgctctcaccaaggcggagatggatacttcagctccttcgccatttgtcaatggagagactctgaagatgtttcttgggcgacgagtgcgcacagtggttcaagtccaacacaatgaaggtggagttcttctcgggctgtccactgatgggcatcagttgactatcagaggtgcttctggtgcccctgaaccaccacactacatcgaggttattgggatcgctgacagcagcctgtccatccgtgctgaatcttgcactgattttggtgaaaactttgatggtgtggcattcaacgggctatgcaagcttgcgaatgacaagtacaattacctgttcctgtagaattcagcatcacacagaagatgtttggaaaatcaagcatgctcgtcatcgatgatgtgtttgccgctttaagatctgttcaaatgttacttcactcgcatcagtaatctgttacttagggtcaactttgcgcacttatcaggacatgttgacctaatctatgtagtagctgtatgagggcaagtgtgtgtgcgccccttgcagttggagagcctatagcttttgctgcttctaagcaaagtaaaccaaagctttatgttactatcacatggatttgggccctggaaggtttatgttactatcttgcagatggtgtgtgatgatcccgtatgcaccttgatgatttctgatgaatccttcatagaatcatagtccagactacttccaagctgaatgctttgctggaaaatatatccgttgatcaaacaggtcctgttgaacatgatttgtgaactctatactgaatgtctgaagccac

SEQ ID NO: 915 - DNA, 903 bp, Triticum aestivum
ccctcgctccctctcccaaaccccccagtttccatagccgccgccaagccgaagcgccggacccttcagcgccgccgaattgccgactgctctcaccaaggcggagatggatacttcagctccttcaccatttgtcaatggagagactctgaagatgtttcctgggcgacgagtgcgcacagtggttcaagtccaacacaatgaaggtggagttcttctcgggctgtccactgatggacatcagttgactatcagaggtgccactggtgcccctgaaccaccacactacattgaggttattgggatcgctgacagcagcctgtccatccgtgctgaatcttgcactgattttggtgaaaactttgatggtgtggcattcaacgggctatgcaagcttgcgaatgacaagtacaagtacctgttcctgtagaattcagcatcacacagaaggcgtttggaaaatcaagcatgctcgtcattgatgatgtgtttgccgctttaagatctgttcaaatgttactttactagcatcagtaatcagttacttagggtcaactttgcgcacttatcaggacatgttaacctaatctatgttgtagctgtatgagggtaattgtgtgtacgccccttgcagttggagagcctatagcttttgctgcttctaagcaaagtaaaccaaagctttatgttactatcacatggatttggaccctggaaaggttcacttgcgtctgatgatcctgtatgcaccttgatgatttctgatgaatccttcatagcccagactacttgcaagctgaatgctttggtggaaactatatctgttgatcaaacgggtcctgttgaaaatgatttgtgaactctatattgaaatggtaccgaagccactgatttgcgctaact

SEQ ID NO: 916 - DNA, 860 bp, Triticum aestivum
gctctctctcccaaacctcccagtttccatagccgccgccaagccgaagcgccggacccttcagcgccgccgaacccgccgactgctctcaccaaggcggagatggatacttcagctccttcgccatttgtcaatggagagactctgaagacgtttcctgggcgacgagtgcgcacagtggttcaagtccaacacaatgaaggtggagttcttctcgggctgtccactgatgggcatcagttgactatcagaggtgcttctggtgcccctgaaccaccacactacatcgaggttattgggatcgctgacagcagcctgtccatccgtgctgaatcttgcactgattttggtgaaaactttgatggtgtggcattcaacgggctatgcaagcttgcgaatgacaagtacaagtacctgttcctgtagaattcagcatcacacagaagacgtttggaaaatcaagcatgctcgtcatcgatgatgtgtttgccgctttaagatctgttcaaatgttacttcactcgcatcagtaatctgttacttagggtcaactttgcgcacttatcaggacatgttaacctaatctatgttgtagctgtatgagggtaattgtgtgtacgccccttgcagttggagagcctatagcttttgctgcttctaagcaaagtaaaccaaagctttatgttactatcacatggatttggaccctggaaaggttcacttgcgtctgatgatcctgtatgcaccttgatgatttctgatgaatccttcatagcccagactacttgcaagctgaatgctttggtggaaactatatctgttgatcaaacaggtactgttgaaaatgatttgtgaactcc

SEQ ID NO: 917 - DNA, 590 bp, Festuca arundinacea
  misc_feature (12)..(13): n is a, c, g, or t
  misc_feature (15)..(15): n is a, c, g, or t
  misc_feature (17)..(17): n is a, c, g, or t
  misc_feature (20)..(20): n is a, c, g, or t
  misc_feature (24)..(24): n is a, c, g, or t
  misc_feature (39)..(39): n is a, c, g, or t
  misc_feature (45)..(45): n is a, c, g, or t
  misc_feature (60)..(60): n is a, c, g, or t
  misc_feature (275)..(275): n is a, c, g, or t
  misc_feature (293)..(293): n is a, c, g, or t
  misc_feature (404)..(404): n is a, c, g, or t
  misc_feature (481)..(481): n is a, c, g, or t
  misc_feature (503)..(503): n is a, c, g, or t
  misc_feature (509)..(509): n is a, c, g, or t
ggacgaggcaanncncnagnctcngaagccgccaccganccgaancgccggaaccctcancgccgccgaagtcgccgtgttctcccagcgaagcggagatggatacttcagttccttcaccatttgtcaatggagagactctgaagatgtttgttgggcgaagagtgcgcacagtggttcaagtccaacgcaatgaaagtggagttcttgtcgtccagtccactgatgggcatcagttgaccatcagaggtgctcctggtgcccctgaagcaccncactatatagaggttatnggaatccctgacagcaaccagtccatccgcgctgaaagttggacagattttggtgaaaactttgatcctgtgccattcaatggactgtgcaagcttgcgagcgacaagtanaagtacctgttcctgtagaagttcagcatcgcatagaagacgtttggcaatcaagcatgcttggaattgatgcttcntttatcgctttaagatctgttnaaacgntacttcagtcacctcagtaatttgggtcaactttatgcacttattagacatattaacctaatctaatctatgtatccctat

SEQ ID NO: 918 - DNA, 706 bp, Avena sativa
ctcgccactgccttccacccttcctctaaaccccaaattccgaagccgccgccgagccgaagcgccggaaccctcagcgccgccgaagtcgccgtgttctctcaccgaagctgagatggatacctcagttccttcaccatttgtcaatggagagactctgaagatgtttgttgggcgaagagtgcgcacagtggttcaagtccagcgcaatgaaagtggagttcttgctgtgcagtccactgatgggcatcaattgaccatcagaggtgctcctgatgcccctgaagcaccacactatatagaggttatggggatccctgacagcaaccagtccatccgagcagaaagctggacagattttggtgaaaactttgatgttgtgccattcaatgggctgtgcaagcttgcgaacgacaagtacaagtacctgttcctgtagaagttcagcatcacaaagaagacgtttggcaaatcaagcatgctcggaatcgatgttgcatttatctcttaaagatctgttcaaacattacttttcagccaccccagtaatctgttacttaaggtcaactctgtgcacgtattagacatattaacgtaacctaatctatgtatctgtatgaaggcaaatatgtgtgccccgtggcagttgaagagcttgttttctttgctgtttctaagcaagtaaactgaagctttatcgtaccga

SEQ ID NO: 919 - DNA, 1513 bp, Brachypodium distachyon
cgtcggcgatgggctggaagagttggcgccatcctcctctgcagcaccaacaacccacgccagcgcgcacgacgccatgctctcactcgctcgccgcccgctctccgccgccgtccccgtcggcaacctcctcggaatccacctcttccagtgccccgacgcggtgggcatcgtggcaaagctgtccgagtgcatcgccacccgcggcggcaacatccacagcgtcgacgtcttcgtccccgacgacaagcccgtcttctacgcccgcagtgagtttacgtacaacccaaggctctggccgcgcgatgagcttggcgccgacttcctccatttgtcaaaccacttcaaggcacaaaaatctaccgtacgagtgcctgatcttgacccaaaatacaagatttcagtccttgcatcaaagcaggaccactgtttgttcgacttgttgcatagatggcaagaaggcaggcttccagttgacattaattgtgtgataagcaaccatgatcgacctacagataatcacgtaaggcgttttcttcagagacatggaattccctatcattacttaccaacaactcctgggaacaaacgagaacaagagatactagaattgattgaaggtacagattttgttgtgctggcaagatatatgcaggtaatgtctgaaagctttcttaaagcatatggtaaagatataattaacattcatcatggacttcttccctcattcaaaggagggagtccttcaagacaggccttcaatgcaggggtgaaattgattggtgcaactagccattttgttactccagaacttgatgctgggccaatcattgagcagatggttgaacgagtttctcacagagacacattacagagctttgttgtaaagtctgagaatcttgagaaacagtgcctagcagaagctatcaagtcatactgcgagctccgtgtgctaccatatgagctcatgaagactgttgtattttaatttttttgtaatgggttatttgatgtctattatttttccaaaattagcaataagttattcatttattaatatatccacattcagccattaggtcagtgcggtcaaagttatgagaataaatagtatgtagtactacatactatttgtgcaaccattcctttagataaaaaactacctggccaaaaaataatttgatgtttattgcatacattgatactgcaaagcacatgccttgcttggattcatgtaaaacaccctctgtcctgcaaaatttgaattcatgtactaaccgcgccagttgagttttagtgtttctagcctgtgtcctacttgatcggctacatcaacctgctggagcaggttttgcacaccatgaacccaattctgcttgttggtgctgctctgacacttaaactcaacaaggccttgtgctgtactcaagccaaagcagcatgtctctggtgaactttgccctggctctgtccattctggcagatcactgtataccccatatacaacacctat

SEQ ID NO: 920 - DNA, 1004 bp, Secale cereale
atccacctcttccagtgccccgacgcggtgggcatcgtggccaagctctccgagtgcatcgcctcccgcggcggcaacatccacagcgtcgacgtcttcgtccccgacgacgcccccgtcttctacgcccgcagtgagttcacctacaatccaaggctatggccgcgcgacgtgcttcgcaccgatttcctccatctgtcggactgcttcaatgcgcaaaaatccactgtgcgcgtgcctgacattgaccccaagtacaagattgcagtcctcgcttcgaagcaggaccattgcttgttcgacttgctgcatagatggcaagaaggcaggcttccagtggacattcattgtgtgataagcaaccatgatcgacctgtagataatcatgtgatgcgttttcttcagaggcacgaaatcccctatcattacttaccaacgacttctgggaataaaagagaacaagagatattggagttgattgaaggtacagattttgttgtgctggcaagatacatgcaggtaatgtctgaaagctttcttaaagcatatgggaaagatattattaatattcaccatggcctccttccctcgttcaaaggaggaagtccgtctagacaggccttcaatgctggggtgaagttgattggtgcaactagccattttgttactccagaacttgatgccgggccaatcattgagcaaatggttgagcgagtttctcacagagacacgttacatagctttgttgtgaagtcggagaaccttgagaaacaatgcctagcagaagctatcaagtcatactgcgagctccgtgtgctgccatatgaagtgatgaagactgttgtgttttgaattttttttggattgttacgatgtgtattatttttccaaaattagcaatacattattcttttgttaatatatttcacgctgagccattaggtgtacctgaacccgggttgaagttacgacaataatcaagcaatattccagaaaaaaaagtc

SEQ ID NO: 921 - DNA, 856 bp, Triticum aestivum
cggcatccacctcttccagtgccccgacgcggtgggcatcgtggccaagctgtccgagtgcatcgcctcccgcggcggcaacatccacagcgtcgacgtcttcgttcccgacgacgcccccgtcttctacgcccgcagtgagttcacctacaacccgaggctctggccgcgcgacgtgcttcgcaccgacttcctccgtctgtcagactgcttcggtgcacaaaagtctactgtgcgagtacctgacattgaccccaagtacaagattgcagtcctcgcgtccaagcaggaccattgtttgtttgacttgctgcatagatggcaagaaggcagactcccagttgacattcattgtgtgataagcaaccatgatcgacctgtagataatcatgtgatgcgttttcttcagaggcacgaaatcccctatcattacttacctacgacttctgggaataaaagggaacaggagatactagaattgattgaaggtacagattttgttgtgctggcaagatatatgcaggtaatgtctgaaggctttcttaaagcatatgggaaagatattattaatattcaccatggcctccttccctcgttcaaaggaggaagtccttctagacaggccttcaatgctggggtgaagttgattggtgcaactagccattttgttactccagaacttgatgctgggccaattattgagcagatggttgaacgggtttctcacagagacacgttacatagctttgttgtgaagtctgagaaccttgagaagcagtgcctggcagaagctatcaagtcatactgcgagctccgtgtgctaccatatgaagtgatgaagactgttgtgttttga

SEQ ID NO: 922 - DNA, 1118 bp, Setaria italica
cacggccgaatccaccaaccgcatcatctcatctgaatatctgattctgccatgccatgccatgcctcgtccttttggagacagacagatgatgtcctcggcgcgccggccgctctccgccgccgccggcaacctcctcggcatccatctcttccagtgccccgacgccgtcggcatcgtcgccaaggtgtccgagtgcatcgcctcccgcggcggcaacatccacagagtcgacgtcttcgtccccgacgacaagcccgtcttctactcccgcagtgagttcacctacaacccgaggctctggccgcgtgatgacctgcgcaaggatttcctcaatttgtcatgctgcttcggcgcacaaaggtccaccgtacgagtacctgaccttgaccccaaatacaagatcgcagtcctcgcttcaaagcaggaccattgcttgtttgatttgttgcacagatggcaagaaggcaggcttccagttgacattaactgtgtcataagcaaccatgatagaccgcaagacaatcatgtgcggcgctttcttcagaggcatgcaattccatactactacttacccaccacgcctgggaacaaaagggagcaagagatactagaattgattcagggcacagattttgttgtgctggcaagatatatgcagattatgtcggaaagctttttaaaagcatatggtaaagatattattaatattcatcatgggcttcttccctcatttaagggaggccatccttccagacaggccttcaatgctggggtgaagttgattggggcaaccagccattttgtcactcccgaacttgatgctgggccaatcattgaacagatggttgagagagtttctcacagagacacactgcagagttttgttgtgaagtctgagaatcttgagaagcagtgcctagcagaggctattaagtcatactgcgagcttcgtgtcctaccatatgaactgaagaaaactgttgtattctaatttttcttatggattggcattgtattaattttcccaaagcaagcaataaacgattcattttttctatttatatttccacagtcacttcctagctttttttttttttgtgattgtgcatgtctta

SEQ ID NO: 923 - DNA, 2184 bp, Panicum virgatum
catgtttttcaattcctgcgactaggtgctgttgcatgtttgccgttcgttgtgtttgcccatgaaatgatcatagtagcctgccttaggcctcagctgtcttcagtttccacatgagcagaaaaaccttaacaatcctgagggctgagaagcctggaatcatggaggaggatctcctgatcgatgccatctttgtcgccacgttcaggtgcaaatgttctttgcctagtacatcactggctagtggcagttgagaggcagcatttgtaaaatcaccgagctcgccgtccagtgcggtgcggcgcaggaggcgagagccaaccgacgtcactccaccaaccgcggcgcgcgtgattcggtcaggaggagatgggaatcggttggcatcgtctgctcatctccatctgctccgccccgcccaccgatggacaccccatccatccatcctcgcagcaggaaaggatagatagatagagaagatcgatcggctcatcggcagatgctgtccatggtgcggcggccgctctccaccgccgtgcccgccggcaacctcctcggcatccacctcttccagtgccccgacaccgtgggcatcgtcgccaagctgtccgagtgcatcgcgtcccgcggcggcaacatccacagcgtcgacgtcttcgtccccgacgacaagcgcgtcttctactcccgcagtgaattcacctacaacccaaggctctggccgcgtgacgagctgcacaaggatttcctcaacctgtcacactgctttagtgcgcagaggtcgaccgtacgagtgcctgatcttgaccccaaatacaagatctcagtcctcgcttcaaagcaggaccattgtttgtttgacttattgtatagatggcaagaaggcaggcttccagttgacattaattgtgtcataagcaaccacgataggccagaagataatcatgtgcgaagatttcttgagaggcatggaattccatatcactacttaccaaccacatctgggaacaaacgagagcaagagatactagaattgattgaaggcacagattttgttgtgctggcaagatatatgcagatactgtcagaaagctttttaaaatcatatggtaaagatattattaacattcatcatggacttcttccctcgtttaaggggggccatccttccagacaggccttcaatgctggggtaaagttgatcggtgcaactagccattttgtcactaccgaacttgatgctgggccaatcattgagcagatggttgaacgagtttctcacagagacacactatggagttttgtagtgaagtctgagaaccttgagaagcagtgcctagcagaggctattaagtcatactgcgagctccgcgtcttaccatatgaactgaagaagactgttgtattctgagctattttttcttacagattggtgtggtgttgtgtgtattatttttttcacaaaacaagcaataaatgattaattttcctatatttccacaagcgctcactagcattttgtgattatgcatgtcttattctggtttgatatgatgagcgtacttgagcagtagcaacgaattattcattggaacttgttcctggtaagcatatataattatataaaagcacacgagaagaaaacagtttgaagttactacataaactctctcctgcattttgctcgaaggtacttccattcactgctgcttttcagttactaaacaaaatgagccctttctgattctgttgattctactgcaaggttgcaaggaatgaaggaatcacaaagttgatatcaagctaccctacatccgaataccgtttcgacaccctcatgaaggcgctcgcagaaggtcttgccgaggatgatggatagcagtcagtctgccgcagtccctcctggtcctggacgagctgtttgttttgatgattatggggcccagttgacaagtgatgctcacactgcatgataaatctgaaaccgtattcaactaaaaaaagttattgaagctaagttctctatagctattttttctgacctagttttgctgatttgaagaaagagccgactctgctgtatgaagagttagcctcaatcattctggacaagttgttttggactgtctagacatacagtaacgccctgcattagaaaagcagagattcattgccagtttctca

SEQ ID NO: 924 - DNA, 1438 bp, Sorghum bicolor
cgtgcggtgcggtccacgtccaccccaccccttcacccaaggagggggaggggaggggaggggagagggccgaggcgagggaaggcgaggaatccctcctccatccaccaaccgtcccgcctgtgttcttcttctctggtgcccggccccggctgttcctgctcgcggctcgggaagccctcctccccccacccatcatccatccaatgcgatgctatcgttggcgcgccggccgctctccgccaccgtccccgcgggcaacctcctcggcatccatctcttccagtgccccgacgccgttggcatcgtcgccaagctctcggaatgcatcgcctcccgcggcggcaacatccacagcgtcgacgtcttcgtccccgacgacaagcccgtcttctactcccgcagtgagttcacctacaacccaaggctctggccgcgccatgagctccacaacgatttcctcaatctctcccgctgcttcaatgcacacacatccaccgtacgagtacccgaccttgaccccaaatacaacatctccatcctcgcatcaaagcaggaccactgcttgttcgatttgctccatagatggcaagaaggcaggcttccactacacattagttgcgtcataagcaaccatgatagaccacaagataatcatgtacggcgttttctccagaggcatggaatcccataccactacttacccactgcacctggcaacaaaagagagcaagagatcttggaattgatccagggtacagattttgttgtgctggcaagatacatgcagatactctcagaaagcttcttaaaagcatatggtaaagacattatcaatattcatcatggccttcttccctcatttaagggagggagtccttcaagacaggccttcaatgctggggtgaagttaatcggggcaactagccatttcgtcactcaggaacttgatgctgggccaatcattgaacagatggttgaacgagtttctcaccgagacacgttacagagttttgttgtcaagtctgagaaccttgagaagcagtgcctagcagaggctatcaagtcatactgcgagcttcgtgtcctaccatatgaactgaagaagactgtcgtgttctgagctccctttatttttctgtcttatactcttgtggattggtgtgtgtatattttttttccctcacagaacaagtgatagatgattcactttttgatatatctcagcaatcgcttcctagctctgtatgatcgtgcataacttactccattggttgatatcacgagcatacttgagctgtggcaacagttattcatcgaatacttgcttgttcgtggcaattttgattcacgtacttgtgcatcattttgtgagaaaattttgattcgcgtacttcttcagtacctagtccatatcaccgataaacatctaccgtgt

SEQ ID NO: 925 - DNA, 4048 bp, Oryza sativa
gaagggaagaggaagaaagtgcaggttaagccaaacacacacgacctttgttatcggcatcgccgtcgcggcagtgaagaagggagatgaggaggtttagggtttggcctccatctccatcgccatggccgctgctcgcttcccgcccttgccctcactcccaccaccatcgcagtcccttccacgcctccgccaactccggcgcccgccaaggcaattttattctacctggtgcaacggcagcaactcttgtcatgtttggtattctacatgctaggcgtatgtacgaagaccaaaaagttgttgaaaggaaggagaaaggaattgagccggaattctcaccagatttcaaggcttcatttctcaggcttctgccattgcgttcgatgtcacgtttatggggatccttgatggaagtggaacttccagtgttcatgcgccctgccatctataaagcatgggctagagccttccactccaatttgcaagaagctgctatgccactagaagaatacccttctttacaggcattcttcatccgtagtctcaaagaaggttcaaggcccattgatgcagacccaaactgtctggtgagtcctgtggatggtaaagttctgcggcttggagaacttagaggtccaggaaccatgattgagcaagtgaagggcttttcttattctgctgcttctcttctcggtgcaagttcatctcttcatggtgctgaagaagaagatttttctagagagcatacagaacaaagtaatcccgcagattcaaatgcaaaatcatggtggcgagtatcagtggctaaacccaaattatgggatcaaactctgctgagcccaaagaaaggcatcttctattgtgtcatttatttacaccctggtgattatcatcgagttcactctcctgttgattggaacattataaagcgccgacatttctcaggtcatctcttcccccaaaatgaacgtgccgtgcggaccatcagaaacttgtatgttgagaatgaaagggtagtacttgaagggcagtggaaggaaggctttgttgcaattgcagccattggtgctactaatgttggctctatcaaactatatattgaaccagagctaaggacaaatagggcagggtcgaagatactgaactcccagcctgagcctcctgatgatcgagtttatgaacctgtaggcaccggtgtgatggttaaaaagggggaagagatagcagggtttaagatgggatcgacggtggtgatggtatttgaggcacctgtagtgtccaaggcaagatggagagaggatggcagtggcacggtaacgtcagatttcgatttctgtatcaaggctggcgataggatcagggtaggagaagccattgggcgatggacatcgcgggaatgaatgaatgaaggcatggcatggcatctctctctatatatcttgtgttaacatgatggatgatgagtatcgtcgtcgtatcaatgtctctttcgtttttatttttgagctgcggtgccggtgcatgctactacaaaaagacttgtatcttctgtagggaagtaaaggaaactattgccattttgacttgacttgggcgatttgagagagaatgatattcttgttactcagcagttttaagacttgttttcagctttgtttagttccaaagtttttttctaaacttccaactttccatcacatcaaacttttcatacaaacacaacttttcagtcacatcgtctctaatttcaaccaaattctaaactttgggccgaactaaacacaacctaagtagaattgttttgaagttgaatcttgttccttccaactgtgtggttcagggagacgaaaatatgtcctcctatagtgcagtcatagattgattgtaacatacggagtagaaatgagaccgataattaactgtatgtatcctagtagtacgttttagtggcagtagtggcggtggcggcaaccggcaaggaaagaatgcgcaactataatagtactatctcatatgttgttttttttttactcatggcatgacaggagcagagcaaacacagatgactgattaatggttgcatctagtagtagtagtacatggatcgaatggcagcagcagcagcagctgaaggcaaagttgcttgacaaaaattgaaaagaagatgatgttgcagcagcagaaggagttggtgagatcagatgaggcccttggtcctgtacatgtaagagagagatgagatctacgaagaagacatgttggtcagtagatgatgaagaagcaagggaggataggagggaagggtcagagcacacctacgtctgcttggagaaggaggaggatggagcggaggaagcggcgacggcggtggaggaggaggaagagcgcttgctgcggaagatcatgtaggcgagcgggaggacaacgccggccatcatgatggcggcgccgaccaggtacctcgccggtgacggcgcctccagctccatcgcttgcctttctctttgtcttgttgtcttggatgaaggaagaagaagaagaagaagatcgtcggaggaggaaagaagtcggagatctgggagggatgcggttggatcggaggcggagcaggaggcgtaaactggtactacacagactccaccaccgtgttgatggcgtaaactagaagtacgcttctccactgcatcaacaaaagactaatattattattattagtatataataaaaaaaaagaagaaaaagaaaagagattccgcttccatttccaccaaccgcgcaagatacaggagggagattagattagttaggagaaaacgacgagcaaggatggaggggatggatactactcatacatccatccttctctctttctgtatccatcccgctctctctctctctcgacgagagagagaaagtgcgaagatatgctttccgtcgcccgccggcccctctccgccgccgtccccgtcggcaacctcctcggcatccacctcttccaatgccctgacacggtgggcattgtggcgcggctgtctgagtgcatcgcctcgcgtggtggcaacatccacagtgtcgatgtctttgtccctgacgacaaacccgtcttctactcccgtagtgagtttacctacaatcccatgctatggccgcgcgatgtgcttcgcaccgacttcctcaatctgtcacaacacttcagcgcacaaagatctactgttcgagtccctgatcttgacccgaaatacaagatatctgtactcgcttcgaagcaggatcattgtttgtttgacttgctctatagatggcaagagggaaggcttccggttgacatcaattgtgtcataagcaaccatgatcgacttaaagataaccatgtcagacgtttccttgagagacatgggatcccctatcattacctaccgacaagcccaggaaataaaagagagcaagagattttagaattggttcaaggtaccgattttgtggtactggcaagatatatgcagatattatctgaaggctttctcaaggcttatggcaaagatattattaacatccatcatggtcttcttccctcatttaagggagggaatccttcgagacaggccttcaacgctggagtaaaattgatcggcgcaaccagccattttgttaccccagaacttgatgctggcccaatcattgagcagatggttgaacgggtgtcccacagagacacgctacagagctttgtggtgaaatctgagaacctagagaagcagtgcctagcagaagctataaagtcgtactgtgagctccgtgtgctaccatatgaattgaagaagacagtagtgttctgatatcttttgaaggaagcgattttgtttgtttgtttttatttgttgataagaggaaattactacagtacaaaattttgtggtgttgattgctttggtgataaggaggtgggtgtgtgggcgtggctggacagtgcattttgtaattgattgagtataacaatactccaaagcaaataaaatgataatgcataatagtagtaattggtatg

SEQ ID NO: 926 - DNA, 1144 bp, Pennisetum glaucum
ccggcggcagagatgctgtccatggcgcggcggccggtctccgccgccgtgcccgccggcaacctcctcggcatccatctcttcaagtgccccgacaccgtgggcatcgtcgccaggctgtccgagtgcatcgcctcccgcggcggcaacatccacagcgtcgacgtcttcgtccccgacgacaagcccgtcttctactcccgcagtgaattcacgtacaacccaaagctgtggccgcgggacgagctgcacagggatttcctcaacctgtcacactgcttccaagcgcagagatcgaccgtacgagtgcctgatcttgaccccaaatacaagatatctgtccttgcttcaaagcaggatcattgcttgtttgatttgttgtatagatggcaagaaggcaggcttccagttgacattagttgtgtcataagcaaccatgatagaccagaagataatcatgtgcagcgatttcttcagaggcatggtattccatatcactacttaccaaccacatctgggaacaaaagagagcaagaaatactagaattgattgaaggcacagattttgttgtgctggcaagatatatgcagatactgtcagaaagctttttaaaatcatatggtaaagatattattaacattcatcatggccttcttccctcatttaagggagggcatccttccagacaggccttcgatgctggggtaaagttgatcggtgcaactagccattttgtcactactgaacttgatgctgggccaatcattgagcagatggtccagcgagtttctcacagagacacgctacagagttttgttgtgaagtctgagaaccttgagaagcagtgcctagcagaggctatcaagtcatactgcgagctccgtgtccttccatatgaactgaagaagactgttgtattctgagctaatttttcttacggattggtgtaaatatgtgatgtgtattattttcacaaaataagcaaaatgattaaaaattttctgtatctctacaatagctcgcgagctttttgtgatgatgcatgtttatctggtctggtatgatgaagcatacttgagcagtagcaacaaattatccctggacacttgggttcatggcaagcataagcatatataaaagcgc

SEQ ID NO: 927 - DNA, 1118 bp, Zea mays
aatgggattgggaatccatatcatccaccaaccgcccccacccagtctgagtctgagtcagaggtacccacccactcatccgtccgtccatccaatgcgatggtgtcgttggcgcgccggccgctctccgccgccgtacctgcgggcaacctcctcggcatccatctcttccggtgccccgacgccgttggcatcgtcgccaagctctcggaatgcatcgcctcccgcggtggcaacatccacagcgtcgacgtcttcgtccccgacgacaaacccgtcttctactcccgcagtgagtttacctacaatccaaggctctggccgcgtcatgagctccacaaggatttcctcaatctctcccgctgcttcaatgcgcaaacctccaccgtacgagttcccgatcttgaccccaaatacaacatctccatcctcgcatcaaagcaggaccactgcttgttcgatttgctctatagatggcaagaaggcaggcttccagtacacattaattgtgtcattagcaaccatgatagaccacaagataatcatgtacggcgttttctccagaggcatggaatcccataccactacttacccaccgcacctgccaacaaaagagagaaagagatcttggaattgatccagggtacagattttgttgtgctggcaagatacatgcagatactctcagaaaacctgttaaaagcatatggtaaagacattatcaatattcatcatggccttcttccctcatttaagggagggaatccttcaagacaggccttcagtgctggggtgaagttaatcggggcaactagccatttcgttactccagaacttgatgctgggccaatcattgaacagatggttgaacgagtctctcaccgagacacgttacagagttttgttgtcaagtctgagaaccttgagaagcagtgcttagcagaggctatcaagtcatattgcgagcttcgtgtcctaccatatgaactcaggaagactgtcgtgttctgatctgagctccctttattttctgtcttattgtacttttatatggattgataaaatgaattttttagcttaaatatatccatcccctcgacattattttaggtaagaaa

SEQ ID NO: 928 - DNA, 985 bp, Secale cereale
atccacctcttccagtgccccgacgcggtgggcatcgtggccaagctctccgagtgcatcgcctcccgcggcggcaacatccacagcgtcgacgtcttcgtccccgacgacgcccccgtcttctacgcccgcagtgagttcacctacaatccgaggctatggccgcgcgacatgcttcgcaccgacttcctccacctgtcggactgcttcaatgcgcagaaatccactgtgcgcgtgcctgacattgaccccaagtacaagattgcagtcctcgcttcgaagcaggaccattgcttgttcgacttgctgcatagatggcaagaaggcaggcttccagtggacattcattgtgtgataagcaaccatgatcgacctgtagataatcatgtgatgcgttttcttcagaggcacgaaatcccctatcactacttaccaacgacttctgggaataaaagggaacaagagatattggagttgattgaaggtacagattttgttgtgctggcaagatacatgcaggtaatgtctgaaagctttcttaaagcatatgggaaagatattattaatattcaccatggcctccttccctcgttcaaaggaggaagtccgtctagacaggccttcaatgctggggtgaagttgattggtgcaactagccattttgttactccagaacttgatgccgggccaatcattgagcaaatggttgagcgagtttctcacagagacacgttacatagctttgttgtgaagtcggagaaccttgagaaacaatgcctggcagaagctatcaagtcatactgcgagctccgtgtgctgccatatgaagtgatgaagactgttgtgttttgtttttttttttggattgttacgatgtgtattatttttccaaaattagcaatacattattcttttgttaatatattcacgctgagccattaggtgtatctgaacgcgggttgaagttacgagaataatcaagcaa

SEQ ID NO: 929 - DNA, 2147 bp, Secale cereale
tcgactctcgccagaccccaccccacacccacacaaacacgcggccatgtaccgggcggcggcggcggccatttcgcggtcctcctcctcggtgctgcggcggcagctcgcccgcggcggcttcggcggcggggagcagcggcagtgggcgcgcgggtatgcggcgaaggaggtcaccttcggcatcgacgcccgcgccgccatgctgcggggcgtcaacgacctcgcggacgccgtcaaggtcaccatgggccccaaggggcgcaatgtggttatcgagaggccgaacagatcccccaaggtcaccaaggacggggtcaccgttgccaagagcatagagttcgaggacagcgccaagaatgttggggcgagcctggtgaagcaggtcgccgatgccactaacaaggcagcaggagatggtaccacttgcgcaactgtgcttacacaggcaattctcacggaaggatgcaaggctgtggcagcaggggtcaatgttatggatttgcggaaaggcataaacaaggctataagcgccgtcactgctcacctcaaaagtaaagcatggatgattgattccccagatgaaataaaccaggtagctacaatttctgcaaatggagaaaaggaaattggagatctgatatcaaaagctatgggaatagttggaaaggatggcgtcattactattgctgatggcaaaacattggataatgagcttgaagcagtccagggaatgaagttgactagaggctacatatccccttactttgtaactgaccagaagactcagaaatgtgagttgaaagatcctctgattcttattcatgacaagaaaatctcaaacatgaattcacttcttccagcattgcaaatttccatccagaatcgcagacctcttctcattttggctgaggatgtagatggagaagctctatcaatgcttgtactgaacaagcatcgtgctggactaaagatatgtgctgtcaaagctcctggatttggtgaaaacagaaggtccaatctggatgatatggctgttttaacaggagggcaggttattagcgaggaccaaggtcttgatcttgataaagttgaactacaaatgctcggcacagctaagaaggttactgtatctcttgatgatactatcattctagatggtggaggtgaaaggcaacagattgaagagaggtgtcaacagcttagagaatcactcgagaacaacacctccatgttcgacaaagaaaaggctcaagagcgtttatcaaaattatctggaggcgttgctattctcaagattggtggagctagtgaagctgaagttggtgagaaaaaagacagggtaacagatgctctaaatgctgcaagggctgctgtggaggagggtattgttccaggtggcggagttgcacttttatatgccaccaaggagctcgacaatattatcacatcgcatgaggatgaaaaaattggagttcagattatcaagaatgctttgaaggcccctctgatgaccatagccgcaaatgccggtgtcgatggtgctatagttattgggaagctactggaacaagataatcttagtctgggctatgatgcagcaaaaggggagtatgttgacatgatcaaggctggtatcatcgaccccgtgaaggtgatccgaactgcacttcaagacgcagcaagcgtttctctgctgatgacaaccacagaggccgcagttgctgagctcccgtcgacaaaggccagaattgccagtcgcatgccggacatgagcggaatgggtttctgaggtcaagtgcggcatgccgtctcatttgcctgttttttttggttaaggacatgacaaacttaactcccccggcctatacatgaatagaaattcccctccctatcaagtgagaggtgcaaagctggcacctattttggtttctgaaaaactcatggttcagtgctgatgtaaccttaactagatttagagccctttcattcttgggtcgaaattcgagtaggctcggacaagacaaggattaccttgggctttgaatgttaactgcgcaacggatggtgccattgaagtggtccttttgaataacaaaaaaaaaaaaaaactagaagactgacacgacacacgacggagtaggggg

SEQ ID NO: 930 - DNA, 2300 bp, Brachypodium distachyon
cagtgacagaaggaggaaccgaagcttccaaaccccacacataaaccctctcccgaatcttgagacgccaaacaagcttgatcgagttcgagaaatccacccacccccactcacgaggccatgtaccgggcggcggcggcggccatttcggggtcctcctcggcgctgcggaggcagctcgcgcgcggcgagcagcggcagtgggcgcgcgggtatgcggcggcgaaggaggtgaccttcggcgtcggcgcccgcgccgcgatgctgcggggcgtcaacgacctcgccgacgccgtcaaggtcaccatgggccccaaggggcgcaatgtgatcatcgagagagcccataaatctccgcaggtcacaaaggacggggtcactgtcgcaaaaagcatagagttcgaggacagcgctaagaatgtcggggcaagcctggtgaagcaagttgctgatgctactaataaggttgcaggagatggtaccacttgcgcaactgtacttacacaagcaattcttacggaaggatgcaaggctttggcagcaggggtgaatgttatggacttgcgtattggtataaacaaggccataaatgctatcacttctcacctcaaaagtaaagcatggacgattaattccccagatgaaataaaccaggtagctaccatttctgcaaatggtgaaaaggaaattggagatttaatatcaaaggctatggaaatagttggaaaagacggagtcattactattgtcgatggcaaaacattggacaatgagcttgaagcagtacagggaatgaagctgtctagaggctacatatctccttacttcgtgactgatcagaagactaagaaatgtgagatggaaaatcctttgattcttattcatgacaaaaaaatctcaaacatgaattcacttcttccagcattgcaaatttctatccagaatcgcagacctcttctcatttttgctgaggatatagagggagaagcactatcaatgcttgtaatgaacaagcatcgtgctggactcatgatatgtgcggttaaagctcctggatttggtgaaaacagaagggccaatctggatgacatggctgttttgacaggagggcaggttgttagtgaggaccaaggtcttgatcttggtaaagttaaattacaaatgcttggcacagctaagaaggttactgtatcgcttgatgatactatcattctagatggtggaggtgacaggcaacagatagaagagaggtgtcaacagcttagagaatcatttgagagcagcactgctatgttcgacaaagaaaaggctcaagagcgtttatcgaggttatctggaggtgttgccatcctcaagatcggtggagctagtgaagctgaagttggtgagaaaaaagatagggtaacagatgctctaaatgctgcaagagctgctgtggaggagggtattgtacctggtggtggagttgcccttttatatgccaccaaggtgcttgacaagattagcacgtcacatgaggatgaaaagattggagttcaaattatcaagaatgctttgaaggcccctctgatgaccatagctgcaaatgctggggttgatggtgccatagttattgggaagctactggaacaagataatcctagtttgggatatgatgcagcaaaagaggagtatgttgacatggtcaaggctgggatcatcgaccctgtgaaagtgatacgaactgcacttcaagatgcagcaagcgtttctctgctgatggcaaccaccgaggctgcagtgtctgagctcccagcaactaaggccaggcttgcgagtcgcatgccgcagatgagcgggatgggtttttgaagacagatatggcatggtatatgattcacctgttctttgttaaaagacaatccctgacgatacttaactttgctccctggcggatacatcgaagagaaattctcgtactgtggaacgagaggtgcaaagatggcaccaatgtgatttttggtttttgaactttgggttcaatgctgatgtaaccttaactaaattagggccctatttagggccctcatgtttttgtgcaagtcttacggcaaatgcttattggatcactgcaatttttgcccttgttgtcatggttaacggctgtgtgcagctgcacctggggagttgtcccaggcctctaaacttcaacattgttgtcgacctcgaccccattgtaaccatgagctgtctgttttacctatcttttcacctgctcccgccattcacctagtataaaaaaaaggcaatctttttaatca

SEQ ID NO: 931 - DNA, 2162 bp, Sorghum bicolor
gaagcgtggatctcgtgttggaacagaagccgaaccttctggaacccaaaccccgttcctctaaaaccctcggtgtcgacccgacggcgaaagcaattcgagtgcgcacacacacgagcagccgcaggcagccaggcacactcgcgcgaccatgtaccgggcggcggcggcggccatctcgaggtcctcctcagtgctgcggaggcagctcccgcggggcgcgggcggggagccgccgcgtctgttggcgcgggggtatgcgtccacggcgaaggaggtgtccttcggcgttggcgcccgcgccgccatgctgcagggcgtcaacgacctcgccgacgccgttaaggtcaccatgggtcccaaggggcgcactgtgatcatcgaggggtcctataaaggtcccaaggtcacgaaggatggggtcactgttgccaagagcgtggagttcgaggatagcgcgaagaatgttggggcgaatctggtgaagcaagttgctgatgctacgaacaaggctgcaggggatggtaccacttgtgcaactgtgcttacacaggcaattcttacggaaggatgcaaggccgtggcagccggtgtcaatgttatggacttgcggaatggtataaacaaggccataaatgctaccactgctcacctcaaaagtaaagcgtggaagattaattctccagaagaaatcaaccaggtagcaaccatttctgcaaatggtgaaaaagaaattggagatctgatatcaaaagctatggaaaaagttggaaaggacggagtcattactattgttgatggcaaaacattggacaatgagcttgaagcagtacagggaatgaagctgtccagaggatacatatctcattactttgtgactgatcagaagactcagaaatgtgagatggagaaccctctgattcttatccatgacaagaaaatctcaaacatggattctctccttccagcattggaaatttctatcaagaaccgcaagcctcttctcattgttgctgaggatgttgatggagatgctctgtcaatgcttgtactgaacaagcatcgtgctggactcaaggtatgtgctgtcaaagctcctggatttggtgaaaatagaaggcacaatctggatgacatggctgtgatgactggaggagaggttattagcgaggaacgcggtcttgatcttggcaaagttcaattacaaatgcttggcactgctaaaaaggtaactgtatctcttgatgatactatcatcctagatggtggaggtgacaaacagcagatagaggagaggtgccaacagcttagagaatcaattgacacaagcactgctgtatttgacaaagaaaaggcccaagagcgtttatcaaagttatctggaggtgttgctgtactcaagattggtggagctagtgaagctgaagttggtgagaaaaaagatagggtaacagatgctctaaatgctgcgagagctgctgtggaggagggcatcgtgccaggtggtggagttgcccttctttatgccaccaaggagctcgacaaaattagcacatcaaacgaggatgaaaagattggagttcaaattatcaagaattctttgaaggctcccttgatgaccatagctgcaaatgctggcattgatggagctatagtcatagggaagctgattgaacaagaggacctcagtttgggctatgatgcagctaaaggggagtatgttgacatgatcaaggctggcatcatcgatcctgtgaaggtgatccgcactgcacttcaagatgctgcaagtgtttccctgctgatgacaaccacggaggctgctgtttctgagctcccggcaacgaaggccagaatagccagccgaatgccgcagatgagtggaatggatttttgaggaaaattaggcgatctgacttgtaagactagtactgtacttgggaagttggggacgaactttgtttccctagcggatacgtctacagagtttattcgaaacgaggtgtgacaccgtgttgcaacttttgatagtgttcgatggacgatagtgatgtaacctggactgatagcgccttccattttgtatgctctatttgatgcgtaataacttgctgccgtcgaagcagctgaattttactgtgctcttctacgagcacagctta

SEQ ID NO: 932 - DNA, 2370 bp, Zea mays
cccgcaaaaacggacggaataagctctctcccgtttccgtcccgtttccatatttttccgtaaatacggaaacggtcgggtcaaatgtagaaaacggtacgggtcgggacgggattttttccgtccgttttcaaccctagtttctggattagaaaaaaaatgaaaaatgaaaaaacaaagtcctacaaacagaaaaattagcgtagtgtcaaatcaaaatttgaaaaaacgtataaatctctcgaatcaaacggtgcccgaagaatggatctcgcggttgagccgaagcttccagaacccaaacccctgcgcatctaaaaccctcctcccgagtcccgacccgacggcaaaaagcaaattcgagtgcgcacacgagcagacccccgcagacagccaggcacactcgcgcgaccatgtaccgggcggcggctgtcatctcgaggtcctcatcagcactgcggaggcagctcgcgcggggcgtggccggggagctgccgcgtctgttggcgcgagggtatgcggccacggcgaaggaggtgtccttcggcgttggcgcccgcgccgccatgctgcagggcgtcaacgacctcgccgacgccgtcaaggtcaccatgggccccaaggggcgcactgtgatcatcgaggggtcccataaaggtcccaaggtcacgaaggacggggtcactgttgcaaaaagcgtggagttcgaggatagcgcgaagaatgttggggcgaatctggtgaagcaagttgctgatgctacgaacaaagctgcaggggatggtaccacctgtgcaactgtgcttacacaggcaattcttactgaaggatgcaaggccgtggcagccggtgtcaacgttatggacttgcggaatggtataaacaaggcaataaatgctatcactgctcacctcaaaagtaaagcgtggaagattaattctccagaagaaattaaccaggtagcaaccatttctgcaaacggtgaaaaggaaattggagatctaatatcaaaagccatggaaaaagttggaaaggatggagtcattactattgttgatggcaaaacattggacaatgagcttgaagcagtacagggaatgaagctgtccagaggatacatatctccttactttgtgactgatcaaaagactcagaaatgtgagatggagaaccctcttattcttatccatgacaagaaaatctcaaacatggattctctccttccagcattagaaatttctatcaagaatcgcaagcctcttctcattgttgctgaggatgttgaaggagatgctctgtcaatgcttgtactgaacaagcatcgtgctggactcaaggtatgtgctgtcaaagctcctggatttggtgaaaatagaaggcacaatctagatgacatggctgtgatgactggaggagaggttattagcgaggaacgcggtcttgatcttggcaaagttcaattacaaatgcttggcactgctaaaaaggtaactgtatcccttgatgatactatcatcctagatggtggaggtgacaaacagcagatagatgagaggtgccaacagcttagagaatcaattgacacaagcactgctgtattcgacaaagaaaaggcccaagagcgtttatctaagttatctggaggtgttgctgtactcaagattggtggagctagtgaagctgaagttggtgagaaaaaagatagggtgacagatgctctaaatgctgcaagggctgctgtggaggagggcattgtgccaggtggtggagttgcccttctttatgccaccaaggagcttgacaagattagcacagcaaacgaggacgaaaagattggagttcaaattatcaagaattctttgaaggctcccttgatgaccatagctgcaaatgctggcattgatggagctatagtcatagggaagctgattgaacaagaggacctcagtttgggctatgatgcagcaaaaggggagtacgtagacatgatcaaggccggcatcatcgatcccgtgaaggtgatccgcaccgcacttcaagacgctgcaagtgtttccctgctgatggcaaccacggaggccgctgtctccgagctcccggcaaccaagtccagaatagccagccgtatgccgcagatgagcgggatggacttctgaggaaattcaggcgccgtgtatgatgctgatctgtgacctgtaaggctaggaattgggaggttggggacgaactttgtttccctagcggatagtcggatacgtctacggagttcattcgaaacgaggtgcagaactgtcaccgagttgcagtttttgatgcagtgcggcgttcgatggtggggtaataaagctggactgatagcgccttccattt

SEQ ID NO: 933 - DNA, 5781 bp, Oryza sativa
aacccaaaacccttcttccctagcaaaaccctctctctctcttctcgaatcgaaattgcgaagccgcaagcaaagccgccggaggaaggagcaatcgcgagtactcgccaccatgtaccgggcggcggcggcggcggcgtcgtcgatttcgaggtcctcgtcggcgctgcggaagcagctgtcgcgcggcggttgcggggagcagcggctgtgggcgcgggggtatgcggcgaaggaggtggcgttcggcgtcggagcccgggccgccttgctgcagggcgtgaacgacctcgccgacgccgtcaaggtcaccatgggccccaaggggcgcaatgtgattatcgagagatcccatagagctcccaaagtcacaaaggatggagtcacggttgcaaaaagcattgagtttgaggacagtgctaagaatgttggtgcaaacctggtgaagcaagttgctgaagctactaataaggtcgcaggagatggtaccacttgtgcaactgtacttacacaggctattcttacggaaggctgcaaggctgtggcagcaggggtcaatgttatggacttacgtaatggcataaacaaggccataagttctatcactacacacctcaaaagtaaagcatggattatcaactcctcagaagaaataaatcaggtagcaactatttctgcaaatggagaaaaggaaataggagatttgatatcaaaggcgatggaaaaggttggaaaggatggagttattactattactgatggcaagacattagacaatgagcttgaagcggtacagggaatgaaactttccagaggctacatatctccttactttgtgactgatcagaagactcagaagtgtgagatggaaaatcctcttattctaattcatgacaagaaaatctcaacgatgaattcacttcttccagttttagaaatgtctatcaagaatcgtaggcctcttctcatcattgctgaggatgttgagggagaagctctatcaatgcttgttctgaacaagcatcgtgctggattaaagatatgtgctgtcaaagctcctggatttggtgaaaacagaagagccaatctggatgacgtggctgtgttgacaggaggagaggttgtcagcgaggaccaaggtcttgatcttggtaaagtcgaactacaaatgcttggcactgctaaaaaggttactgtatcccttgatgatactatcattctagatggtggaggcgacaaacagcagatagaggagaggtgtcaacagcttagagaatcaatggacaaaagcactgctgtatttgacaaagaaaaggctcaagaacgtctatcaaagttatctggtggtgttgctgtcctcaagattgggggagctagtgaagttgaagttggtgagaaaaaagatagggtaacagacgctttacatgcagcaagggctgctgtggaggagggcattgtaccaggtggtggagttgcccttctgtatgccaccaaggagcttgacaagattatcacagcaaatgaggatgaaaagattggagttcaaattatcaagaatgctttgaaggctcctttgatgactatagctgcaaatgctggcattgatggtggtgtggtcattgggaagctaattgaacaagataatcttaatatgggctatgatgcagcaagaggggagtatgttgacatgattaaggctgggatcatcgaccctgtgaaagtcatccgaacagcgctacaagatgcatcaagtgtttctttgctgatgacaacgacagaggcagctgttgctgagcccccagcagcaaaggccagaatggctagtcggatgccgcagatgagcgggatggatttttgagagcaagtaacatgatttatgatatgtcttctcctgatgtaaggcagtgcccctcaaatgaaaggggtgattttttgaaagctatatgacgtgattttgtcttttcgtggtgaaaggcagtagtagtacttaatatttctacagaatttcacggcccgggagaaagacgttacagatataatttattttaaacttgggaattgggaatccgtctgatgtaaactgaactaatgtggagcagcacctcattttgtagattactacatatgtgaaattgatactgtgaaagctgcaatattttactatgcattttggcaataattttgcctgcgcaaaaccaccatttgtccgaccacctgaacgaattattctcccctgatctccttgaatgtgcgtacgctgcacatgttcataagcacgaactgattcaaacacatcacaactcgactgttatcaggaaggcgaaaatgcaaagtagacaaacaaggagtgaagatttatgactcatgaacacttccaatttctcattataaggggataaggggaaataaaccgtttataccgtataatatagatcgtatctaactctacttgccttgagatcgatgggggcaaactgtttattcacgcaacaaacactacatatcgtgtccttacagacacgcaacatttaaaagattcagtgatcattgaagattttatgccggtttcgcctcttctggtgtctgcataaagcgtggaacttctccgttcatcaccctccatggcccccagtagaatttgggcggcatgagcggcacggcctcgcccggatgatcttcccagtacttctcctgctccaaaatgcggtcacaatcaggcaaaagcaactgtaaattgaggtcaaattgccaatcctagttatttcaaagggtttgacgaagcttttggcggacaatgcgcccaaggcgatgaaggagcagaagttcgagagctacttcggccggcgcattgccgtcgacgccagcatgagcatctaccagttcctcattgtagttggaaggacggggatggaaaccctcacgaacgaggccggtgaagtcaccagtcatttgcaaggtatgttcaaccggacaataaggttgctggaggcaggaatcaagccagtatatgtttttgacggcaagcctcctgatctgaagaaacaagagctcgcaaaaaggtactcgaagagggaggatgccaccaaagaactaacagaggcagtagaggaaggagataaagacgcaattgaaaaattcagcaagagaactgtgaaggtcacgaagcagcacaatgaagaatgtaaacgactattaagacttatgggggttcctgttgtagaggcgccatgtgaagcagaagcagaatgtgctgcactttgcataaatgatatggtttatgcagttgcatcagaagatatggactctcttacttttggagctccacggtttcttcgtcatttgatggatccaagttccaagaaaattccagttatggaatttgaagtcgcgaaagttttggaggagcttgaactcactatggaccaattcattgacttgtgcatcctatctggatgtgactattgtgatagcattaaaggtattggaggtcaaacagctctgaaacttattcgtcaacatgggtccatagaaagcattctggaaaacataaataaagacagatatcagattcctgaggactggccttatcaagaagctcgacgcttgttcaaggaacccaatgttacattggatattcctgagctgaaatggaatgctcccgatgaggaaggtcttgtagagtttctggtgaaagaaaatggtttcaaccaagatagagtgacaaaggccatagagaagattaaatttgccaagaacaaatcttcccaaggaaggctcgaatccttcttcaagccagttgttagcacatcagtgcctctgaaaagaaaggacacttcagaaaaaccaaccaaagcagtcgctaacaagaaaacaaagggagccggcggaaagaagaaataagttcgattgtgccattcatcaacaagacctcctgcacgtgtcatttcaattttaactcccatgtttgtaactcatcctccatctgatgttttctatgttcctagtaaaccagaagtccagaacttcgtctaatactagttcatctatgtagtacgtctctcttctctactagggatttgtagtgttggtttggttgctgcgtagtgtatgaagaaccaacaaaattggctttgccgcgcaaaattaactggttccgattcgcaaaatcagcgatctcccggacgatgtgctccgcgaaatcttgcgccgcgtcaactcccgcgccgcgctgggcaagcgctgggccggcctcgcgcgcgagctgcccagcctcgatctgagggtcgccgacatcctgccgcgcgactactacctagagcttcgccggcgcgacgaggccaagaggtcgttctgggtgtacgactacggcaagaagtacgacgccgtcatcagacggtacgagcgccgcgccatgcgcgccatggccgcctgcatgaaggagctctcgccgtcgacgccgcgccggagcgtccacaggctcgcggtggagttcatcgacaccaacagctcgaaccacatcaaccgcctgatcaccacggccgtcgacgcgtggggcgtcgagcacctcgacgtcgccgccgttctcctgacgtcgtcgtcgtcggcgcagctggatcacccggcctacaggttccccgacggccgcatcagcgacgacccccacggctcccggctaaggacgctcgagctcaccagatgccggcctccggatctccgaggcttcgacgcgctcaccacgctggtcctgcgcggcttgccccgcacgacgcgggcggccgtctacgagcgcgccgtggcgagctgcccgtcgctccgagccctccacctcgtctcctgccgatgccgctactccaaggtcgtgatcgacgcgccattgccggacctccgggagctcgtcgtcgtcggcggcggcgacatgagcgtacgcttcctccacggactccccagcctcgagacgctcgtcgctgtccagaacagcgtggagctgtaccgccccgacgccgacgccgcgccgcgcctcgcgcgcgccaccgtcgcgttccgcgtcggccagatggaaggggatcccccggactgcagccattgcaggagaggatcaagcgcgacgccgcgctgtccgcgctcggctacctctgcagggccgccattaacgtgacggatctcgcgctgcgtctcacggggcctcagatgtgggtcgtcccggagagccctttcctggagatgcccagcctgaggaggctgctggtcgccgacgtgccgccgcgctgggacgcgacgtggatccgcgccgtcgtcgaggcggcggcgccgtcgcttgagcgcctccacgtccacttctcccaacactatcgccaagacgacgacgacccggcggcggatcgtcggagattggagatagtgtgggagaatgagccgtcaagaacacagcattgtgacaatctggaggagcttgtggtcattggtttccagagcaagaaagagaggcaggttcagtttgtgaggtacgtcatggaggaagcatccatggcgttgcgccgtgttgtgctgatcaagcatggacacgtcgaggatagaggcccaggtgaatgggagatggtgagccagaaatgtacttggagcgatgaggagaagctcgccgtgaaggagcagatcatggagggggtttgctgttcgatggaccaagttgaattggtcctagaataatgaaaccaaactatgtgttgattgtacattagttaaacattcataaaggttatacaatacatcgaacagttataattc

SEQ ID NO: 934 - DNA, 2457 bp, Setaria italica
atggctgacacgtctcggtgtacagctccatatctaggactgtccaaaccttctggtgggcctatagatttgtcgaatgtacctcccccccccccccccccccccccccccgcgcgcccggaggagcaactcgaatccgctcacgagccgccgcgcacatacacgagcgcgaccatgtaccgggcggcgacttcggccatttccaggtcctcctcggcgctgcggaagcacctcgcgcggggcggcggcggggagccgcagcggctgtgggcgcgggggtatgcagcgaaggaggtggccttcggcgtcggcgcccgcgccgccatgctgcagggcgtcaatgacctcgccgacgccgtcaaagtgaccatggggcccaaggggcgcaccgtgattatcgaggggtcctataaaggtcctaaaatcacgaaggatggggtcactgttgcgaagagcgtggagttcgaggacagtgcgaagaatgttggggcgaacctggtgaagcaagttgctgaagctactaacaagacggcaggggatggtaccacttgtgcaactgtacttacacaggcaattcttacggaaggatgcaaggccgtcgcagctggtgtcaatgttatggacttgcgcaacggtataaacaaggccataaattccatcacttctcacctcaaaagtaaagcatggaagattaattccccagaagaaataaaccaggtagcaactatttctgccaatggtgaaaaggaaattggagatctgatatcaaaggctatggaaaaagttggaaaggatggagtcattactattgttgatggcaaaacattggacaatgagcttgaggcagtacagggaatgaagctttccagaggatacatatctccttactttgtgactgatgagaagactcagaaatgtgagatggagaaccctctgattcttatccatgacaagaaaatctcaagcatgaattctctccttccagtactagaaatttctatcaagaatcgcaggcctcttctcattgtggctgaggatgtagaaggagaagctctgtctatgcttgtactgaacaagcatcgcgctggactcaaggtatgtgctgtcaaagctcctggatttggtgataacagaaggcacaatctggatgatatggctgtgatgactggaggagaggttgttagtgaggaacgaggtcttgatcttggcaaaatccaacaacaaatgcttggaactgccaaaaaggttactgtatctctcgatgacactatcatcctagatggtggaggtgacaaaaagcagatagaggagaggtgccaacagcttagagaatcttttgagacaagcactgcaatgtttgaaaaagagaaggcccaagagcgtttatcaaagctatctggaggtgttgctgtcctcaagattggtggagctagtgaagctgaagttggtgagaaaaaagatagggtaacagatgctctaaatgctgcaaaggctgctgtggaggagggcattgtgccaggtggtggagttgcccttctatatgctacgaaggagctcgacaagattagcacagcgaatgaggatgaaaagattggagttcaaattatcaagaatgctttgaaggctcccttgatgaccattgcggcaaatgctggcattgatggggctatagtcatcgggaagctaagtgaacaagatgaccttagtttgggctatgacgcatcaagaggggagtatgtagacatgattaaggctggaatcatcgatccagtgaaggtgattcgcactgcacttcaagatgctgcaagtgtttccttgctgatgacaaccacagaagcggctgtttctgagctcccagcaacgaaggccagaatagccagccgcatgccgcaaatgggtggaatggatttttgaggacgactcttcgtgatgtaagattgacatgttcttggccaaagacagcacatgggatcaaactttgtttccctagcggatacatctagagtttatttcaaaagaggttcaaagctgatgctgagaagtgttttttggtatagggccaatggtgatgcgacattgtgacctgaactaatttagagcctttcattttgtagactctaaatgtgtgatatgcagcttggtactgttcgaagcaggggaatattgctgcccatttttcacgtgggcagctatttcgtcacatcttgttctcgatcatgtctcagcgatttctcatgtcggccttatcacttgtgtcgaccttagttcagagtgttttattctccataaataatgtgccgcatacttgacatggcatccaagttacgaagagaaaaaaaaaagtttcatttcgatgaaacttactttacatggttaccaacgcgatgaatttttttccgtgtatctattgagagctagagttttatttcatcctatcttttatccaattaaaagttt

SEQ ID NO: 935 - DNA, 3045 bp, Panicum virgatum
cggcgagcgagcgcacggcagcaacggcggcgggcgcgcgcggcctccgtctccggcgagcgagcgtgcgacagcagcggcgagcgctggtccgggcctcgcggccgtcccccggcttccccgccgtcctcgccatatccaatttcgacctcgtcctgggccgcttccccatcttcctcgtctccgtctaccccgccccgtccgccggcctcgccgcggtcctcgccgccgtgctctggcttcctcctttggcaagcgcgccgggtccttgctcccctgcacgcgggagctgcgggctgcggcgcgtccgacgcgcacgtccctggttgccgtgttctctggccgcttccccatccaattttctcatgctgccatcaaaccaaacagcagctggccatcatctctccatcgatctcgtgctccactgcaggcttcctttcttccccaaatataatccacataagattcgacgccggcacgagcccacgcgcgagctgccgttggcgcaagcacaggcagacaggcagagcggcggcagcggcgctgcaggggtgaggggtggccgtcgcggagcagaggagaggaaaggaggagagtggagaatgggccgggtttggatgggcgggctggacaaaataggctcgggtcgggcgtggggggagagagctgacatgatcccagctgaaacgacgcgctggcgtccacgtagacgatagcggtaaaagtgtaagaattttctctttccaatattgattttgtagtgtcaaaaacaagaatactattttagatggtgacgtagacgagattggtaaaagtgtaagagttttctctttccaacattgattttatagtgccaaaaacaaaaatactattttagatggtgcatattgttataatggtataaagttaaatttctccaggatctcgcgttggagccgaagcttccggaacccaaacccctgtttctcttatccccctcctccaaaaccctcctactcctcggcgccgtacactagccgccacaccagcacacacgcgcgcgtgaccatgtaccgggcggcggcgtcggcaatttcaaggtcctcctcggtgctgcgcaagcagctcgcgcggggcggcggcggggagccgcagcggctgtgggcgcgcgggtatgcggcgaaggaggtggccttcggcgtgggcgcccgcgccgccatgctgcagggcgtcaacgacctcgccgacgccgtcaaggtcaccatgggccccaaggggcgcaccgtgattatcgatgggtcccataaaggccctaaaatcacgaaggatggggtcactgttgcgaagagcgtggagttcgaggatagtgcgaagaatgttggtgcgaacctggtgaagcaagttgctgaagctacgaacaaggttgctggtgatggtaccacttgtgcaactgtacttacacaggcaattcttatggaaggatgcaaggctgtggcagctggtgtcaatgttatggacttgcgcaatggtataaacaaggcgataaattccatcactgctcacctcaaaagtaaagcatggaagatcaattccccagaagaaataaaccaggtagcaaccatttctgccaatggtgaaaaggaaattggagatctgatatcaaaggctatggaaaaagttggaaaggatggagtcattactattgttgatggcaaaacattggacaatgagcttgaagcagtacagggaatgaagctgtccagaggatacatatctccttactttgtgactgatgagaagactcaaaaatgtgagatggagaaccctctgattcttatccatgacaagaaaatctcaaacatgaattctctccttccagtattagaaatttctatcaagaatcgcaggccccttctcattgtggctgaggatgtagaaggagaagctctatcaatgcttgtactgaacaagcatcgcgctggactcaaggtatgtgctgtcaaagctcctgggtttggtgataacagaaggcacaacctggatgatatggctgtgatgactgggggagaggttgttagcgaggaacgaggcttggatcttggcaaagttcagctacaaatgcttggcactgccaagaaggttactgtatctcttgatgatactatcatcctagatggtggaggtgacaaaaagcagatagaggagaggtgccaacagcttagagaatctattgacacaagcactgctatgtttgacaaagaaaaggcccaagagcgtttatcaaagttatctggaggtgttgctgtcctcaagattggtggagctagtgaagctgaagttggtgagaaaaaagatagggtaacagatgctctaaatgctgcaaagtgtgctgtggaggagggcatcgtgccaggtggtggagttgcccttctatatgcttcgaaggagctcgacaagattagcacagcaaatgaggatgaaaagattggagttcaaattatcaagaatgctttgaaggctcccttgatgaccattactgcaaatgctggcattgatggggctgtagtcatcgggaagctaactgaacaagatgaccttagtttgggctatgacgcagcaagaggtgagtatgtagatatgattaaggctggaatcattgatccagtgaaggtgatccgcactgcacttcaagatgctgcaagtgtttccttgctgatgacaaccacagaagctgccgtttctgagctcccagcaacgaaggccagaatagccagccgcatgccgcaaatgagtggaatggatttttgaggacgactccacctgatgtatgattaacacgttcttggccaaaggtggtacttgggaacgaactttgtttccccggcgaacacacatctgtagagtttatactaaacaaggtgcaaagctggcacccagatgtgatttttggtgtggggccaatggtgattggttatgcaacctgaactaatttggagcctttcattttgtagactatgcatggtatgcaaatactgttagaattagtggaatttcgctgtgcactct

SEQ ID NO: 936 - DNA, 2035 bp, Panicum virgatum
cctcctactcctcgtcgccgtacactagccgccacaccagcacacacgcgcgcgtgaccatgtaccgggcggcggcgtcggcaatttcaaggtcctcctcggtgctgcgcaagcagctcgcgcggggcggcggcggggagccgcagcggctgtgggcgcgcgggtatgcggcgaaggaggtggccttcggcgtgggcgcccgcgccgccatgctgcagggcgtcaacgacctcgccgacgccgtcaaggtcaccatgggccccaaggggcgcaccgtgattatcgatgggtcctataaaggccctaaaatcacgaaggatggggtcactgttgcgaagagcgtggagttcgaggatagtgcgaagaatgttggtgcgaacctggtgaagcaagttgctgaagctacgaacaaggttgctggtgatggtaccacttgtgcaactgtacttacacaggcaattcttatggaaggatgcaaggctgtggcagctggtgtcaatgttatggacttgcgcaatggtataaacaaggcgataaattccatcactgctcacctcaaaagtaaagcatggaagatcaattccccagaagaaataaaccaggtagcaaccatttctgccaatggtgaaaaggaaattggagatctgatatcaaaggctatggaaaaagttggaaaggatggagtcattactattgttgatggcaaaacattggacaatgagcttgaagcagtacagggaatgaagctgtccagaggatacatatctccttactttgtgactgatgagagactcaaaaatgtgagatggagaaccctctgattcttatccatgacaagaaaatctcaaacatgaattctctccttccagtattagaaatttctatcaagaatcgcaggccccttctcattgtggctgaggatgtagaaggagaagctctatcaatgcttgtactgaacaagcatcgcgctggactcaaggtatgtgctgtcaaagctcctgggtttggtgataacagaaggcacaacctggatgatatggctgtgatgactgggggagaggttgttagcgaggaacgaggcttggatcttggcaaagttcagctacaaatgcttggcactgccaagaaggttactgtatctcttgatgatactatcatcctagatggtggaggtgacaaaaagcagatagaggagaggtgccaacagcttagagaatctattgacacaagcactgctatgtttgacaaagaaaaggcccaagagcgtttatcaaagttatctggaggtgttgctgtcctcaagattggtggagctagtgaagctgaagttggtgagaaaaaagatagggtaacagatgctctaaatgctgcaaagtgtgctgtggaggagggcatcgtgccaggtggtggagttgcccttctatatgcttcgaaggagctcgacaagattagcacagcaaatgaggatgaaaagattggagttcaaattatcaagaatgctttgaaggctcccttgatgaccattactgcaaatgctggcattgatggggctgtagtcatcgggaagctaactgaacaagatgaccttagtttgggctatgacgcagcaagaggtgagtatgtagatatgattaaggctggaatcattgatccagtgaaggtgatccgcactgcacttcaagatgctgcaagtgtttccttgctgatgacaaccacagaagctgccgtttctgagctcccagcaacgaaggccagaatagccagccgcatgccgcaaatgagtggaatggatttttgaggacgactccgcctgatgtatgattaacacgttcttggccaaaggtggtacttgggaacgaactttgtttccccggcgaacacacatctgtagagtttatactaaacaaggtgcaaagctggcacccagatgtgatttttggtgtggggccaatggtgattggttatgcaacctgaactaatttggagcctttcattttgtagactatgcatggtatgcaaatactgttagaagcag

SEQ ID NO: 937 - DNA, 1802 bp, Triticum aestivum
agagaccgaacagatcccccaaggtcaccaaggacggggtcaccgttgccaagagcatagagttcgaggacagcgccaagaatgttggggcgagcctggtgaagcaggtcgcggatgccactaacaaggcagcaggagatggtaccacttgcgcaactgtgcttacacaggcaattctcacggaaggatgcaaggctgtggcagcaggggtcaatgttatggatttgcggaaaggcataaacaaggctataagcgccgtcactgctcacctcaaaagtaaagcatggatgattgattccccagatgaaataaaccaggtagctacaatttctgcaaatggcgaaaaggaaattggagatctgatatcaaaagctatgggaatagttggaaaggatggcgtcattactattgctgatggcaaaacattggataatgagcttgaagcagtccagggaatgaagttgactagaggctacatatccccttactttgtaactgatcagaagactcagaaatgtgagttgaaagatcctctgattcttattcatgacaagaaaatctcaaacatgaattcacttcttccagcagtgcaaatttctatccagaaccgcagacctcttctcatttttgctgaggatgtagatggagaagctctatcaatgcttgtactgaacaagcatcgtgctggactaaagatatgtgctgtcaaagctcctggatttggtgaaaacagaagggccaatctggatgatatggctgttttaacaggagggcaggttattagcgaggaccaaggtcttgatcttgataaagttgaactacaaatgctcggcacagctaagaaggttactgtatctcttgatgacactatcattctagatggtggaggtgaaaggcaacagatagaagagaggtgtcaacagcttagagaatcacttgagaacagcacctccatgttcgacaaagaaaaggctcaagagcgtttatcaaaattatctggaggcgttgctattctcaagattggtggagctagtgaagctgaagttggtgagaaaaaagacagggtaacagatgctctaaatgctgcaagggctgctgtggaggagggtattgttccaggtggtggagttgcacttttatatgccaccaaggagctcgacaatattagcacatcgcatgaggatgaaaagattggagttcagattatcaagaatgctttgaaggcccctctgatgaccatagctgcaaatgccggcatcgatggtgccatagttattgggaagctactggaacaagataatcttagtctgggctatgatgcagcaaaaggggagtatgttgacatgatcaaggctggtatcatcgaccccgtgaaggtgatccgaactgcacttcaagatgcagcaagcgtttctctgctgatgacaaccacagaggctgcagtcgctgagctcccgtcgacaaaagccagaattgccagtcgcatgccggacatgagcggaatgggtttctgaggtcgagtgcggcatgccgtctcatttgcctgtttttggttaaagacatgacaaactttaactcccccggtctatacatgaatagagattcccctccctatcaagtgagaggtgcaaagctggcacctattttggtttctgaaaaactcatggttcagtgctgatgtagccttaactagatttagaaccctttcattttgggtcaaaactcagatagattctgacaagacaagcatttggggctttgaatgtttactgggcaacgcctggtgttattgaagtgcttct

SEQ ID NO: 938 - DNA, 1446 bp, Secale cereale
gcatgaggggttcgcggtggtgctgctgctgcttcggcggaggcggcggcggggccgggcgctcggggagcgtggccgacgacgggctgctgtgggacgtgggcctcaaggcgcacgcctccggcgagtactccgtcgccgtcgcgcaggccaacgaggcgctcgaggaccaggcgcaggtgctcgtctcccccgccgccacgctcgtcggcgtctacgacggccacggcggccccgacgccgctcgcttcgtcaacgcgcgcctcttctccctcatccaagagttcgcgtcccagagcgggggcctgtcggcgcaggtgatcaagagggccttcggcgccacggaggaggagttcatgggcatggtggagaggtcgtggccgtcgcagccgcggctcatgtccgtcggctcctgctgcctggtgggcgccatcgaggacggcacgctctacgtcgccaacctgggcgactcgcgcgccgtgctgggccgcctcgccagcacggggggcaagaagcggagggcggtggtggcggagcggctgtcgcgggaccacaacgtggccgacgaggaggtgcggcgggaggtggcggaggcgcacccggacgacccgcacatcgtgatgagcagccacggcgtgtggcggatcaaggggatcatccaggtgtcccggtccatcggggacgcgtacctgaagcggcccgacctgtgcagcccggcggtgatgcagtcgctctgcccgttcccgctgcgccgcccggtgatgagcgccgtgccgtcggtcacgtcccgcaggctgcgcccgggcgaccagttcatcatcttcgcgtccgacgggctgtgggagcagctcagcgacgaggccgccgtgggcatcgtgtcccggagcccgaggaagggcgtggcgatgaggctggtgcgggccgcgcagctggaggcggccaggaagaaggacatcaagtacgagagcatcgcggccatcgagaagggccggaggcggcgcttccacgacgacatcaccgtcgtcgtgctcttcctcgacagcaggtgcgagggcacgccgcagccgacggccggcgccggcgggatcgacggcacgcgcgcccccgtcgacgtgttctcgctcggccccgacgaccacggggacgacccgaccaggcccgtgctgctgcgctgatcgttctgccggccggtcaagtcggtcagcgacgtcgatggtcaccgaacgtggtactgaaaacgtgctagcggcgttaattttcagcgacttttgctctctgaaacggaagatacgggagcatgcgttccttgcttcctgcgtcgaattaagaggagaatttatgtctaattagttgtgtagataagcagtgccgtgtcgtgttggtttgcagagaagtaagtggtactactctgtgcttaagcttcttctgcgatcaattcagaggttg

SEQ ID NO: 939 - DNA, 1533 bp, Triticum aestivum
actcccttggcctcctcctccgcacctcattcacaccacccccaactcacgatcgatcgctagcctcgccggagcatgaggggttcacggtggtgctgctgctgcttcggccggggcggcggcggggccgggcggtcggggagcgtgggcgacgacgggctggtgtgggacgtgggcctcaaggcgcacgcctccggcgagtactccgtcgccgtggcccaggccaacgaggcgctcgaggaccaggcgcaggtgctcgtctcccccgccgccacgctcgtcggcgtctacgacggccacggcggccccgacgccgcccgcttcgtcaacgcgcgtctcttctccctcatccaagagttcgcgtcccagagcggaggcatctcggcgcaggtgatcaagagggccttcggcgccacggaggaggcgttcatgggcatggtggagaagtcgtggccgtcgcagccgcgtctcatgtccgtcggctcctgctgcctggtgggcgccatcgagggcggcacgctccacgtcgccaacctgggcgactcgcgcgccgtgctgggccgcctcgccagcacgggcgggaagaagcggagggcggtggtggcggagcggctgtcgcgggaccacaacgtggccgacgaggaggtgcggcgggaggtggcggaggcgcacccggacgacccgcacatcgtgatgagcagccacggcgtgtggcggatcaaggggatcatccaggtgtcccgctccatcggggacgcctacctgaagcggcccgacctgtgcagcccggcggtgatgcagtcgctctgcccgttcccgctgcgccgcccggtgatgagcgccgtgccgtcggtcacgtcccgcaggctgcgccccggcgaccagttcatcatcttcgcgtcggacgggctgtgggagcagctcagcgacgaggccgccgtgggcatcgtgtcccggagcccgaggaagggcgtggcgatgcggctggtgcgcgccgcgcagctggaggcggccaggaagaaggacatcaagtacgagagcatcgcggccatcgagaagggccggagaaggcgcttccacgacgacatcaccgtcgtcgtgctcttcctcgacaacaggtgcgagggcacgccgcagccgacggccagcgccggcgggatcgacggcacgcgcgcgcccgtcgacgtgtccccgcgcggccccgacgaccacggggacgacccgaccaggcccgtgctgcgctgaatcaatccgccagccggtcagtcggtcagcgacgtggacgctcaccgaacgtggtaccgtaaacgtggtagcggcgttaattttcggcgacttttgctctctggaacggaagatacgggagcatgcgttctttgctttccgcgtcgaattaagaggattattatgtttaattagttgtgtagataagtagataagcagtgccgtgccgtgttggtgtgaagagaattaaatggtactctgtgcttaagcttcctctgtgatcaatttagaggttgctttgccccctcc

SEQ ID NO: 940 - DNA, 1295 bp, Leymus cinereus x Leymus triticoides
gcggcggtggggccgggcgctcggggagcgtggcggacgacgggctggtgtgggacgtgggcctcaaggcgcacgcctccggcgagtactccgtcgccgtggcgcaggccaacgaggcgctcgaggaccaggcgcaggtgctcgtgtccccggccgccacgctcgtcggcgtctacgacggccacggcgggcccgacgccgctcgcttcgtcaacgcgcgcctcttctccctcatccaagagttcgcgtcccaaagcgggggcctctcggcgcaggtcatcaagaaggccttcggcgccacggaggaggagttcatgggcatggtggagaagtcgtggccgtcgcagccgaggctcatgtccgtgggctcctgctgcctggtgggcgccatcgaggacggcacgctctacgtcgccaacctcggcgactcgcgcgccgtgctcggccgcctcgccagcgcggggaagaagcggagggcggtggtggcggagcggctgtcgcgcgaccacaacgtggccgacgaggaggtgcggcgggaggtggccgaggcgcacccggacgacccgcacatcgtgatgagcagccacggcgtgtggcggatcaagggggtcatccaggtgtcccggtccatcggggacgcatacctgaagcggcccgacctgtgcagcccggcggtgatgcagttcctctgccccttcccgctgcggcggccggtgatgagcgccgtgccgtcggtcacgtcccgcaggctgcgccccggcgaccagttcatcatcttcgcgtcggacgggctgtgggagcagctcagcgacgaggccgccgtgggcatcgtgtcccgcagcccgaggaagggcgtggcgatgaggctggtgcgggccgcgcagctggaggcggccaggaagaaggacatgaggtacgagagcatcgcggccatcgagaagggccggaggcggcgcttccacgacgacatcaccgtcgtcgtgctcttcctcgacaacaggtgcgagggcacgccgcagtcgacagtcggcgccggcgatatcgacggcacgtgcgcccccgtcgacgtgttctcgctcggccccgacgaccaggaggacgacccgaccaggcccgtgctgcgctgatcattctgccagccggtcagtcggtcagcgacgtcgatgctcactgaacgtagtaccgtaaacgtgctagcggtgttattttcagtgacttttgctctctgaaacggaagatacgggagcatgcgtcctttgctttctgcgtcgaattaagaggattattatatatta

SEQ ID NO: 941 - DNA, 1395 bp, Secale cereale
tcagaaggaaagcagctagccagacaaagaccacctgcgcgttgggtgccactgtgctgagcaattctttggttctttggattcttccgtctgcgacaggagattgctggttgtttgctcggccacgaggagggatggaccggctgctgctgccggtgagggtgaaggaggagtggccgccgccgctgccggaggaggaggaggagttggagcatcggggcctggcgccgcggccgatggaggggctgcacgagacggggccgccgccgttcctgaccaagacgttcgacctggtggccgacccggccaccgacggcgtcgtctcctggggccgcgccgggaacagcttcgtcgtctgggacccgcacctcttcgccgccgtgctgctcccgcgcttcttcaagcacagcaacttctccagcttcgtccgtcagctcaacacctactagatggatcaagacaccggctgaagctacaagaatctgcttatttcttctagaagacccctttcatcaccatcaagcaatataggttttagaaagattgatccagatagatgggaattcgcgaacgagggtttcattaggggccagagacagcttctgaagatgataaagagaaggagaccattgtcctatctcccttcatcacaacatcaggcccttggctcctgcctggaggtcggccagttcggatttgacgaagaaatcgaagtgctaaagcgcgacaagaacgccttgctcgcagaggtggtgaaactgaggcaggagcagcagagcacgagagctgacatgcgagccatggaagagaggctgcaccgcgcagagcagaagcagctccagatgatgggtttcctggcaagagcaatacagaaccctgacttctttctccagttgatccagcaacaaaataagctgaaggacctcgaggacggttaccggcgaagaggaggaggtccatcgacgtaatgccattccttggccctgaggggagcagtcagagtgagccactcgagtccacattcatatttgaggacagggagttttcagagctggagaatttggccatgaacattcaggggatcaggaagggcatggagggtgacagaggtggtcggaatcacggctgcggtgaggccgagctgactgacgacttctgggaggagctgctgagtgaaggaatgagggatgaagctgagatgctagagctggaaaggaggagatctagatatgtcgacgcctagcgaaaaagctgggtcatctaagtaacagcaatccaaactctacgagaattcataaccattaatatatataccattgtattgatagctatattgtatattgtagtgctaatttatagccatagactgattgtattgcggttccacaccgatta

SEQ ID NO: 942 - DNA, 2630 bp, Secale cereale
acggagaggccccggcagggttgcggtgatctcttctccttctcacgatgggggacattgccaaggacttgacagccggaaccgtcggagggatcgccaatctggttgttgggcacccatttgacaccatcaaggtcaagctccagagccagcccagccctgctccaggccagcttcctaagtatgccggcgcctttgatgctgtcaagcaaacggttgccgctgaagggccgaggggattgtataagggaatgggggctcctctcgctaccgttgcagccttcaacgctctcctgttcactgtgaggggccagatggagactctcttgagatctgagcctggggcgccattgacggtaaagcagcaggtcgtcgctggtgctggtgctgggcttgcggtctccttcctggcatgcccaacagagctgatcaagtgcaggttgcaggcccagagctctttagctgaagcaggtgctgtctctggcgtggcgctacccaaagggccaatggatgtggcgaggcatgtcatcagggacgctggcctcaaaggtctgttcaagggcattgtcccaacaatgggccgtgagatccccggcaacgccataatgttcggcgtgtacgaggccgtcaagcagtacatggccggtggtcgggacacgtcgggcctcggccagggctctctcatccttgctggggggctcgccggaggagcgctgtggctcacggtgtacccaaccgacgtcgtgaagagcgtgatccaggtggacgactacaagaagccgaggtactcggggtcgatcgacgcgctcaagaagatcgtcgcggccgacggggtcaagggcctgtacaaggggttcggccccgccatggcccgcagcgtcccagcaaacgccgccacctttgtggcctatgagatcacacggtcggccatgggctgactgacccaaggtgccggctctgcatccgtctcttctccgacgcgtctgaagtggcattacacggagcaactgagacagaattcaggaccatggcagacgaaagaaaggaaaattaaccattcttctttgctgcaacgttatttcccaaaaccttgcatagactggcagcaatggcaggatcgttggtgataataaaggttgagctttacctgtgctgtgcgtgtgtcatgcgtgtagtgagcgagtgtagtagttggtgatttggcttgtggtaatggttggctgggagtggattggccatccgacggcgatccaatggtgagggagcgattgtctgacggcgatgggggtgcgcctttgtgtttgttgggttgcatcgtctggtgagggggtgggtgggtggttctgggttagcttggcatctgaaccacctcacccttcttcctggcctgtatttttttgccgctggctagcggtgtgttctctcctcatctttcttctttgtggaggggcggattgagtgcagctccatttcggctcggagtcgagatgggggacgtggccaaggacctggccgccggcacggtgggcggcgcggcgcagctggtcgtcggccacccgttcgacaccatcaaggtgaagctgcagagccagcccacgccgccgcccggccagccgcccaagttcgccggcgccatggacgccgtcaagcagaccatctcggccgagggcccgcggggcctgtacaagggcatgggcgccccgctcgccaccgtcgccgccttcaacgccgtgctcttcaccgtcaggggccagatggaggccctgctgcgctccgagcccggcgccgcgctcaccgtcggccagcaggtcgtcgccggcgccggggctggtgttgccgtctccttcctcgcctgccccaccgagctcatcaagtgcaggctgcaggcgcagagcgcgctggccaccgccgctcctgccgccgctgctcctgccgcaggcggcgcggctgccaccgttaccgccacggccgctgccgcggtgaagtacggcgggccgctggacgtggcgaggcacgtgctgcggtcggagggcggcgtgcggggcctcttcaagggcttggtccccacaatggcgcgcgagatccccggcaacgcgctcatgttcggcgtctacgaggccacgaagcagtacattgccggcgggcaggacacgtcggagctgggcaggggctccctgatcctcgccggcggtgtcgcgggcgcggcgttctgggggtccgtgtacccgaccgacgtggtgaagagcaagctccaggtggacgacttcaagaacccaaagtactcgggctccatggacgcgttcaagaagataatcgccgccgacggggccaggggtctgtacagggggttcgggccggccatggcgcgcagcgtcccggccaacggcgcctgcttcctcgcctacgaggtgaccaggtccctgctctaggcggccagcaggccgctggtgctggccgctggttgctacgcatcgattgccattcttggcttcgttcttgttcctccaccctgatgattcagtttggacagtcctgtctctgtaacagaaaaccaagccatgtgtgcaaatcgaacgaaatttgcttttctttctttctttttgcgagaaggccaaggtcatatattaaaa

SEQ ID NO: 943 - DNA, 1248 bp, Secale cereale
cctcctcctcctcctcctctccgacggcgcggagacggagaggccccggcagggttgcggtgatctcttctccttctcacgatgggggacattgccaaggacttgacagccggaaccgtcggagggatcgccaatctggttgttgggcacccatttgacaccatcaaggtcaagctccagagccagcccagccctgctccaggccagcttcctaagtatgccggcgcctttgatgctgtcaagcaaacggttgccgctgaagggccgaggggattgtacaagggaatgggggctcctctcgctaccgttgcagccttcaacgctctcctgttcactgtgaggggccagatggagactctcttgagatctgagcctggggcgccattgacggtaaagcagcaggtcgtcgctggtgctggtgctgggcttgcggtctccttcctggcatgcccaacagagctgatcaagtgcaggttgcaggcccagagctctttagctgaagcaggtgctgtctctggcgtggcgctacccaaagggccaatggatgtggcgaggcatgtcatcagggacgctggcctcaaaggtctgttcaagggcattgtcccaacaatgggccgtgagatccccggcaacgccataatgttcggcgtgtacgaggccgtcaagcagtacatggccggtggtcgggacacgtcgggcctcggccagggctctctcatccttgctggggggctcgccggaggagcgctgtggctcacggtgtacccaaccgacgtcgtgaagagcgtgatccaggtggacgactacaagaagccgaggtactctgggtcgatcgacgcgctcaagaagatcgtcgcggccgacggggtcaagggcctgtacaaggggttcggccccgccatggcccgcagcgtcccggcaaacgcggccacctttgtggcctatgagatcacacggtcggccatgggctgactgacccaaggtgccggcgctgcatccgtctcttctccgacgcgtctgaagtggcattacacggagcaactgagacagaattcagggccatggcagacgaaagaaaggaaaattaaccattcttctttgctgcaacgttatttcccaaaaccttgcatagactggcagcaatggcaggatcgttggtgataataaaggttgagctttacctgtgctgtgcgtgtgtcatgcgtgtagtgagcgagtgtggtagttggtgatttggactttaaaagt

SEQ ID NO: 944 - DNA, 1262 bp, Triticum aestivum
ctcgactgaataaaccccgactccaaaagcagcagccccgcgattccgaatcccatttttccaatccagtcactcctcgctcgctcctcctcctctccgacggcgaggagacggagaggccccggcagggttgcggtgatctcttctccttctcgcgatgggggacattgccaaggacttgacagccggaaccgtcggagggatcgccaatctggttgttgggcacccatttgacaccatcaaggtcaagctccagagccagcccagccctgctccaggccagcttcctaagtatgccggcgcctttgatgctgtcaagcaaacggttgcggctgaagggcccaggggactgtacaaggggatgggggctcctctcgctactgttgcagccttcaacgctctcctgttcactgtgaggggccagatggagactctcttgagatcggagcccggggcgccattgacggtaaagcagcaggtcgtcgctggtgctggtgctgggcttgcggtctccttcctggcatgcccaaccgagctgatcaagtgcaggttgcaggcccagagctctttagctgaagcaggtgctgtctccggcgtggcgctacccaaagggccaatggatgtggcgaggcatgtcatgagggacgctggcgtcaaaggtctgttcaagggcattgtcccaacaatgggccgtgagatccccggcaacgccataatgttcggcgtgtacgaggccgtcaagcagtacatggccggcggtcgggacacgtcaggcctcggccagggctctctcatccttgccgggggcctcgccggaggagctctgtggctcacggtgtacccaaccgacgtcgtgaagagcgtgatccaggtggacgactacaagaagccgaggtactcggggtcgatcgacgctctcaagaagatcgtcgcggccgacggggtcaagggcctgtacaaggggttcggccccgccatggcacgcagtgtcccggcaaacgccgccaccttcgtggcctacgagatcacgcggtcggccatgggctgactgacccaaggtcccggcgccgccctaagtctcttctccgacgcggctgaagcggcgttccacggagcaactgagagataattcaggaccatggcaaacaaaagaaaggaaaaattaaccattcttctttgctgcgacgttgtttccgaaaaccttgcatagactggcagcaatggcaggatcgttggtgataataaaggttgagctttacctg

SEQ ID NO: 945 - DNA, 1157 bp, Secale cereale
ggatacggagaggccccggcagggttgcggcgatctcttctccttctcacgatgggggacattgccaaggacttgacagccggaaccgtcggagggatcgccaatctcgttgttgggcacccatttgacaccatcaaggtcaagctccagagtcagcccagccctgctccaggccagcttcctaagtatgccggcgccttcgatgctgtcaagcaaacggttgccgctgaagggcccaggggattgtatagggaatgggggctcctctcgctaccgttgcagccttcaacgctctcctgttcactgtgaggggccagatggaggctctcctgagatctgagcctggggcgccattgacggtaaagcagcaggtcgtcgctggtgctggtgctgggcttgcggtctccttcctggcatgcccaacagagctgatcaagtgcaggttgcaggcccagagctctttagctgaagcaggcgctgtctctggcgtggcgctacccaaagggccaatggatgtggcgaggcatgtcatgaggaacgctggcgtcaaaggtctgttcaagggcattgtcccaacaatgggccgtgagatccccggcaacgccataatgtttggcgtgtacgaggccgttaagcagtacatggccggcggtcgggacacgtctggcctcggccagggctctctcatccttgccggtggcctcgccggaggagctctgtggctcacggtgtacccaaccgacgtcgtgaagagcgtgatccaggtggacgactacaagaagccgaggtactcggggtcgatcgacgctctcaagaagatcgtcgcggccgacggggtcaagggcctgtacaaggggttcggccccgccatggcccgcagcgtcccggcaaatgccgccaccttcgtggcctacgagatcacgcggtcggccatgggctgactgacccaaggtcccggcgccggccaaagtctcttctccgacgcggctgaagcggcattacacggagcaactgagagagaattcaggaccatggcagacgaaagaaaggaaaattaaccattcttctttgctgcaacgttatttcccaaaaccttgcatagactggcagcaatggcaggatcgttggtgataataaaggttgagctttacctgtgc

SEQ ID NO: 946 - DNA, 1431 bp, Brachypodium distachyon
actgccctgcccgtgcgcgccgttcacgccaaattccaaaggatgggatctcgattgattctccttccgataaaaagcaagcaagaaaggcagctgctccagccaccaacccaaaccttgcctgtataaaccccgcgatttcgaatccatttgttccaatctaatcactcttactcctccgcttcccccgctccttcctcgcagcctgccaagcccgctgtcccacccgggtgtcgtgttcatctcgtcgtcttcgctcgatggggaacatagctaaggacttgactgctggaaccgtcggaggggtcgccaatctagtcgtcggccatccgttcgacaccatcaaggtcaagctccagagccagcccagccctgctccaggccatcttcccaagtatgccggcgccttggacgctgtcaagcaaactatcgcagccgaaggccccaggggattgtataagggtatgggggctcctctcgctactgtcgcggccttcaacgctctcctgttcgccgtaagggggcagatggagtccctcttgaggtcggagcctggggcacctttgactgtcaagcagcaggttgtcgctggtgctggtgctggctttgcagtctccttcctggcgtgcccgacagagcttatcaagtgcaggttgcaagcccagagctctttagctgaggcagcagctgcctccagcgtggcactacccaaagggccattggatgtggcgaagcatgtcatgaaggatgctggcttgaaaggtctattcaaaggactggtgcccacgatgggccgtgagatccctggcaatgccattatgttcggcgtgtacgaggccgtcaagcagtacatggccggtggccaggatacgtcgagcctcggccagggctccctcatcctcgctgggggccttgctggaggagctctgtggctcacggtgtacccgaccgacgtcgtgaagagtgtgatccaggtggatgactacaagaagccaaggttttcagggtcaatcgacgcgctcaagaagatcgtcacagctgatggtgtgaagggcttgtacaaggggtttggacctgcaatggcccgcagtgtccccgccaacgctgccaccttcgtcgcctacgagatcacaagatctgctatgggttgacccatgctccagcatcgtctccgtctcttctcatacacaactggaacaaagcaacatttcacagagctatcttagaactattggtgccatggcaagtttttttttttctttcgaactattcttcacggcaacatttgcatgtctgaaagacctcgcaaagattggcagcaatggcagggttgttgatgcaataagcttttaatatgtgcatgtgtcatgtgtggaggagtgattgtagctgttagtatggcttgtcgtaatggttggctgggagtggatt

SEQ ID NO: 947 - DNA, 1458 bp, Sorghum bicolor
gtgaaggtgaagtgcctgtcgactgtcgcagcagtagctgcccatgggccatgcccatcctcctcctcctgtccgcaggccgcacagcctataatatactccggctcggcggctcgcccacccgcctgccccgcggaacggcccccgtgaaccagcccagccgtccagccccactcggccactcccacccgcgaccaactccccctccttgaacgcttggggccttcccttgggagattggcaaccgacaaatcgatcgatcaatcagcgccccggccatccgcgattcgaatcggaaaatcaagccagagtcgcaggcagcggaggcggcggcgccccacctccacctccaactccacctccaccccgatcccggcaccggccccaagcccaagatgggggacgttgccagggacttgacggctgggaccgtgggaggggttgccaacctcgtcgtcgggcacccgttcgacaccatcaaggtcaagctccagagccagcctacccctgctcccggacagctccccaagtacgctggcgctatcgatgctgtgaagcagacgattgcggctgaaggcccaaggggcttgtacaaggggatgggggcacctctggccaccgttgcggccttcaatgctctcttgttcagtgtgagggggcagatggaggcccttctgaggtcagagcctggtgtgccactgactgtgaagcagcaggttgttgctggcgctggtgctggaatcgcagtctccttcttggcttgtccaacagaactgatcaagtgcaggttgcaagcccagagttccttagccgaggcagccgccgcttccggtgtggctcttcccaaagggccgatcgatgtggcgaagcatgttgtccgggacgccggcgcgaaaggtctcttcaagggcctggtcccaacgatgggacgagaggtccctggcaatgcgatgatgttcggcgtgtacgaagccacgaagcagtacctagcgggcggcccagacacgtcgaacctcggcaggggctcccagatcctggcgggtggcctcgccggtgccgccttctggctgtccgtgtacccgacggacgtggtgaagagtgtgatccaggtggacgattacaagaagcccaggtactctgggtccctcgacgcgctgaggaagatcgtggcggccgatggggtgaagggcctgtacaaggggttcggacccgccatggcgcgcagcgttccggccaatgccgcgacgttcgtggcctacgagatcacgagatcggcgctaggttgattggtgctgctggcctttgccatggcgctttgcccgtttattcattctccttgcgcggctggagcaacacgaacaatgccagacatttttttaggggggaaatgagaaaactttcacgtcagtgatgagatgctttaatgaagcaaagcttaattgaaagtctgttcctcat

SEQ ID NO: 948 - DNA, 1327 bp, Zea mays
ccgcggaacagcccccgtgaccgtgaaccaaccagttgtccagttccgctccggcactccacccacccacccagccaccccacgcccgcgagcgaccaactcccctctcgaacggttcgggcctttgcagtcgacagatcgatcaatcagcaccgaccactcgcgacccgattcgaatcgagccagagtcccaggcagcggcggcggcggcgcccgcctccaagaccacctccacccggaccccagccccaaccccaagttaacagatgggggacgttgcgaaggacttgacggctgggaccgtgggaggggctgccaacctcatcgtcgggcacccgttcgacaccatcaaggtcaagctccagagccagcccacccctgctcccggacagctccccaagtacgccggcgccatcgatgctgtgaagcagacggtcgcggctgaaggtccgaggggcctatacaaggggatgggggcacctctggccaccgtagcggccttcaacgctgtcttgttcagtgtcagggggcagatggaggcgtttctcaggtcagagcctggtgtgccgctgacagtgaagcagcaggttgttgcgggcgccggtgctggaatcgcagtctccttcttggcttgtccaacagaactgatcaagtgcaggttgcaagcccagagttccttagccgaggcagccaccgcttctggtgtggctcttcccaaaggtccgatcgacgtggcgaagcatgttgtccgggacgccggcgccaaaggtctcttcaagggcctggtcccgacgatgggacgcgaggtccctggcaacgcactgatgttcggcgtgtacgaagccacgaagcagtacctggccggcggcccggacacgtcgggcctcggcaggggctcccaggtcctggcgggcggcctcgccggcgccgccttctggctgtccgtgtacccgacggacgtggtgaagagcgtgatccaggtggacgattacaagaagcccaagtactccgggtccctcgacgcgctgaggaagatcgtggcggctgatggggtgaagggcctgtacaaggggttcggacccgccatggcacgcagcgttccagccaatgccgcgacattcgtggcctacgagatcacgagatcggcgcttggttgatttgattggtgctggcctttgccatggccctttgcagtttattcattctccttgcgcggctggagcaacgcgaacaatgcgagacaattttagggaggaaagagagagagaaacttttcacttcaatgatgagattctttaatgaagcaaagcttactaaaagtttgttc

SEQ ID NO: 949 - DNA, 1156 bp, Saccharum officinarum
cgattcgaatcggagcaagccagagtcccaggcagcggaggcggcggcgcccacctccacctccacccccaccccgacaccggcaccggccccaaccccaagatgggggacgttgcgaaggacttgacggctgggaccgagggaggggttgccaacctcatcgtcgggcacccgttcgacaccatcaaggtcaagctccagagccagcctacccctgctcctggacaactccccaagtacgctggcgccatcgatgccgtgaagcagacggtcgcggctgaaggccccaggggcttgtacaaggggatgggggcacctctggccactgttgcggccttcaatgctgtcttgttcagtgtgagggggcagatggaggcacttctgaggtcagagcctggtgtgccgctgactgtgaagcagcaggttgttgcgggcactggtgctggaatcgcagtctccttcttggcgtgtccaacagaactgatcaagtgcaggttgcaagcccagagttccttagccgaggcagccgtcgcttccggtgtggctcttcccaaagggccgatcgatgtggcaaagcatgtcgtccgggacgccggcgccaaaggtctcttcaagggcctggtcccgacgatggggcgggaggtccctggcaatgcagtgatgttcggcgtgtatgaagccacgaagcagtacctggccggcggcccggacacatcaaacctcggcaggggctcccagatcctggcgggtggcctcgcgggtgccgccttctggctatccgtgtacccgacggacgtggtgaagagtgtgatccaggtggacgattacaagaagcccaggtactccgggtccctcgatgcgctgaggaagatcgtggcggccgatggggtgaagggcctgtacaaggggttcggacccgccatggcgcgcagcgttccggccaatgccgccacgttcgtggcctacgagatcacgagatcggcgctaggttgattggtgctgctggcctttgccatggcgcttcgccgtttattcattctccttgcgccgctggagcaacacgaacaatgccagacattttttagggaggaaaaagaggaagagagaaaactttcacttcagtgatgagatgctttaatgaagcaaagcttaattg

SEQ ID NO: 950 - DNA, 1403 bp, Panicum virgatum
ccacgcgtccgcgaaccccgtgaaccaagcgagtggccccacgcgcgcgcgcgctacgcgagcgaccaactcccctagggctttgtccggcagcgcccgcgattcgaatcggagtctcggaccaacccagggccccaggcaggaggcccccaggcggcaccggcagcggcggcggcggcaccgacctccaccacccccggcgcccggccccgaccccgagatgggggacgttgtgaaggacttgacagccgggaccgtaggaggggctgccaacctggttgttgggcacccattcgacaccatcaaggtgaagcttcagagccagcccacccctgctcctggccaactccccaagtatgcaggcgccatcgatgctgttaagcagacgattgcagctgaaggcccgagaggcttgtacaagggaatgggggcacctctagcaactgtcgcggcattcaatgctctcttgttcagcgtgagggggcagatggaggctctcctgaggtcagaacctggtgcgccgctgaccgtgaagcagcaagttgttgctggtggtggtgctggaattgcagtctcattcttggcatgtccaacagaactgatcaagtgcaggttgcaagcccagagttccttagccgaggcagcagctgcctccggcgtagctctacccaaaggcccgatcgatgtggctaaacacgtcgtcagggacgctggcgcaagaggtctcttcaagggcctggtaccaacaatgggccgtgagatccccggcaacgcgttgatgtttggcgtgtatgaggccgcgaagcagtacctcgccggcggccctgacacgtcgaaccttggcattggatcccagatcctggctggtggcctcgccggtgcctccttctggctgtcagtgtacccgacggacgtggtgaagagcgtgatccaggtggatgactacaagaacccacggtactcagggtccctggacgcgctgaggaagatcatggcggccgatggcgtgaagggcctgtacaaggggtttggaccggccatggcgcgcagcgtccctgccaatgctgctaccttcgtggcgtacgagataacaagatcggcgctcggttgattggctgcgactccagtgccattgccaatccttttgatggcatacggctggaggctggagctgctgcatcttcgatagctactcaggatggaaacacaggcacgccttgcaagtgcaacccagaactgtacaattgcaagcatttttagggagaaaaaaagagggaacactgcaatggtgagattgtttaataagcaagcttaataagacgttcatggatggattgagtgagagtggttgctgatagaaaaataatactgtcctcgtcgtgatggttgcccatccgacggtg

SEQ ID NO: 951 - DNA, 2660 bp, Setaria italica
cagatgggggaagttgtgaaggacttgacagccgggactgtaggaggggctgccaacctgattgttgggcaccccttcgacaccatcaaggtgaagctccagagccagcccacccctgctcctggccagctccccaagtatgcaggcgccatcgatgctgttaagcagacgattgcagctgaagggcccaggggcttgtacaagggaatgggggcacctctagccaccgttgctgccttcaatgctctcttgttcagtgtgagggggcagatggaggctctcctcagggaagaacccggtgtggccctgacggtgaagcagcaggttatcgcaggagctggtgctggacttgcagtctccttcttggcgtgtccaacagaactgatcaagtgcaggttgcaagcccagagttccttagccgaggcagcagccgcttccggcgtggctctacccaaaggcccgatcgatgtggcgaagcacgtggtgcgggatgccggtgcgaagggtctcttcaaaggccttgtcccgacgatgggtcgcgaggtccccggcaacgctttgatgtttggcgtgtacgaagccaccaagcagtacctcgcgggtggccgggatacttctaacctcggcaggggctcccagatcctggctggtggcctcgctggcgccgccttctggttgtccgtgtacccaactgacgtggtgaagagcgtggtccaggtggacgactacaagaaccctaggtactccgggtccctcgacgcgctgaggaagatcgtggcggctgatggcgtgaagggcctgtacaaggggttcggaccggccatggcacgcagcgtccccgccaatgctgctacgttcgtggcgtacgagataacgagatctgctctcggttgatgggctgctactccagtgccactgccatttcttctgctggcacggctggaactgctacatcttccatagcaacacaggatggagcaaaggcacgccttgcatgtgcaacccagaaattgtacaattgcaagcatttttttagggtggaaaaggggggaacttttggctgcaatggtgactgttgggattgtttaataagcaagcttcataagatgttgatgggtgtagtgagtgagtgtgatggtggttgcgcgatggtggtggactggtggcctttgctttgttgggttgtggcgtctggtggcgagtggccccctcgtcagcaggttgtcgtctccctttcttggccttggcttattggcctggatattattccctcttttccgccatattttgctctctctctctctctcttttttgcagtggtatatgcgccgtgcatttattagtatcgcattgccgctcaggttggtgtggaggagcgctgggccgtacgtaggtggagtcgagtcgtgttcgttgggtgaggaggaggcacccgtccctgggctcctcctccattgccgacctccgccgctgccgcacctctccttgcacaaatggccgacgggagcacccactgaaatttgcagaacgtgcgccccgcagatgggtgacgtcgccaaggacctggccgccggcacggtgggcggcgcggcgcagctggtggtgggccacccgttcgacaccatcaaggtgaagctgcagagccagcccacgccgccgccgggccggccgcccctctacgccggcgccggcgacgccgtcaggcagaccctggccgccgagggggcccggggcctctacaagggcatgggcgcgccgctcgccaccgtcgccgccttcaacgccgtcctcttcaccatcaggggccagatggaggccgtgctgcgctccgagccaggcgtgccgctcaccgttggccagcaggtcgttgccggcgccggcgcgggggtcgccgtctcgttcctggcgtgccccaccgagctcatcaagtgcaggcttcaagcccagagcgccttggcagcggccgctcccgccgccgccgctgcaggcgcaggaggcgctgccgccgccaccgtcgccgccccagccgtggccgtgaagtacggcggcccgatggaggtcgcgaggcacgtgctcagatcggagggcggcacgcgcgggctcttcaaggggctcttcccgacgctggcgcgcgaggtgcccggcaacgccatcatgttcggcatgtacgaggcgatcaagcaggccctcgccggcgggcaggacacgtcgcagctcggccggggctcgctgatcctggcgggcgggctcgccggcgcctccttctggggccccgtgtacccggccgacgtggtcaagagcgtgctccaggtggacgactacaagaaccccaagtactcgggctccatggacgccttcaggaagatcctcgccgccgacggcgtgaagggcctctacaaggggttcggccccgccatgttgcgcagcatgccggccaacggcgcctgcttcttggcgtacgaggtgaccaggtccgcgctagggtgatgatcggttgcgtgctagactgatggcaccgtttcaatgccttgtgatctttgtttcccacctctactgatccatgtcatgatggcgatgatgaattgatgataatgatgatcgtgtcgattgtcgagatcaggtcaattcccctgtgaaggagagtttatttacaaaatctg

SEQ ID NO: 952 - DNA, 2132 bp, Panicum virgatum
ctggattggtcgcatcgcatcgctggacgctggtgaagaaggcgaaggtcggaaggtgggtgtgtgactctgcgcccactcctgctgccgccgcctgtgcctatatactctactccggctcgcccacccggagccggagcagaacgaaccccgtgaaccaagcgagtggccccacgcgcgcgcgcgctacgcgagcgaccaactcccctagggctttgtccggcagcgcccgcgattcgaatcggagtctcggaccaacccagggccccaggcaggaggcccccaggcggccggcaccggcagcggcggcggcggcaccgacctccaccacccccggcgcccggccccgaccccgagatgggggacgttgtgaaggacttgacagccgggaccgtaggaggggctgccaacctggttgttgggcacccattcgacaccatcaaggtgaagcttcagagccagcccacccctgctcctggccaactccccaagtatgcaggcgccatcgatgctgttaagcagacgattgcagctgaaggcccgagaggcttgtacaagggaatgggggcacctctagcaactgtcgcggcattcaatgctctcttgttcagcgcgagggggcagatggaggctctcctgaggtcagaacctggtgcgccgctgaccgtgaagcagcaagttgttgctggtggtggtgctggaattgcagtctcattattggcatgtccaacagaactgatcaagtgcaggttgcaagcccagagttccttagccgaggcagcagctgcctccggcgtagctctacccaaaggcccgatcgatgtggctaaacacgtcgtcagggacgctggcgcaagaggtctcttcaagggcctggtaccaacaatgggccgtgagatccccggcaacgcgttgatgtttggcgtgtatgaggccgcgaagcagtacctcgccggcggccctgacacgtcgaaccttggcattggatcccagatcctggctggtggcctcgccggtgcctccttctggctgtcagtgtacccgacggacgtggtgaagagcgtgatccaggtggatgactacaagaacccacggtactcagggtccctggacgcgctgaggaagatcatggcggccgatggcgtgaagggcctgtacaaggggtttggaccggccatggcgcgcagcgtccctgccaatgctgctaccttcgtggcgtacgagataacaagatcggcgctcggttgattggctgcgactccagtgccattgccaatccttctgatggcatacggctggaggctggagctgctgcatcttcgatagctactcaggatggaaacacaggcacgccttgcaagtgcaacccagaactgtacaattgcaagcatttttagggagaaaaaaagagggaacactgcaatggtgagattgtttaataagcaagcttaataagacgttcatggatggattgagtgagagtggttgctgatagaaaaataatactgtcctcgtcgtgatggttgcccatccgacggtgatccgatggcgttggagtggtggtgctggtgatgttgatctgatggtggtggactggtggcctttgcattgttgggttgcggcgtctggtggcgagtggcccaccattggccttgtgcccttgtcctcctcgcagcctgaattttattccctccctttctgcatattgttttctttttgtttgtttgggagtggaatatctcccgtgctttttggtactccaagttgccgctctggttggtgtgggggagccgccagctcagtggtacgtgggtggaatccagtcgagtcgttgggtgcggaagaggctccgcctccattgccggcatcggccgccggcgccggcggccgccgccgctcctctccttgcacaagtaaggattgttcccctgccgattaccttacatttggttgtgtatgggtattgctggtgctttctctctctctctccgatttgggattcgtcgaccaaacacggttctgccgatttttatcagacggtagcatgaatcagcccaagtgtttttcttttcgtttgttttgtacctcgcaaagcaatcttgttcttcacctctggcctgctagaacctgat

SEQ ID NO: 953 - DNA, 2179 bp, Panicum virgatum
cgccgcccacccggatcggagcagaacgacccccgtgaaccaagcgagtggccccacgcgcgccgcgcacgcgagcgaccgacccccctccccgctcgggggctcgggctttgtctttgtctttgtccggcagacgcccccgatcaatcggcgcccgcgattcgaatcggaaaatcgaatcggaccaacccaggcaggagacccccgggcggcggcaccggcagcggcggcggcgcccatctccaccaccccggcgcccggccccgaccccgaggaccgagatgggggacgttgtgaaggacttgacagccgggaccgtaggaggggctgccaacctggttgttgggcacccattcgacaccatcaaggtgaagcttcagagccagcccacccctgctcctggccagctccccaagtatgcaggcgccattgatgctgttaagcagacgattgcggcagaaggcctgaggggattgtacaagggaatgggggcacctctagccactgttgcggcattcaatgctctcttattcagtgtgagggggcagatggaggctctcctgaggtcggaacctggtgcgccgctgactgtgaagcagcaggttgttgctggtggtggtgctggaattgcagtctcattcttggcatgtccaacagaactgatcaagtgcaggttgcaagcacagagttccttagccgaggcagctgctgcctccggcgtagctctacccaaaggcccgatcgatgtggcaaaacatgtcgtcagggacgctggcacaagaggtctcttcaagggccttgtaccaacaatgggccgtgaggtccctggcaacgcgttgatgtttggcgtgtatgaggctgcgaagcaatacctcgccggcggccctgacacgtcgaacctcagcattggatcccagatcctggctggtggcctcgctggtgccaccttctggctgtcagtgtacccgacggatgtggtgaagagcgtgatccaggtggacgactacaagaacccacggtactcggggtccctggacgcggtgaggaagatcgtgggtgccgacggcgtcaagggcctgtacaaggggtttggaccagccatggcgcgcagcgtccctgccaatgctgctaccttcgtggcgtacgagataacaagatcggcgctcggttgattggctgcgactccagtgccattgccattccttctgctggcacggctggtggctggagctgctgcatcttccatagctactcaggatggaaacacaggcacgccttgcaagtgcaacccagaactgtacaattgcaagcatttttagggagaaaaaaagatggaacttctcgctgcaatggtgagattgtttaatattcaagcttaataagatggtcgtggatggattgagtgagtgtgtggttgctgatagaaaaataatactgcccgtgatggctggtctggagtggtttgcccatctgacggtgatccgatggcgttggagtagtggtgctggtgatagtgatctgatggtggtggactggtggcctttgctttgttgggttgtggcgtctggtggcgagcggccctcgtcagctcgtctccctttgctcggcccaccattggccttgtgcccttgtccccctcgcagcctgaattttattccctctctatctgcatattgttttctttttgtttgtttgggagcggaatatctcccgtgctttttggtgctccaagttgccgctctggttggtttgggggagccgccagctcagtggtacgtgggtggaatccagtcgagacgttgggtgcggaagaggctcagcctccattgccggcatcggccgccggcgccggcggccgccgcggctcctctccttgcacaagtaaggattgttcccctgccgattaccttgctcgtcgtcagacccagaccaatgtgtgcatttggttgcgtgtgggtattgctggtgctttatctctctccgatttggattcgtccaccaaacacggttctgtatatttttatcagatggtagcatgaatcagcatcagcccaagcgtttttcttggtttcgtttatttttttacccccttcgttccaaattattaattatttgaattgtaaattgtgtgataccatgtaagtggtggaaacgaagatgagcacaacaacaacgtttg

SEQ ID NO: 954 - DNA, 1256 bp, Panicum virgatum
gcgcccgcgattcgaatcggaaaatcgaatcggaccaacccaggcaggagacccccgggcggcggcaccggcagcggcggcggcgcccatctccaccaccccggcgcccggccccgaccccgaggaccgagatgggggacgttgtgaaggacttgacagccgggaccgtaggaggggctgccaacctggttgttgggcacccattcgacaccatcaaggtgaagcttcagagccagcccacccctgctcctggccagctccccaagtatgcaggcgccatcgatgctgttaagcagacgattgcggcagaaggcctgaggggattgtacaagggaatgggggcacctctagccactgttgcggcattcaatgctctcttattcagtgtgagggggcagatggaggctctcctgaggtcggaacctggtgcgccgctgactgtgaagcagcaggttgttgctggtggtggtgctggaattgcagtctcattcttggcatgtccaacagaactgatcaagtgcaggttgcaagcacagagttccttagccgaggcagctgctgcctccggcgtagctctacccaaaggcccgatcgatgtggcaaaacatgtcgtcagggacgctggcacaagaggtctcttcaagggccttgtaccaacaatgggccgtgaggtccctggcaacgcgttgatgtttggcgtgtatgaggctgcgaagcagtacctcgccggcggccctgacacgtcgaacctcagcattggatcccagatcctggctggtggcctcgctggtgccaccttctggctgtcagtgtacccgacggatgtggtgaagagcgtgatccaggtggacgactacaagaacccacggtactcggggtccctggacgcggtgaggaagatcgtgggtgccgacggcgtcaagggcctgtacaaggggtttggaccagccatggcgcgcagcgtccctgccaatgctgctaccttcgtggcgtacgagataacaagatcggcgctcggttgattggctgcgactccagtgccattgccattccttctgctggcacggctggtggctggagctgctgcatcttccatagctactcaggatggaaacacaggcacgccttgcaagtgcaacccagaactgtacaattgcaagcatttttagggagaaaaaaagatggaacttctcgctgcaatggtgagattgtttaatattcaagcttaataagatggtcgtggatggattgagtga

SEQ ID NO: 955 - DNA, 1424 bp, Panicum virgatum
tggcttgttcttacttagttaccatccagacagccggtgcttgatgcagaattctgccatgaatcatctttactggcaaattgaattacatggagctgatttttgttgcatttagcagatgggggacgttgtgaaggacctgacagccgggaccgtaggaggggcggccaacctgtttgttgggcacccattcgacaccatcaaggtgaagctgcagagccagcccacccctgctcctggccagctccccaagtatgcaggcgccatcgatgctgtcaagcagacgatcgcggctgaagggccgaggggcctgtacaagggaatgggggcacctctagccactgtagcggcattcaacgctctcctgttcaccgtcaggggccagatggaggccgtgctccgctccgagccaggcgcgccgctcaccgtcggccagcaggtcgtcgccggcgccggcgcgggggtcgccgtctcgttcctggcgtgccccaccgagctcatcaagtgcaggttgcaagcccagagctccttagccgaggcagcagccgcctccggcgtggctgtacccaaaggcccgatcgatgtggcgaagcacgtcgtccgggacgccggcgcgagaggcctcttcaagggcctggtgccgacgctggggcgcgaggtccccggcaacgcggtgatgttcggcgtgtacgaggccgcgaagcagtacctcgccggcggccccgacacgtcgggcctcggccgggggtcccaggtcctggccggcggcctcgccggcgccgccctgtggctgtcggtgtacccgacggacgtggtgaagagcgtgatccaggtggacgactaccggaacccgcggtacgcggggtccctggacgcgctgaggaagatcgtggcggccgacggcgtcaagggcctgtacaaggggttcgggccggccatggcgcgcagcgtccctgccaatgccgcgacgttcgtggcgtacgagataacaagatcggcgctcggttgattggctgcgacttgccattggagtggtggcctttgctttgttgggttgtgatgtctggtggcgacgtctccttttgcacagcccaccattggccctgtgccctttcatgaatcagctcaagtgttcttcgtttaatttgtttcgtatacctcgcaagtcgcaaagcaatctgttgcacctctggcctgccagatttatcccctgcgaggctgaggcactgctcgctgcgaaaaaggttcgccgggtggtggggtgtgctgttcagttacaatgcctgaacatctacatttcccctcgtgtcctctcatcagaacgaagttgttctgcctactttcatagatgttcccagtcaacattattacattaacaagaagccgcataatctgttattttaatacaatggtgttaaaaaaaa

SEQ ID NO: 956 - DNA, 4978 bp, Oryza sativa
ccttcccgtaatcgcgttcgtcatcatctatctcctccaccgcctgatcgcgccgccgccgtctcttttcacctacaaaaaccctaagcccaaaaatctccatcccccccgcccccagagatcccccaatccactcgattcgatccaatccggcgaggtacaggatgctgccggggtcggcggcgccggcggctgggagcggcatgttcgtgccaacgcagacggtgggcacggtgctgtgctgcatctgcggcgtggcgatgcagcccaacccggccaacatgtgcgcgcgctgcatccgcgcccgcgtcgacatcaccgagggcgtcccgcgccacgccgccgtcgtctactgccccgactgcacctcctacctccagccgccgcgctcctggctccgcgccggcccggagtcccccgagctcatgcagatcctcctccgccgcctcaaccgccccctcgcccgcctccgcgtctccctctccgccgccgagttcgtcttctccgagccccactccaagcgcctccgcctcaagctccgcctccgccgcgaggtcttcaacgccgtcgtcctcgagcagacccaccccgtcgagttcaccgtccacgatcgcctctgcgatgcctgcgcccgcgcccagtccaaccccgaccagtgggtcgccgtcgtccagctccgccagcacgtcccgcaccgccgcaccttcctctacctcgagcagctcctcctcaagcacggccaggcctccctcgccctccgcgtcgccgccgcccccggcggcctcgacttcttcttcggctcccgctcgcacgccgcccgcctcgtcgacttcctcgccaccgtcgcccccgtccagacccagaccgccaagcagctcgtctcccacgacaccaagagcaacgtctacaactacaagcacaccttctccgtcgagatctgccccatctgccgggaggacctcatcgcccttagccctcaggtgtcccgcgatcttggaggccttggacctatcgtcctctgcatcaaggtcaccaatgccatcgctctgcttgaccccctcaccctgcgtgtgcaccacctcgaggaaaagaagtacagggtctacaacttcaaggctgctctcaccagcaagcagctcgtcgagtacatcgtgctagacatcgagcacgagtcaccagagattaccattgacggatctcgctaccagttggcttatgcccaggtcgcccgggtctccgactttgggaaaaacgacaccatgttcaccgtgcggactcatcttggccacctgctgaatcctggagaccttgcccttgggtatgatctttatggtgccaacttgaatgatgatgacatggacacagctatgatgcgccacagtctgcctgaagtcattcttgttaagaagagcttcgccaagaggccacgcacacgccgatggaagctgaagaggcttccaatggaggaagatgctgtaaataaggccaagggggagctagagaagagggctgatgagtatgaggagtttctcagggacttggagcacaactctgatattagattccagattgatctatacaaggatgaggactacaggtcggagatggcatctactattggtgatgatgttcccactgtgccgattgaggaactaattgaggacctaagtcttggtgatgatgaggaggaggatgaaggtggggaaggcaaccaacatgctgttatggtgggatgagttaatatgtttacctgtgctgtgcttctgccttctggtgatggttgctgccaaccgcagatcatagtcacggacttgctacatgaacgaaaagcagcagccgggcgatgatagattacatcacggctgacgtgtactttgtccgggagacgagtagaaaaggacaagttgtatttcttcatctttctttggctcgtgccctacagtactccgcggctgcctgccaacccggtaatcgcagaggcaggtcatcgtcggatttgatcttgacggctgacccgtcccgccggcggtagctgcagccagtgcctcgccccccttccatataacaccaacctcctccgcgatcgcaatcgccaccaaccccatcgagaagcagacgccaccaccgcgattcgaatcgccgccgtctcaaactcaaaactcacagatcgatcagatcatgggggacgtggtcaaggacctggtggcgggcaccgtcgggggagcggccaacctcatcgtcggccaccccttcgacaccatcaaggtcaagctccagagccagcccacccctgcccccggccaattccccaagtacgccggcgccgtcgacgccgtcaagcagaccatcgccaccgagggccccaggggcctctacaaggggatgggtgcgccgctcgccaccgtcgccgccttcaacgccctcctcttcaccgtcaggggccagatggaggccctgctgcgctccgagcccggccagcctctcacggtcaaccagcaggtcgtcgccggtgcgggtgctggtgttgccgtctccttcctcgcttgcccaactgagctcatcaagtgcaggttgcaggcccagagtgctttagccgaggcagctgctgcttctggcgtagccctacccaaaggaccaattgatgtggcaaagcacgtcgtcagggaagccggcatgaagggtttgttcaagggccttgtccctacaatgggccgcgaggttcctggcaatgccgtgatgtttggtgtgtatgaaggcaccaagcagtacctcgccggtggtcaggacacatcaaacctcggcaggggctctctcatcctatccggaggccttgctggggcggtgttctggctctcggtttaccctaccgacgtcgtgaagagcgtgattcaggtggatgactacaagaagccaaggtactcagggtcagtcgacgctttcaagaagattctcgcggccgatggagtgaagggcttgtacaaggggtttggacctgccatggctcgtagtgtcccggccaatgctgcgacattcctggcgtatgagattacaagatcggctctaggctgattgattgctggttccaatggccatttctatctcttatcatggttgaaacaacaaccaggctgtgcagttgagggggggaaaaagcagcagtagcagttccaatcctgttttgcaagtttatttcatctgcaacattgtgattcaaaacattgaagtatggaagatgcaacagcgagcaagatcgctggctctgcattttttgtctgcctgtatgtataataatataagcctaacatgtgtggggtgtgggtgtggagtgagtgtagctgaaagaaactcgtcgtcttgtcggaatggttggcctggagtggattggccatctgacggcgatcccatggtgaggggagtgagtgatgctgtctgtgatggcgattgggggtgcgtttggtgagtgagtgagtgagtggccctggtgttgcttgccctcttggcatccgaatcacctctcctcttcttcttggtctgaatttttttgattccctctcaactagcatctttttaattggctgctattgccacagcccttgtattttagtactgagacctggggctctagttgttttgagccagttgagctgctgcagctttgggtgaggtggaggtaggaggcggcggccgctcccatccttccttcacctccatctatctccaagctcgatcttctgctgaatagagaggagatgggtgacgtggccaaggacctgacggccggcacggtgggcggggcggcgcagctggtcgtggggcaccccttcgacaccatcaaggtgaagctgcagagccagccgacgccgccgccggggcagccgcccaagttcgccggcgccatggacgccgtcaagcagacgctggcggccgaggggccgaggggcctgtacaaggggatgggggcgccgctcgccaccgtcgccgccttcaacgccctcctcttcaccgtcaggggccagatggaggccgtgctgcgctccgagcccggcgcgccgctcaccgtcagccagcaggtcgttgccggcgccggcgccggagtcgccgtctcgttcctggcctgtcccactgagctcatcaagtgcaggttgcaagcccagagcgcgttggcgtccgctgctcctgccgccgccgccgctgccgcctctcccgtcggcggaggcgcggccacggcgacggcgagcgtggcggcggtgaagtacggcgggccggtggacgtggcgaagcaggtgctgaggtcggagggcggcgtgggggggctgttcaaggggctggggccgacgctggcgcgggaggtgccggggaacgcgctcatgttcggcgtgtacgaggcgatcaagcagtacctcgccggcgggcaggacacgtcgtcgctggggcgggggtcgctggtggtggccgggggcctcgccggcgcctccttctgggggtcggtgtacccgacggacgtggtgaagagcgtcatccaggtggacgactacaagaaccccaagtactccggctccatggacgccttcaggaagatcctcgccgccgacggcgtcaagggcctctacaagggcttcggcccggccatggcgcgcagtgtccccgccaacgccgcctgcttcttggcctacgaggtcactcgctctgcactaggctgaactcatgtatcattacatcctcctccttcttgacccttaattttcttcttctgattctgattctgattcttgctgtcatccatctcatctgtggatgtaagaacagtgtaattctgtacacacaaatactatctttataaaaatttcctagatcacacaaactctctggtttagtggacttgttccgttggtgaattgttgatggtgagctaagcatggtaattctgtgatgctgttcggatgaatcgaaagggaaaaggggtctgcggagccgcatg

SEQ ID NO: 957 - DNA, 1162 bp, Eragrostis curvula
  misc_feature (9)..(9): n is a, c, g, or t
  misc_feature (20)..(20): n is a, c, g, or t
  misc_feature (945)..(945): n is a, c, g, or t
  misc_feature (960)..(960): n is a, c, g, or t
  misc_feature (990)..(990): n is a, c, g, or t
  misc_feature (1003)..(1003): n is a, c, g, or t
  misc_feature (1008)..(1008): n is a, c, g, or t
  misc_feature (1017)..(1017): n is a, c, g, or t
  misc_feature (1043)..(1043): n is a, c, g, or t
  misc_feature (1063)..(1063): n is a, c, g, or t
  misc_feature (1071)..(1072): n is a, c, g, or t
  misc_feature (1074)..(1074): n is a, c, g, or t
  misc_feature (1077)..(1077): n is a, c, g, or t
  misc_feature (1086)..(1086): n is a, c, g, or t
  misc_feature (1088)..(1088): n is a, c, g, or t
  misc_feature (1095)..(1095): n is a, c, g, or t
  misc_feature (1112)..(1112): n is a, c, g, or t
  misc_feature (1114)..(1114): n is a, c, g, or t
  misc_feature (1123)..(1124): n is a, c, g, or t
  misc_feature (1127)..(1127): n is a, c, g, or t
  misc_feature (1132)..(1132): n is a, c, g, or t
  misc_feature (1139)..(1139): n is a, c, g, or t
  misc_feature (1141)..(1141): n is a, c, g, or t
  misc_feature (1145)..(1145): n is a, c, g, or t
  misc_feature (1151)..(1151): n is a, c, g, or t
aggggtaangggtacagcangacaggacccctccccgctccgaccggcggcggcggcggcggaccacctcctgcttccgtcaaacgcccgaggatttagcatcagatgggggacgttgcaaaggacttgacggcggggaccgtcggaggggccgccaacctcatcgtcggccacccgttcgacaccatcaaggttaagctccagagccagcccaccccagcccctggccagctccccaagtactctggcgccatcgatgccgtcaagcagaccatcgcggctgaagggccgaggggcttgtacaaggggatggggcgccgctcgccaccgtcgcggccttcaacgctgtcttgttcagtgtgagggggcagatggaggctgtcctgaggtcggagcccggcgcgccgttgacggtcaagcagcaggttatcgcgggtgctggtgctggagtcgcggtctcgttcttggcgtgtccaacagagctcatcaagtgcaggttgcaagcccagagttccatggccgaggcagcggctgcttccggtgttgctctacccaaaggacccattgatgtggcaaagcacgtcgtccgtgatgccggcgcaaggggtctcctcaagggccttgtccccacgatgggccgtgagatccctggcaatgctgtggtgttcggcgtgtatgaggccaccaagcaacacctggccggtggcaaggacacatccaatctcggcagaggctcccagatcctggctggagggcttgccggcgcagcgttctggctctcggtgtacccgaccgacgtggtgaagagcgtgatccaggtggatgactacaagaaaccaaggtactcggggtccattgacgcgctgaagaagatcgttgctgctgatggcgtcaagggcctgtacaagggctttggacctgccatggctcgcagcgtacctgccnatgctgctacattcntggcgtatgagataacaagatcagcattangttgattgctganttgancaccattgnccattgccttgctgccgtggatggancaacaccttgccagcactcnaacggggnncnatnctttttcananatttttnggttgaaagtggtttgncnggcagccannggnaagtngtttaananccangcaagnttggtgattcc

SEQ ID NO: 958 - DNA, 1853 bp, Panicum virgatum
gagcgttcatgtcacggtgtcatcttctttggcacctccattgatggatggatgctacattgtaaatttctaactttgaaccaaccagctgacctgttcgtgttctgtgctgtgctgtttgtttgtttgttcctcagaaaagccaagctgacttgtttttctgtagtagggtcaatatgccagtgtagaattctttgcatggtacgttgatagttattttgcttatcggcttggcttggcttgttcttagtcaccatccagacaggcggtgcttgatgcagaattctgccatgaatctttactggcaaattgaatgaaatggagctgatgtttgttgcatttagcagatgggggacgttgtgaaggacctgacagccgggaccgtaggaggggctgccaacctgtttgttgggcacccattcgacaccatcaaggtgaagcttcagagccagcccacccctgctcctggccagctccccaagtatgcaggcgccatggatgctgttaagcagacgatctctgctgaagggccgaggggattgtacaagggaatgggggcacctctagccaccgtagcagcattcaatgctctcttgttcaccgttaggggccagatggaggccgtgctgcgctccgagccaggcgcgccgctcaccgtcggccagcaggtcgtcgccggcgccggcgcgggagtcgccgtctcgttcctggcgtgccccaccgagctcatcaagtgcaggttgcaagcccagagttccttagccgaggcagcccccgcctccggcttggttctacccaaaggcccgatcgatgtggcaaagcacgtcgtccgggacgccggcgcgagaggtctcttcaagggcctggtaccaacgatgggccgtgaggtccccggcaacgcggtgatgtttggcgtgtatgaggccgcgaagcagtacctcgccggcggccctgacacgtcgaacctcggcaggggatcccagatcctggccggtggcctcgccggcgccttcttctggctgtcggtgtacccgacagacgtggtgaagagcgtgatccaggtggacgactacaagaacccacgctactcggggtccctggacgcgctgaggaagatcgtggcggccgatggcgtgaagggcctgttcaaggggttcggaccggccatggcgcgcagcgtccctgccaatgctgctaccttcgtggcgtacgagataacaagatcggcgctcggttgattagatgcgactcccgtgccaatgtgccattgcccattgccattggagtggtggtgctggtgatagtgatctgatggtggtggaatggtggcctttgctttgctgggttgtggacttgtggcgtttggtggcgagtggccctcgtcagctcgtctccctttgcacagagcccaccattggccttctgcccttgcctgaatcagcccaagtgttcttcgtttgatttgttttgtacctcgcgaagcaatctgttttacacctctggcctgccagatttatccaatgtgtctctcctgtgaggctgagggcctgaggcactgctcgtcgcgaaaaatgttcgccggggtagtggagtgtgctgttccgttacaatgcctgaacattaccacgttattctgaaaaatagaagaatctatatcattggatgaagatcttctgacagtctttactagggtaaaaagttcatgttgaaaccagttaatagatacaacaaaaatagctaataacagtgttgctcaaaatttaattggtgtgctataagaaaaataattttatgtcaaggaaggagaagcaatgaatgaagggaaaataagaatgaaaaactaatataataca

SEQ ID NO: 959 - DNA, 1512 bp, Triticum aestivum
cccgccgcccgcgatggaggccctccacgaggagatgcccttcgacctctccttccacccctccgcgcccctcgtcgccacctccctcatcaccggcgagctccacatgttccgctacgccgacggtttgccgctggagaggttgttcgtggcaaaacctcacaaggactcttgtagggctgttcgttttgtggactcaggaactgcgattctgacgggatctgctgatatgtcgattgtcgcttctgatgtagaaacaggcaaagtcattgcccgtttggataatgcacatgatgacgccataaaccgccttgtgtgtcttactgaaactacagttgcttcaggcgatgatgacggttacattaaggtgtgggatactcggcaacgatcttgctgcaacacttttcaccgccatgaagattacatatcagatatgacctatgtagctggctcaaatcaaatattggctacaagtggtgatggaactttatctgtgaacaatctccggggtaacagagtaaagtcacaatctgaattttcagaagacgaactcctatctgtggtggtaatgaagaatggccaaaaagttgtttgtggaactccaagtggagctctattgttgtattcgtggggacattttaaggactgcagtgaccgttttctggggcacgcacagtctgttgataacttgctgaagctggatgaagaaactctgatatctgctgcagcagatggtgtgatcaggttagtgggtatcttaccgaatcagataatacagccgctagctgagcattcagaatttccaatcgaggcgcttggtttctcgcacgataggaagtacctaggcagcatttcacatgacaaaatgataaagctctgggacatggaggaactcctgggcggtccacagttaaatcaccagaacgacatgcccgaagccaacgcagccgtccatcacgacgagttgcctgaagccaacgcggccatccaccacgacgaattgcctgaagccaacgccgccgctggtcagcacgacgagttgcctgcagccaacgccgccgctgtcaaccacaaccagccggctgaagctgacagcgacgacgacgggatggacgtggacatggagccaagctcttccaacgtgtcgaggagcaagaagaaaggcaagggcaagaggctggacgggttcgcgccggacttctttgcagatctgtagcctgcccaggcgagggcaagaggccgcccttgagatgttaacttgtcaagggagcagttttgatgttgtctcagtatatcgggttgtaggaggaatgttttagtttatttataggcgtgaggtgtgtgaacttggctatcatagtaacgtgtatttccggctgcagatggccccctgaagtgaagcatacgtgtagtagtatcttttattgtctacggtatgtgcgtagccggccgcaggtaggcctgtcccgttttaaagaaagagctatgtacttttgcgtgcactcacgcgtc

SEQ ID NO: 960 - DNA, 1482 bp, Secale cereale
gatggaggccctccacgaggagatgcccttcgacctctccttccacccctccgcgcccctcgtcgccacctcctcatcaccggcgagctccacatgttccgctacgccgacggtttgccgctcgagaggttgttcgtggcaaaacctcacaaggagtcatgtagggctgttcgctttgtggactcaggaactgcgattctgacgggatctgctgatatgtcgattgtcgcttctgatgtggaaacaggcaaagtcattgcccgtttggataatgcacatgatgacgccataaaccgccttgtgtgtcttactgaaacgacagttgcttcaggcgatgatgacggttacattaaggtgtgggatactcggcaacgatcttgctgcaacacttttcaccgccatgaagattacatatcagatatgacctatgtagctagctcaaatcaaatattggctacaagtggtgatggaactttatctgtgaacaatctccggggtaacagagtaaagtcacaatctgaattttcagaagacgaactcctatctttggtggtaatgaagaatggccaaaaagttgtttgtggaactccaagtggagctctattgttgtattcgtggggacattttaaggactgcagtgaccgttttctggggcacgcacagtctgttgataacttgctgaagctggatgaagaaactctgatatctgctgcatcagatggtgtgatcaggttagtgggcatcttaccgaatcagataatacagccgctagccgagcattcagaatttccaatcgaggcgcttggtttctcacacgacaggaagtatctaggcagcatttcacatgacaaaatgataaagctctgggacatggaagaactcctgggtggtccgcagttaaaccaccagaacgacatgcccgaagccaacgcagccgtccatcacgacgagttgcctgaagccaacgcggccatccaccacgacgaattgcccgaagccaacgtcgccgctggtcagcacgacgagttgcctgcagccaacgccgccgccgtcaaccccaaccagctggctgaagctgacagcgacgacgacggcatggacgtggacatggagccaagctcttccaacgtgtcgaggagcaagaagaagggcaagggcaagaggctggacgggttcgcgccggacttctttgcagatctgtagcctgctcgtgcaagggcaggagggccgcccctgagatgctcacgtgccaaggagcagttttgatgttgtctcatcagtgtgtcgggttgtaggaggaatgttttatacggagtactagtttttttataggcctggggtgtgttgtgtgaacttggcttccaatatacagtaagcgtgtacttccgggccggctgcaaatggccccctgaagtgaagcgtacgtgtattactagtactccgtataaaacattcctcctacaacccgatatactgacgaga

SEQ ID NO: 961 - DNA, 1320 bp, Secale cereale
tttgccgctcgagaggttgtttgtggcaaaacctcacaaggagtcctgtagggctgttcgttttgtggactcaggaactgcgattctgacgggatctgctgatatgtcgattgtcgcttctgatgtggaaacaggcaaagtcattgcccgtttggataatgcacatgatgacgccataaaccgccttgtgtgtcttactgaaacgacagttgcttcaggcgatgatgacggttacattaaggtgtgggatactcggcaacgatcttgctgcaacacttttcaccgccatgaagattacatatcagatatgacctatgtagctggctcaaatcaaatattggctacaagtggtgatggaactttatctgtgaacaatctccggggtaacagagtaaagtcacaatctgaattttcagaagacgaactcctatctttggtggtaatgaagaatggccaaaaaattgtttgtggaactccaagtggagctctattgttgtattcgtggggacattttaaggactgcagtgaccgttttctggggcacgcacagtctgttgataacttgctgaagctggatgaagaaactctgatatctgctgcagcagatggtgtgatcaggttagtgggtatcttaccgaatcagataatacagccgctagccgagcattcagaatttcccatcgaggcgcttggtttctcacacgacaggaagtatctaggcagcatttcacatgacaaaatgataaagctctgggacatggaagaactcctgggcggtccgcagttaaaccaccagaacgacatgcccgaagccaacgcagccgtccatcacgacgagttgcctgaagccaatgcggccatccaccacgacgaactgcccgaagccaacgccgccgctggtcagcacgacgagttgcctgaagccaacgccgccgccgccaaccccaaccagctggctgaagctgacagcgacgacgacgggatggacgtggacatggagccaagctcttccaacgtgtcgaggagcaagaagaagggcaagggcaagaggctggacgggttcgcgccggacttctttgccgatctgtagcctgctcgtgcaagggcaagaggccgcccttgagatgctcacgtgccaaggagcagttttgatgtggtctcatcagtatatcgggttgtaggaggaatgttttatacggagtagtttatttatatgcccgaggtgtggtgttgtgaacttggctttcactatacagtagcgtgtacttccgggccggctgcaaatggccccctgaagtgaagcgtacgtgtattactagt

SEQ ID NO: 962 - DNA, 2323 bp, Secale cereale
caaccagcaccccagcagcgcgcgcgcggcaatggcggaccccgtcgagctcgtgcggcacgtctgcctccgtttcccgccgcggcgctccagagtgccgccgccacagccgcgatgcctcgtcatggctcgcctccgcctcccgggctctgccttgtcgctccggtgccgcgcgctcgacgccagcaagtcgtcggcggtcaagggggagccgagcgaggagtacgacgacgacgacgaggagccgtacttttccgtgacatcgtcgaggctgtcggaggtggactacctcggggagagcaccaagggggatttgaacgtgcgcaggaggcacctcgacgcgctcggtgggaatggaaagtcaacattgcatggtcctatagaggagatagcttggaaagaagcgagacaagctgaaacgttgcttagtgaccttggaattgcagatcctttaacagtaagacactctcctcgtggaattttctgcaccagaacactaaatcttcgatctatcagtgtcattggctatgacatggattatacattgattcattacaacgtgatggcctgggaagggcgtgcatatgattatgggatggccaacctgaagagcatgggttttcttgtagatgaccttgaatttgatcctgacctggttattaggggtcttattatggataaagtaaaaggaaacttggtaaaagctgaccgttttgggtacatcaagagggtcatgcatggtacccaaatgttgcccactcgtgctgtgagtgaaatatatggacgagagttggtggacctgcggaaagaagatacgtgggagttccttaatacccttttctctgtttcagaagctgtcatgttcatgcagatggttgacaagttggatcagggtttggtgcctgctgaacttgggccactggattacaaagggctgtacaatgctgtttccaaagcacttttccgagcacatgtagaaggtcaactcaagagcgagataatggctgagcccgagcgatttgtagagcctgatccagaactgcctctagctcttctagatcaaaaagaggctggaaaaaggttgcttcttattactaactcagattaccactatacaaacaaaatgatgaatcatgcattcaatcgctttcttcctaatgatatggggtggagagatctatttgaaatggttatagtctccgcgaggaaaccagagtttttccaaatttcgcatcccttgtacgaggttgtcactgacaatggattattgcgtccctgttttaaagcaaattcaggtggcctgtactctggtggttgtgctcagatggttgagaagtcactagatattcatggagatgaaatattatatgtgggggaccatatttttacagatgtaagccaatcaaaggttcatttacgatggaggacagcattaatatgccgagaactggaagatgagtttgaagcactaatccaaagccatgctcagaaagaaaagcttgtcacacttatacaacaaaaggaaattgtcggagaccttttcaaccaacttcgcctggctctgcagaggcgcacaaattcacgtcctgcacagacgcttgctgcaacttgtatgaatgatcaggagcttgcagaaagtatgcaaaagttgctcattgttatgcagagattggatgaaaagatcgtgccattgctggaatcagatggagaacttttcaataaaagatggggttggctgtcacgtgctggcctatgggacaagagtcatctaaccaggcaaattgagaaatatgctgatatatacacatcaagggtttcaaattttctacactatactccattcatgtatttccgatcacaagaacagacgcttgcacacgacgtccattcttattcccgcggtcaataacattggtgtcaacgagttacctctatatctaatcacgcgctgagactaggcgatggaaataagaagaattgcaacttggtaaggattgtgtggccgtagttgctgggctgcactaagctccttgatattgggcaaagactgctgattcgcgagatgttgcgatgctgggagtactattttttgttggagtgtaagtaatttatatggccgtgtgccagtacagctaaagtcattagctagttgtaagtttacacgattagattcttacagtaagtgactgtcgtggtcgtttgttttggttcggtgaggaataagaatgatgaccagtgtgatttttagcggaccatgtgaagtgttacacagcggagatccggcagtttatgtaacttaatttgtgcaaaacttatgtataat

SEQ ID NO: 963 - DNA, 2411 bp, Triticum aestivum
gggctcgcctccgcctcccgggctctgtcctgtcgctccggtgccgcgcgctcgacgccagcaagccgtcggcagtcaagggggagccgagcgaggagtacgacgacgatgaggagccgtacttttccgtgacatcgtcgaggctgtcggaggtggactacctcggggagagcaccaagggggatttgaacgtgcgcaggaggcacctcgacgcgctcggtgggaatggacagtcaacattgcatggtcctatagagcagatagcttggaaagaagcgagacaagctgaaacgttgctcagtgacctgggaattgcagatcctttaacagtaaggaactctcctcgtggaattttctgcaccaggacactaaatcttcgatctatcagtgtcattggctatgacatggattatacattgattcattacaacgtgatggcctgggaagggcgtgcatatgattatgggatggccaacctgaagagcatgggtttcctagtagacgaccttgaatttgatcctgacctggttattaggggtcttattatggataaagtaaaaggaaacttggtaaaagctgaccgttttgggtacatcaagagggtcatgcacggtacccaaatgttgcccactcgtgctgtgagtgaaatatatggacgagagttggtggacctgcggaaagaagatacatgggagttccttaatacccttttctctgtttcagaagctgtcatgttcatgcagatggttgacaagttggatcaggggttggtgcctgctgaacttgggccactggattacaaagggctgtacaatgctgtttccaaagcactttttcgagcacatgtagaaggtcaactcaagagcgaaataatggctgagcccgagcgatttgtcgagcctgatccagaactgcctctagctcttctagatcaaaaggaggctggaaaaaggttgcttcttattactaactcagattaccactatacaaacaaaatgatgaatcatgcattcaatcgctttcttcctaatgatatgggatggagagatctatttgaaatggttatagtctccgcgaggaaaccagagtttttccaaatttcgcatccattgtacgaggttgtcactgacgatggtttattgcgtccctgttttaaggcaaattcaggtggcttgtactctggtggtagtgctcagatggttgagaagtcactagatattcatggagatgaaatattatatgtgggggaccatatttttacagatgtgagccaatcaaaggttcatttacgatggaggacagcattaatatgccgagaactggaagatgagtttgacgcactaatcaaaagccatgctcagaaagaaaagcttgtcacacttatacaacaaaaggaaattgttggagaccttttcaaccaacttcgcctggctctgcagagacgcacaaattcacgccctgcacagacgcttgctgcaacttgtatgaatgatcaggagcttacagaaagtatgcaaaagttgctcattgttatgcagagattagatgaaaagatcgtgccattgctggaatcagatggagaacttttcaataaaagatggggttggctgtcacgcgctggcctatgggacaagagtcatctaaccaggcaaattgagaaatatgctgatatatacacttcaagggtttcaaactttctacactatactccattcatgtattttcgatcacaagaacagacgcttgcacacgacgtccattcttattcccgcgatcaataacattggtgtcaacgagttccctctatgtctaatcacgcgcggagactaggcgatggaaataagaagaattgcaagttggtaaggactgtgtggccgtagttgctgggctgcaccaagctcctggatactgggcaaagactgctgattcgcgatatgttgcgatgtgtaagtattattttttgcgggagtgcaagtaatttatatggccgtgtgccagtacagctaaagtcattagctagttgtaagtttttacacgattagattcttacagtaagcgactgtcgtggtcgtttgttttggtttggtgaggaataagaatgatgaccagtgtgatttttagcagaccatgtgaagtgttacacagcggagatccggcagtttatgtaacttaatttgtgcaaagcttatgtataatgaaccgatggaatctctattcatgaatgaaagatttcatcttctcgttgtaagcctatgttctgcacgccgccgggaggtccttggtacgtgcggttttcctggattatttgtgggaattgcctgtttcagtaaaattctactgaatccaggcgttttaattcgctgtatataggagcatttttcactgcttggaaagagtggtcagctatatat

SEQ ID NO: 964 - DNA, 4031 bp, Brachypodium distachyon
ccccactcgcccactttctcccacctcccccatccaatcttcgcttctctcgggcctgaccgaaagcagcggccagcccagcagtgcgcgcggcaatggcggaccccgtcgacctcgtgcagcgccactgcctccgcctctcgacgcggcttccgcctccgccgcagccgcgatgcctcgtcggggctcgcctccgcctcccgggctctcccctctcgctccggtgccgcgcgctcgacgccagcaagccggtggcggtggagggggataagagcgaggaggacgacgaatcgtacttctcggtgatatcgtcgaggctttccgatgtggactaccacggggagagcaccaagggggatttgaacgttcggagggagcacatcgacgcgctcggtgggaatggcaagtcaacattgcatggtcctatagaggagatagcttggaaagaagcgaaagaagctgaaacattgctcagtgacatgggaattgcagatcctttaacactgaggcactctcctcgtggaattttctgcaccaggacactaaatcttcgatctatcagtgtcattggctatgacatggattacacattggttcattacaacgtgatggcctgggaagggcgtgcatatgattttgggatggccaacctgaagagcatgggtttcccagttgatgaccttgaatttgatcctgacctggttatcaggggtcttattatggataaagtaaaaggaaacttggttaaagctgaccgttttggatacattaagagggtcatgcatggtaccaaaatgctgtccactcgtgctgtgagtgaaatatatggaagagaattggtggacctgcggaaagaaagtacatgggagttccttaatactcttttctctgtttctgaagctgtcatgttcatgcagatggttgacaagttggatcagggtttggtgcctcctgaacttgggccactggattacacagggctgtacaatgctgtttccaaagcactttttcgagcccatgtagaaggtcaactcaagagcgagataatggctgagcctgagcgatttgtagagcctgatccagaactgcctttagctcttctagatcaaaaagaggctggaaaaaagttgcttcttattactaattcagattacctctatacgaacaaaatgatgaatcatgcattcaatcgcttccttccgaatgatatgggatggagagatctgtttgaaatggttatagtctctgcgaggaagccagagttttttcaaatttcacacccattgtacgaggttgtaacaaatgatggattaatgcgtccctgttttaaagcaacttcagggggcttgtactctggtggtagcgctcagatggttgagaagtctctagacattcatggtgatgagatattatatgtgggggaccatattttcacagatgtaagccaatcgaaagttcatttaagatggaggacagcattaatctgccgagaactagaagatgagtttgaggcactaatccaaagccatgttcagaaagaaaagcttgtcacacttatacaacaaaaggaaatcgtgggagacctttttaaccaatttcgcctggccctgcagaggcgtacaaattcacgtcctgcacagacagttgctgctacttctatgaatgatcaggagcttacagaaagtatgcaaaagtcgctcattgttatgcagagattagacgaaaagattgcaccattgatggaatcggatggagaccttttcaataaaagatggggttggctgtcacgggccggcctttgggacaagagccatctaaccaggcaaattgaaaaatatgctgatatatacacatcaagggtttcaaattttctacactatactcctttcatgtatttccagtcacaagaacaggtactgtcaaaatttgtcatttgccacataggcactctcgccgtcctccgctccagcctgcgtggctcgtcactccctatcctcctcgcacaccgcaacagctgcacggtcagacgcaacgcaaagcgaaaaagcgccgcccgacggaaacggggtgcggcggcgatgttgcggcagatgcgatggatgacggacagggaagggaggtgggagctggacgtggagtccccggcgacgatggagggcacggcgcgcccggtcccgggcgacccgttgcccctcggcctctcgcggggcccccgcgtcacccgcaccaagcagctcgacttcttccaccgcttcatggcatccccgctcgtccccgccttcagcccctaccgcagcggcctctccctcgaccacgctcacctcttccacctcgccgagaactggtcttttactatcctggagcagcttcatgtaaagaagcttgtggaagtcgtgaaagagaagttgtcaaatcggcaagaaggagtcccctggaccaatgatctcaagaggcaattgcatgatgttatgtctctaggtgttggcacggaactcttgatcacaccagacaccactttgctgctagagctgtacaatatcaagaagggcgagcgaggcaaagcgattattaaccataagcttcctcaacaaaatcttaaattagaagcatcttggcctggattatttgtcgataaacaaggggtatactgggacgtgcctctgtcattatctgctgactttgcttcagttggctccagttctggattgagttatcgcctgttggtgcagcagaatagtggggaaccaaaatgttttggtggtgatgaaaccaatgatgttcctctcgctctgctgcctggattgtgtgttaaagcagctttttccatcaagaaaagcattgatgtctggaggaaaaaggaagacaagctaaaaatggttcagccatatgatgtatttctctcagaccctcatgtttcattcactaggattgttggtgccgtagccagtggttctttgggggattgttcaaaaagaatatctgtgcaagacgaaagaagcaatgcctttagagtgttcaatgataggaataagtttgctgcctttgcagacctctttgcttctgtcacttttacagctcagcatggaaattttcagaggcttttcctagatctgacaagggtaagtgcccgattagatatatcttcagggtcgttgttcttacgcggtgcttctcgtcttgcacaagatttcttcttctctagacggcctgatttagagacattctgcgacgtttgtccaaatacaattgtttctcttcaacaacagatagttgggccattcagctttcgtgttgagtcatcggttgccattgatccaagaagtcaagaccgtcttgttagagtagatgactcggttttcgctattgattgggccctgaaggtccttggttcagcaaaggccacggcttggtattcccccaagcatcaggaagcaatggtggagcttcgtttcttcgaggcctgatgccctgatggatagagattccagctcaccttaaaggccacatgacatagtcatggggtttcatggcctgatcataaaatttcactcgaatatcagatcagatggattggggttgctgtttttcatcaagcctatgcacatgacatcatcaaatttgtctgggattttagaagtttctattgatgctatagtaaggaaggagtggtagaatgttgattaccagtggtaatttagactttttacgtgcatatggtgtgggggccactcgtccttacctgtagagagacgcaagcactcggctttcaatctactcttctccagagagttcacgtgagggagaagaaaggagagggagacacgaagagctccaccaaggcaccaacgaagctgccatctctgtgcgcttccccatcagccggcggagattctccgtcgcgtgcttccgggaagccgaagagcctcctccgtgcgctgctgggtggtacacgagccgccgccgcctccgcaccctgccggaaggctttgataggctattcgcctccctgtgcctccccgttggctgcccgg

SEQ ID NO: 965 - DNA, 2348 bp, Setaria italica
tcgttgtcattttaaccggccccacttccccacttccccatccagtcctcgcgcaagctctcctcctcaccaaacggctggctagacccgccgccgccgcgcaccagcaatggcggacgccgcggagctcgtgcgcctcctccgcctccgagccgcgccgctgccgtcgcctccgcagcgctccggaccatcctcgcggccgcagcgcctgctcagagctctcccccgccgccgccctcccctctcgctccggtgccgcgcgctcgacgccagcaggccggcggcggtggagggagagcgtggcgaggaggacgtgttcgaggacgaggaggagtcctacttctcggtcacctcgtcggggctctcgcaggtggactacctcgggcagagcaccaggggtgatttgaacgtgcggagggagcgcctcgaggcgcttggtgggaatggcgagtcaacactgcatggccctattgaggagattgcttggaaagaagcaggagaagctgaaacgttgcttcatgacttgggaattgcagacccattttcagtaagacactctcctcgtggaattttctgcaccaggacactaaatcttcgatctatcagtgtgattggctatgatatggattatacattaattcattacaacgtgatggcctgggaagggcgtgcatatgattatgggatggacaaccttaagagcatgggtttcccagttgatgaccttaaatttgatcctgatctggtcataagaggtcttgttattgataaagaaaaaggaaacttggtcaaagctgatcgttttggttacattaaaagggccatgcatggtacccagatgctttccacttcttctgtgagtgaaatatatggaagagaattggtggacctgcggaaagaaagtcgatgggagttccttaatacccttttctctgtttctgaagctgtcatgttcatgcagatggtcgacaagttggatcaggggctggtgccagctgaacttggaccattggattacaaagggctgtacaatgctgtttccaaagcactttttcgagcacatgtagaaggccaacttaagagagaaataatggctgagcctgagcggtttgtagagcctgatccagaactgcctttagctcttcttgatcaaaaagaggctgggaaaaagttgcttcttattactaactcggattaccactatacaaacaaaatgatgaatcatgcattcaatcggtttcttcctaatgatgtgggatggagagatctttttgagatggttatagtctctgcaaggaagccagagtttttccaactttcacatccattatacgaggttgtaacagacgatgggttgatgcgcccctgttttaaagcaaattcaggtgggctatactctggtggcagtgctcagatggttgaaaagtcactagagattcatggggatgagatattatatgttggagaccatatttacacagatgtaagccagtcaaaagttcatttacgatggaggacagcattaatctgcagagaactagaagatgagtttgatgcactggtccaaagctatgatcagaaagaaaagcttgtcacacttatacaacaaaaagaaattgtgggggatctttttaaccagcttcgcctggctcagcagagacgctctaattcacgtcctgcacagacgcttgctgcaacttgtatggatgaccatgagcttacagaaagcatgcaaaagttgctcattgttatgcaaagattagatgaaaagattggacctatgctggaatcagatggagaactttttaataaaagatggggttggctgtcacgtgctggcttgtgggataagagtcatctgaccaggcaaattgaaaaatatgctgatatatacacatcaagggtttcaaattttctacactatactccattcatgtacttccaatctcaagaacagacgttagcccatgatggccattcttatgctcggggagaaaacattaaagttcaatgagcgttcaagtcaatgtggagaagacagggaagagaaacaaaatgattttgagtatgactggtggctaggctgtaacaattgtcgatttggagttttgaacagatgaccagagaatcttgtatgcatgtacaattaaaatcattagctcatagtatgctgaataaatcatgtagctcataatacgctgagtaaatcatgtactagtagttttgtcgtggccaaagaaaaaggttgtatttggtgagccacaacgacctatgttgtgtataccttcaatttgcattgtatatgtaaattgtgaagtatgacaagatgaagaccagtacatcacacc

SEQ ID NO: 966 - DNA, 2455 bp, Panicum virgatum
atggacccgtttactttttcgtcgtcattttaaccgggcccactccccacttccccatccgtcctcgcccaagctctcgtcctcaccaaacggctagactcgccgccgccgcgcgcgaagaaaccaatggcggacgccgcggagctcgtgcgcctcctccgcctccgggccgcgcagcggccgtcgcctccgcagcgccccggaccgtccccgcgggcgcagcgccttctcagagctctcccccgccgccgccgccctccgctctcgctccgttgccgcgcgctcgacgccagcgggccggcggcggtggagggggagcgtggcgaggaggacgtgttcgaggacgaggaggagtcctacttctcggtcacctcgtcggggctctcgcaggtggattaccttgggcagagcaccaggggggatttgaacgtgcggagggagcgcctcgaggcgcttggtgggaatggcgagtcaacactgcatggtcctattgaagagattgcatggaaagaagcggaagaagctgaaacattacttcatgacttgggaattgcagacccattttcagtaagacactctcctcgtggaattttctgcaccaggacactaaatcttcgatccatcagtgtgattggctatgatatggattacacattaattcattacaacgtgatggcctgggaagggcgtgcatatgattatgggatggacaaccttaagagcatgggtttcccagttgacgaccttaaatttgatcctgatctggtcataagaggtctcattattgacaaagaaaaaggaaacttggtcaaacctgaccgttttggctacattaagagggccatgcatggtacccagatgctttccactccttctgtgagtgaaatatatggaagggaattggtggacctgcgaaaagaaagtcgatgggagtttcttaatacccttttctcggtttcagaagctgtcatgttcatgcagatggtcgacaagttagatcaggggttggtgccagctgaacttggaccactggattacaaagggctgtacaatgctgtttccaaagcactttttcgagcacatgtagaaggccaacttaagagagaaataatggctgagcctgagcggtttgtagagcctgatccagaacttcctttagctcttcttgaccaaaaagaggctgggaaaaagttgcttcttattactaattcagattaccattatacaaacaaaatgatgaatcatgcattcaatcgctttcttcctaatgatgtgagttggagagatctttttgagatggttatagtctctgcaaggaagccagagtttttccaactttcacatccactgtatgaggttgtaacagatgatggattgatgcgcccctgttttaaagcaaattcaggtggcctatactctggtggcagcgctcaaatggttgagaagtcgctgaacattcatggggatgagatactatatgttggagaccatatttacacagatgtaagccaatcaaaagttcatttacgctggaggacagcattaatctgcagagaactagaagatgagtttgatgctctggtccaaagccatggtcagaaagaaaagcttgtggcacttatacaacaaaaagaaattgttggggatctttttaaccagcttcgcctggctcagcagagacgctctaattcacgacctgcacagacacttgctgcaacttgcatggatgatcaggagcttacagaaagtatgcaaaagctgctcattgttatgcaaagattagatgaaaagattggacctatgcttgaatcagatggagaactttttaataagaggtggggttggctttcacgtgctgggctatgggacaagagtcatctgaccaggcaaattgaaaaatatgctgatatatacacatcaagggtttcaaattttctacactataccccattcatgtatttccaatctcaagaacagacattagctcatgatgcccattcttattttcgcgaagaaagcattaaagtccaatgagcgtctattcaagtcaatgtggagagaagacggagagagaatgaaatgattttgagtgtggctatggctgctaggctgcaacagttgtccatttagattgatgagtgatgacccagaaaatcttgtataactgtatgcatgtacaagtaaaatcattagcagatagtacacagaataaaatcatggaaaatgattagctcatagcactggataaaatcgtgtagcagttgttttgtcgtggccaactaaaaggattttgatttagtgaggcacaacggccttttctttttgtgtagacctaccatttgaattgtacatgtaattctgaagtgtgacaagattaggcaagaacaacgcacgcagtaagaacataatacagcatttgagatcaaacactttgtgtgaggaagtttggccaaaa

SEQ ID NO: 967 - DNA, 2546 bp, Oryza sativa
ttctccctattttcaatttccacggtccacgggccggccccactgcccagtcagcccgatccgacgcccccatcccacaccaccaccactccccccccttctcgcggaggcacgaggctttactcgcgacgccccaaagccgcagcagcagcagcgccgcacgcggcagcaatggcggactccatcgagctcgcgcgccgcctctgcctccagcctccggcgcggaggacgggaacgggaaggtgcaggccgcggggccgcctcggagctccctccctccgcgtcccgcgccctcccctctccctctccctctccctctggtcgtcgctccggtgccgcgcgctcgactccaccaggccggtcgcggtggaggggggcctgggagacgaggaggacgaggatgaggagggggagtcgtacttcgccttgacctcgtcgaggctctcgcgggtggactacctaggggagagcaccaagggggatttgaacgtgcggagggagcatctcgacgcgtttggtgggaatggcaagtcgacattgcatggccctatagaggagatagcttggcaagaagcgagagaagctgaatcgttgctccgtgagttgggaattgcagatcctttttccgtaagacactctcctcgtggaatattttgcaccaggacactaaatcttcgatccatcagtgtcattggctatgatatggactatacattgattcactacaatgtgatggcttgggaagggcgtgcttatgattatggtatggccaatctgaagggcatgggtttccctgtagatgaccttgaatttgatcctgacctggtcatcaggggtctaattatggataaagacaaagggaatttggtcaaagctgatcgttttggttacattaaaagggccatgcatggcacccagatgctttctactagtgctgtgagtgaaatatatggaagagaattggtggatctacggaaagaaagtagatgggagttccttaatacccttttctctgtgtcagaagctgttatgttcatgcagatggtcgacaagttggatcaggggttggtgccagctgaacttgggccactggattacaaaggactgtacaatgctgtttccagggcactttttcgagcgcatgtagaaggtcaactcaagagtgagataatggctgagccggaacgatttgtagagcctgatcctgaactgcctttagctcttctggatcaaaaggaggctggaaaaaggttgcttcttattacaaactcagattaccactatacgaacaaaatgatgaatcatgcattcaatcgcttccttcctaatgatatggcatggagagatctgtttgaaatggttatagtctctgcaaggaagccagagtttttccaaatctctcatccgttatacgaggttgtaacaaatgatggattaatgcgtccctgttttaaagctaattcaggtggattgtactctggtggcagtgctcagatggttgagaagtcactagacatccatggagatgaaatattatatgtgggggatcatatttacacagatgtaagccagtctaaagttcatttacgatggaggacagcactaatctgcagagaactagaagacgagtttgatgcactaattcgaagccatgttcagaaagaacagcttatcacacttatacaacaaaaggaagtcgtgggagatctttttaaccagcttcggctggctctgcagagacgaacaaattcacgcccagcacagacgcttgctgctacttgtatggatgatcaggagcttacagaaagtatgcaaaagttgctcattgttatgcagagattagatgaaaaaattgcaccaatgctagaatcagatggagagctgttcaataaaagatggggttggctatcacgtacgggcctatgggataagagtcatctgacgaggcaaattgaaaaatatgctgatatatacacatcaagggtttcaaattttctacattatactccattcatgtatttccaatcacaagaacagacgcttgggcatgacgtgcattcctattcccggaggcaacaacactgacattcgttcgattcatcattcatgtggtggagttgggagaaaaatcggtagagatagaaaggcagctggatggacgtgcttgtgccagtgtgtgagccgtggcgattgatcttgatgcagcgaggcaggccatttggaacgttttcgcgttacgtagcgattatgtcgtgtatagctgtgtgtacttggggtgtaagtagagtcattagcttgtaataacacgattggaataagcccgtgcggtcgttttcttctttctgctcgccgactcaaaagaaatttggtttggttaggcagaacgaccgtggaaagttgggcatgtaatttgtaaacttttaagttttgtaagattttcatctgatcatctcagcatctgtctaaactctggactgtcacttgaaacagttaaattccagaaaaataagaagaagtcccattgttgtatgcttttttttcgtatg

SEQ ID NO: 968 - DNA, 2357 bp, Zea mays
gtcgattctactctacccggtcctcgcttccccgttctgtcctcgcggtcgcgcaggcgtaccaaacagctagggccgggggccgcagccgcgcacacagcaagcaatggcggacgccgccgagatggtgcgcctcctctatctccggaccccgccgcggccgttgctcccgcagttcgctgtacatacacatcggccacaaagtctgctcagagtttccccccgcttccgccctcccatccgtcttcggtgccgcgcgctcgacgccagtagaccggttgcggtggagggggagcgggatgaggaggacggtctcgaggacgaggaggagtcctacttctcggtcacctcgtcggggctctcggaggtggactacctaggggaaagcaccaggggggatttgaacgtgaggagggagcgcctcgaggcgcttgggaacagcaagtcaactttgcatggtcctattgaggagatagcttggaaagaagcgggagaagctgaaacattgcttcatgacttgggaattgcagacccgttttcagtaagacactctcctcgtggaattttctgcaccaggacactaaatcttcgatctatcagtgtagttggctacgatatggactatacattaattcattacaatgtgatggcctgggaaggacgtgcatatgactatgggatggacaacctcaagagcatgggttttccagtagatgaccttaaatttgaccctgacctggtcataagaggtcttgttattgataaagagaagggaaacttggttaaagctgatcgatttgggtacattaagagggccatgcatggtacccaaatgctttccactcgtgctgtgagtgaaatatatggaagagaattggtggacctgcggaaagaaattcgatgggagttccttaatacccttttctctgtttcagaagctgtcatgttcatgcagatggttgacaagttagatcagggattggtgccagctgaacttgggccactggattacaaaggactgtacaatgctgtttccaaagcactttttcgagcacatgtagaaggccaacttaagagagaaataatggctgagcctgatcggtttgtagagcctgatccagaacttcctttagctcttcttgatcaaaaagaggctggaaaaaagttgcttctcattactaattcagatttccattatacaaacaaaatgatgaatcatgcattcaatcgctttcttcctaatgatgtgggatggagagatctgtttgaaatggttatagtctctgcaaggaagccagaatttttccagctttcacatccattgtatgaggttgtaacagatgatggactgatgcgtccctgttttaaagtaaattcaggtggcttatattctggtggtagtgctcagatggttgagaaatcactagacattcatggggatgagatattatatgttggggaccatatttacacagatgtaagccagtcaaaagttcatttacgatggaggacggcattaatctgcagagaactagaagatgagtttaatgcactggtcaaaagccatgatcagaaagaaaagcttgttacacttatacaacaaaaagaaattgtgggggatcttttcaaccagcttcgcctggctctgcagaggcgctctaattcacgtcctgcacagacgcttgctgcaacttgtatggatgaccaggagcttacggagagtatgcaaaagttgctcattgttatgcaaagattagatgaaaagatcgggccaatgctagaagcagatggagaacttttcaataaaagatggggttggttgtcacgtgctggtctatgggataagagtcatcttaccaggcaaattgaaaaatatgctgatatatacacatcaagggtttcaaattttctgcactatactccattcatgtatttccaatctcaagaacagacacttgcgcatgatgcccattcctattctggaggaaaggacatcaaagttcattgagcatccgttcgtcacaatctggagattaggcaggaaagagcgaacgtgatcattgtgattatggctgcgatggctacacaataacaattgtcgttttgaacaaattaattaatacaccttgtaagattgtatttatatataagtaaatctttagctatagcatgctgaatgattgttctgatagtcagtttgtttgtcgtggcctacctagagtttcatattgggaggcacagtacctgttttggtgtacctgctgctatttgcattgtatatgtgaaatgcgaagtgaagtatgacaaggtaacgataagtgacaaatcacgtcatttgatcctgcgcaagtcgatat

SEQ ID NO: 969 - DNA, 2325 bp, Sorghum bicolor
gctggccccacttctgcttccccatccggtcttcgcttaagctctcgcagcaaacaatggcggacgccggcgccgagcttgtgctcctcctctgcccccgggccccgccgcggccgtcgcttccgcatagctccgtatatccactgcggccacggagcctgctcagagctcccccccgcctccgccctcccatctgtctcaggtgccgcgcgctcgacgccagtaggccggttgcggtggagagggagcgggagcgggacgaggaggacgggctcgaggacgaggaggagtcctacttctcggtcacctcgtcggggctctcggacgtggactacctcggggagagcaccaggggggatttgaacgtgcggagggagcgcctcgaggcgcttggtgggaacggcaagtcaactttgcatggtcctattgaggagatagcttggaaggaagcgggagaagctgaaacattgcttcatgacttgggaattgcagccccattttcagtaagacactcttctcgcggaattttctgcaccaggacactaaatcttcgatctatcagtgtggttggctatgatatggattatacattaattcattacaatgtgatggcctgggaaggacgtgcatatgactatgggatggacaacctcaagagcatgggtttcccagtagatgaccttaaatttgaccctgagctggtcataagaggtcttattattgataaagagaagggaaacttggttaaagctgatcgatttggctacgttaagagggccatgcatggtactcagatgctttccactcgtgctgtgagtgaaatatatggaagagaattggtggacctgcggaaagaaagtcgatgggagtttcttaacacccttttctctgtttcagaagctgtcatgttcatgcagatggtcgacaagttagatcagggattggtgccagctgaacttgggccattggattacaaaggactgtacaatgctgtttccaaagcactttttcgagcacatgtagaaggccaacttaagagagaaataatggctgagcctgagcggtttgtagagcctgatccagaacttcctttagctcttcttgatcaaaaggaggctggaaaaaagttgcttctcattactaattcagatttccattatacaaacaaaatgatgaatcatgcattcaatcgctttcttcctaatgatgtgggatggagagatctttttgaaatggttatagtctccgcaaggaagccagagtttttccagctttcacatccattatatgaggttgtaacagatgatgggctgatgcgcccctgttttaaagtaaagtcaggtggcttatattctggtggtagtgctcagatggttgagaaatcactagacattcatggggatgagatattatatgttggggaccatatttacacagatgtaagccagtcaaaagttcatttacgatggaggacagcattaatctgcagagaactagaagatgagtttgatgcactggtcaaaagctatgatcagaaagaaaagcttgttacacttatacaacaaaaagaaaatgtgggggatctttttaaccagcttcgcctggctctgcagaggcgctctaattcacgtcctgcacagacgcttgctgcaacttgtatggatgaacaggaacttacggaaagtatgcaaaagttgctcattgttatgcaaagattagatgaaaagattggaaaatgctagaagcagatggagaacatttcaataaaagatggggctggttgtcacgtgctggcctatgggataagagtcatctgaccaggcaaattgaaaaatatgctgatatatacacatcaagggtttcaaattttctacactatactccattcatgtatttccaatctcaagaacagacacttgcacatgatgcccattcctattctgggggaaaggccatcaatgttcattgagcgtccgttcaagtcacaatgtggaggttaggcagggaagagagaacgtgatcattgtgattatggctgcgatggctagacagtaacaattgtcacattttgaacaaattaatcaatacatcttgtacgagtgtatggatgtataagcaaatatttaattatagcatgctgaatgattggtccgatagtcagtttgtttgtcgtggccagccagaagagtttcatttggggaggcacagtgacctgttttggtgtacctgctgctatttgtactgtatatgtaaagtgtgaaggtatgacaaggtaaagaactaagagtgataaatcacgccatttgatgctgcgcaaggcgagat

SEQ ID NO: 970 - DNA, 2175 bp, Triticum aestivum
cgcccccctccctcccctctcgcgaggcgcacagatctcgcctcgcctccaccagcagccgcagcggctgccagatccgtccgcccggccgcctcgcgaggttccatccgccgattccccgcatacgcttccctcgccgccggccggtggctcgtctgatcggagcgtgcgtgcgctcgcgtcagaagcggttagggacggaggagagaagcgcggagtcgatctgagagggaggggcgaaccccttcgcgctcctgtgggtttcgatctgttcgtcgggtgtagatccggaagggcttggttggatctgccacttacgaccgggcgccatggagactctggtcatctcgcagcagcgcagccaccaccaccaccaccactcaggtcgccggaggaagccatccccgcacacctcgtcgcctcagcccatgcgtggctaccacgccttcaactgccgtgccttccactccagtatcagcataggcatcctgccgtccccgcccccaccacctcccccgcctgcaccccgggctcggacctactccccggagcccaagacgcccaagcagcagctgcacaatgacaaaaagcgcagccgggcgatccctataactccatcaggatctcctccttcccgtcctgagctttgggctggcccggcatactccaactcgccgccacccagctcgctgccgattcccaagttctcgctccaccagaagcgcagtgtctcacttgagttgccacctgctgataggccagagcatgtggaggtgcttgtgcatgccaagtctgcaccttcgacacccactgctggctcaggatttggcttctttggtgacaatgatactgccattgccacggagaatctgaggaggatccttaatttggaaatcaccgaggactgaatgatgggggcatcaccgtgtacataggtcatcagcaactaaccttgggtactttgtataaagtaacttagaatagcagccttccacctagattctgcatcaacaggagtactgttaggtgtgttagcaagcacatcatgactcgcgggaagctgccgtgaaggatgtggttgtggtggagactgttggggtggatgagagcacagcagtttcagagtcaccttgtagcttgtggtcacctatagggttccaactttctttaggtgttagatcttcatttccatccatggtcagtgatccattagtggttggtagtctgcgtgatcctagctagtaggaaactgcagcaggcaggggtagggtaataagttctgttctactgttagataactagagtttacgctccagcatctgttcccatcttatattctgtaggatatctgcatattatattcttctgatacatacattctgcctcgccatcttgacactcctctcacaccgacttccctggtgctctgcaaagaacacaaggatctctcctcgctggctcttctgtattttttggaatgaagaagccagtggaggttcaagaagccccccttcgatgccctttctccctcatctgtcaactgacttttatctgcacatctcccctcccaccttagtttgttgcatatgtagcatgtcagatcccctcccctgccatccaatcttcattccatgcatataatctaaagttccatccagtggcaccttgtgtagatcctcgttcatgttcatgtccatggaacatgtggagggtttgagttccgttggcatgtttgataaaggatgcaagattccatttcagagacctgcgagcggacaaaccataatacggttggcttatccagtgcacttcatggcgcacaaacctggggtgctcagccgagtttgcaataaatctagttgcttgtttcctttttagttaaagagcagcgcagcttatgctagactgtttcattttatgtaatgcctgcttggctagctgtttctggtactgtttaaaccttggacctagtggtgttccaccttctatgcagatgttgttgctttctttgttagcttcgcttgtttgagcgcataaatgcaagacgacctttatgtcggtgttaaattctctgctgaacgtcgtgttgtcgaccatttgtgaagatcagtatgttttataatctagtttgttgttaacttctttgacctgaattaagttatgtgagtgatttga

SEQ ID NO: 971 - DNA, 1992 bp, Triticum aestivum
tacgcttccctcgccgccggccggtggctcgtctgatcggaacgtgcgtgcgctcgcgtcgcagaagcggttagggacggaggagagaagcgcggagtcgatctgagagggaggggcgaacccctttgcgctcctgtgggtttcgatctgttcatcgggtgtagatccggaagggcttggttcgatctgccacttacgactgggcgccatggagactctggtcatctcgcagcatcgcagccaccaccaccaccaccactctggtcgccggaggaagccatccccgcacacctcatcgcctcagcccatgcgtggctaccacgcattcaactgccgtgccttccactccagtatcagcatcggcatcctgccgtccccgcccccacccccacccccgcctgccccccgggctcggacctactccccggagcccaagacgcccaagcagcagctgcacaatggcaaaaagcgcagccgggcgatccctataactccatcaggatctcctccttcccgtcctgagctttgggctggcccggcatactccaactcgccgccacccagctcgctgccgattcccaagttctcgctccaccagaagcgcagtgtatcacttgagttgccacctgctgataggccagagcatgtggaggtgcttgtgcatgccaagtctgcaccttcgacacccactgctggctcaggatttggcttctttggtgacaatgatactgccattgccacggagaatctgaggaggatccttaatttggaaatcaccgaggactgaatgatgggggcatcacagtgtacataggtcatcagcaactaaccttgggtactttgtataaagtaacttagtatagcagccttccacctagattctgcatcaacaggagtactgttaggtgtgttagtaagcacatcatgactcgcgggaagctgccgtgaaggatgtggttgtggtggagactgttggggtggatgagagcacagcagttttagagtcaccttgtagcttgtggtcacctatagggttccaactttctttaggtgttagatcttcatttccatccatggtcagtgatccattagtggttggtagtctgcatgatcctagctagtaggaaactgcatcaggcaggggtagggtaataagttctgttctactgttagatagctagagtttacactccagcatctgttcccatcttatattctgtaggatatctgcatattatattcttctgatacatacattcttcctcgccatcttgacactcctctaatcacaccgacttccctggtgctctgcaaagaacacaaggatctctcctcactggctcttctgtattttttggaatgaagaggccagtggaggttcaagaagcccccttcgatgccctttctccctcatctgtcaactaacttttatccgcgcacctcccctcccaccttagtttgttgcacatgtagcatgtcagatcccctcccctgccatccaatcttcattccatgcatataatctaaagttctatccagtggcaccctgtgtagtttctgttacttgttcatgttcatggaacatgtggaggattcgagttccgttggcatgtttgataaaggatgcgagataccatttcagagacctgcgagcggacaaaccataatacggttggcttatccagtgcacttcatggcgcacatacctggggtgctcagccgagtttgcaataaatctagttgcttgtttcctttttagttaaagagcagcgcagtttatgctagactgtttcctgttatgtaatgcctgcttggctagctgtttctggtactgtttaaaccttggacctagtggtgttccaccttctaagcagatgttgctgctttctttgttagcttcgcttgtttgagcgcataaatgcaagaccttttaagttggtgttaaattctctggccaatgtcgtgttgtggaccattcatgaagatcagtat

SEQ ID NO: 972 - DNA, 2175 bp, Triticum aestivum
ccacgcgtccgcccacgccctccggtcccacccgcccacccaagggcccccctccataccctctcgcgaggcacacagatctcgcctcgcctccaccagcagcggcagccaaatccgtccgcccggccgcctcgcgagggtccatccgccgatccccctcgaccctctcgccgccggccggtggctcgtctgatcggagcgtgcgtgcgctcgcgtgcggcggcggttagggacggcggagacaagcgcggagtcgatctgagagggaggggcgaaccccttcgcgctcctgtgggtttcgatctgttcgtcgggtgtagatccggaagggcttggttcgatctgccacttacgacttggcgccatggagactctggtcatctcgcagcagcgcagccaccaccaccaccaccaccactctggtcgccggaggaagccatccccgcacacctcgtcgcctcagcccatgcgtggctaccacgccttcaactgccgtgccttccactccagtatcagcatcggcatcctgccgtccccgcccccacccccacctccggctgccccccgggctcggacctactccccggagcccaagacgcccaagcagcagctgcacaatggcaaaaagcgcagcagggcgattcctataactccatcaggatctcctccttcccgtcccgagctttgggctggcccggcatactccaactcgccgccacccagctcgctgccgattcccaagttctcgctccaccagaagcgcagtgtctcacttgagttgccacctgctgataggccagagcatgtggaggtgcttgtgcatgccaagtctgcaccttcgacacccactgctggctcaggatttggcttctttggtgacaatgatactgccattgccacagagaatctgaggaggatccttaatttggaaatcaccgaggactgaatgatggggggcatcaccgtgtacataggtcatcagcaactaaccttcggtactttgtataaagtaacttagaatagcagctttccacctagattctgcatcaacaggagtgctgttaggtgtgttagcaagcacatcatgactcgcgggaagctgccgtgaaggatgtggtggtggtggagactgttgcggtggatgagagcacagcagtttcagagtcaccttgtagcttgtggtcacctatagggttccaactttctttaggtgttagatcttcatttccatccatggtcagtgatccattagtggttggtagtctgcatgatcctagctagtaggaaactacatcaggcaggggtagggtaataagttctgttctactgttagataactagagtttacgctccagcatctgttcccatcttatattctgtaggatatctgcatattatattcttctgatacatacattctgcctcgccatcttgacactcctctaatcacaccgacttccctagtgctctgcaaagaacacaaggatctctcctcactggctcttctgtattttttggaatgaagaggccagtggaggttcaagaagcccccttcgatgccctttctccctcatctgtcaactaacttttatccgcgcacctcccctcccaccttagtttgttgcacatgtagcatgtcagatcccctcccctgccatccaatcttcattccatgcatataatctaaagttctatccagtggcaccctgtgtagttcctggtccttgttcatgttcatggaacatgtggaggattcgagttccgttggcatgtttgataaaggatgcgagataccatttcagagacctgcgagcggacaaaccataatacggttggcttctccagtgcacttcatggcgcacatacctggggtgctcagccgagtttgcaataaatctagttgcttgtttcctttttagttaaagagcagcgcagtttatgctagactgtttcctgttatgtaatgcctgcttggctagctgtttctggtactgtttaaacatttggacctagtggtgttccaccttctaagcagatgttgctgctttctttgttagctttgcttgtttgagcgcataaatgcaagacctttatgtcggtgttaaattctctggtgaacgtcgtgttgtcgaccatttgtgaagatcagttaatgttttataatcttagttggtt

SEQ ID NO: 973 - DNA, 2111 bp, Secale cereale
ctccctcccccctcgcgaggcatacagatctcgcctcgaccagcagcccagccagatccgtccgcacggccgcctcgcgaggttccatccgccgatccccctcgacaccctcgccgccggccggtggctcgtctgatcggagctcgcgagcgtgcgtgcgctcgttagggacggcggagagaagcgcggagtcgatctgagagggaggggcgaacccgttcgcgctcgtgtgggtttcgatctgttgttcatcgggtgtagatccggaagggcttggttcgatctgcaacttacgaccgggcgccatggagactctggtcatctcgcagcagcgcagccaccaccaccaccaccactctggtcgccggaggaagccatccccgcactcctcgtcgcctcagcccatgcgtggctaccacgccttcaactgccgtgccttccactccagcatcagcatcggcatcctgccatccccgcccccacccccgcctgcaccccgggctcggacctactccccggagcccaagacgcccaagcagcagctgcacaatggcaaaaagcgcagccgggcgatccctataactccatcaggatctcctccttcccgtcccgagctttgggctggcccggcatactccaactcgccgccgcccagctcgctgccgattcccaagttctcgctccaccagaagcgcagtgtatcacttgagttgccacctgctgacaggccagagcatgtggaggtgcttgtgcatgccaagtctgcaccttcgacacccactgctggctcaggtttaggcttctttggtgacagtgatactgccattgccacggagaatctgaggaggatccttaatttggaaatcaccgaggactgagtgatgggggcatcactgtgtacataggtcatcagcaactaaccttgggtactttgtataaagtaacttagaatagcagccttccacctagattctacatcaacaggagtactgttaggtgtgttagcaagcacatcatgactcgcgggaagctgccgtgaaggatgtggtggtttcggagactgttagggtggatgagagcacagcagtttcagagtcaccttgtagcttgtggtcacctatagggttccaactttctttaggtgttagatcttcatttccatccattgtcagtgatccattagtggttggtagtctgcatggtcctagctagtaggaaactgcatcaggcaggggtagggtaataagttctgttctactgttagagtttacgctccagcatctgttcccatcttatattctgtaggatatctgcatattatattcttctgatacatacattctgcctcgccatcttgacactcctctaatcacaccgacttccctggtgctctgcaaagaacacaaggatctctcctcactgtctcttctgtattttttggaatgaagaggccagtggaggttcaggaagccccctttcgaagccctttctccctcatctgtcaactaacttttatctgcacacctcccctcccaccttagtttgttgcatatgtagcatgccagatcccctcccctgccatccaatcttcattccatgcatataatctaaagttccatccagtagcagggatgcatctgttctggcaccctgactagttcctggtccttgttcatgttcatggaacatgtggaggattcaagttccgttggcatgtttgataaaggatgtgagattccatttcagagacctgcgatcggacaaaccataatacggttggcttctccagtgcacttcatggcgcacatacctggggtgctcagccgagtttgcaataaatctagttgcttgtttccttcgtagttaacgagcagcgcagcttatgctagactgtttccttttatgtaatgcctgcttggctagctgtttctggtactgtttaaaccttggacctagtggtgttccaccttataagcagatgtcgctgctttctttgttagcttcgcttgtttgagcgcataaatgcaagacctttatgtcgttgttaaattctctggtgaacgtcgtgttgtctaccatttgtgaagatcggtatgttttataatctagtt

SEQ ID NO: 974 - DNA, 2215 bp, Secale cereale
cgatacagatctcgcctcgaccagcagcccagccagatccatccgcacggccgcctcgcgaggttccatccgccgatccccctcgacaccctcgccgccaaccggtggctcgtctgatcggagctcgcgtgcgtgcgtgcgctcgttagggacggcggagagaagcgcggagtcgatctgagagggaggggcgaaccgcttcgcgctcctgtgggtttcttcgatctgttcatcgggtgtagatccggaagggcttggttcgatctgcaacttacgactgggcgccatggagactctggtcatctcgcagcagcgcagccaccaccaccaccaccactctggtcgccggaagaagccatcccagcactcctcgtcgcctcagcccatgcgtggctaccacgccttcaactgccgtgccttccactccagtatcagcatcggcatcctgccgtccccgcccccacccccacctccgcctgcccctcgggctcggacctactccccggagcccaagacgcccaagcagcagctgcacaatggcaaaaagcgcagccgggcgatccctataactccatcaggatctcctccttcccgtcccgagctttgggctggcccggcatactccaactcgccgccacccagctcgctgccgattcccaagttctcgctccaccagaagcgcagtgtatcacttgagttgccacctgctgacaggccagagcatgtggaggtgcttgtgcatgccaagtctgcaccttcgacacccactgctggctcaggtttaggcttctttggtgacagtgatactgccattgccacggagaatctgaggaggatccttaatttggaaatcaccgaggactgagtgatgggggcatcaccgtgtacatagggtcatcagcaactaaccttgggtactttgtataaagtaacttagaatagcagccttccacctagattctacatcaacaggagtactgttaggtgtgttagcaagcacatcatgactcgcgggaagctgccgtgaaggatgtggttgtggcggagactgttagggtggatgagagcacagcagtttcagagtcaccttgtagcttgtggtcacctatagggttccaacttttctttaggtgttagatcttcatttccatccattgtcagtgatccattagtggttggtagtctgcatggtcctagctagtaggaaactgcatcaggcaggggtagggtaataagttctgttctactgttagagtttacgctccagcatctgttcccatcttatattctgtaggatatctgcatattatattcttctgatacatacattctgcctcgccatcttgacacttctctaatcacaccgacttccctggtgctctgcaaagaacacaaggatctctcctcactggctcttctgtattttttggaatgaagaggccagtggaggttcaagaagccccccttcgaagccctttctccctcatctgtcaactaacttttatctgcacacctcccctcccaccttagtttgttgcatatgtagcatgtcagatcccctcccctgccatccaatcttcattccatgcatataatctgaagttccatccagtagcagggatgcatctgttctggcaccctgagtagttcctggtccttgttcatgttcatgttcatgttcatggaacatgtcgaggattcgagttccgttggcatgtttgataaaggatgcgagattccatttcagagacctgcgagcggacaaaccataatacggttggcttctccagtgcactccatggcgcacatacctggggtgctcagccgagtttgcaataaatctagttgcttgtttccttcgtagttaacgagcagcgcagcttatgctagactgtttccttttatgtaatgcctgcttggctagctgtttctggtactgtttaaaccttggacctagtggtgttccaccttataagcagatgtcgctgctttctttgttagcttcgcttgtttgagcgcataaatgcaagacctttatgtcggtgttaaattctctggtgaatgtcgtgttgtctatcatttgtgaagatcggtatgttttattatctagttggttgttaactttgttgtgtctcagctttggacctgagttaagttctgtgtgtgatttgatctgttttaatgtacttgccttgaagtatcactatcaaaagtc

SEQ ID NO: 975 - DNA, 2135 bp, Secale cereale
tcgcgaggcatacagatctcgcctcgaccagcagcccagccagatccgtccgcacggccgcctcgcgaggttccatccgccgatccccctcgacaccctcgccgccggccggtggctcgtctgatcggagctcgcgtgcgtgcgtgcgctcgttagggacggcggagagaagcgcggagtcgatctgagagggaggggcgaaccccttcgcgctcctgtgggtttcttcgatctgttcatcgggtgtagatccgtaagggcttggttcgatctgcaacttacgaccgggcgccatggagactctggtcatctcgcagcagcgcggccaccaccaccaccaccactctggtcgccggaggaagccatccccgcactcctcgcagcctcagcccatgcgtggctaccacgccttcaactgccgtgccttccactccagcatcagcatcggcatcctgccatccccgcccccacccccacccccgcctgcaccccgggctcggacctactccccggagcccaagacgcccaagcagcagatgcacaatgccaaaaagcgcagccgggcgatccctataactccatcaggatctcctccttcccgtcccgagctttgggctggcccggcatactccaactcgccgccgcccagctcgctgccgattcccaagttctcgctccaccagaagcgcagtgtctcacttgagttgccacctgctgacaggccagagcatgtggaggtgcttgtgcatgccaagtctgcaccttcgacacccactgctggctcaggtttaggcttctttggtgacagtgatactgccattgccacggagaatctgaggaggatccttaatttggaaatcaccgaggactgagtgatgggggcatcactgtgtacataggtcatcagcaactaaccttgggtactttgtataaagtaacttagaatagcagccttccacctagattctacatcaacaggagtactgttaggtgtgttagcaagcacatcatgactcgcgggaagctgccgtgaaggatgtggtggtggcagagactgttagggtggatgagagcacagcagtttccgagtcaccttgtagcttgtggtcacctatagggttccaactttctttaggtgttagatcttcatttccatccattgtcagtgatccattagtggttggtagtctgcattatcctagctagtaggaaactgcatcaggcaggggtagggaaataagttctgttctactgttagataactagagtttacgctccagcatctgttcccatcttatattctgtaggatatctgcatattatattcttctgatacatacattctgcctcgccatcttgacactcctctaatcacaccgacttccctggtgctccgcaaagaacacaaggatctctcctcactggctcttctgtattttttggaatgaagaggccagtggaggttcaagaagccccccttcgaagccctttctccctcatctgtcaactaacttttatctgcacacctcccctcccatcttagtttgttgcatatgtagcatgtcagatcccctcccctgccatccaatcttcattccatgcatataatctgaagttccatccagtagcagggatgcatctgttctggcaccctgagtagttcctggtccttgttcatgttcatggaacatgtggaggattcgagttccgttggcatgtttgataaaggatgcgagattccatttcagagacctgcgagtggacaaaccataatacggttggcttctccagtgcacttcatggcgcacatacctggggtgctcggccgagtttgcaataaatctagttgcttgtttccttagtagttaacgagcagcgcagcttatgctagactgtttccttttatgtaatgcctgcttggctagctgtttctggtactgtttaaaccttggacctagtggtgttccaccttataagcagatgtcgctgctttctttgttagcttcgcttgtttgagcgcataaatgcaagacctttatgtcggtgttaaattctctggtgaacgtcgtgttgtctaccatttgtgaagatcggtatgttttataatctagttggttgttaactttgtggaagtc

SEQ ID NO: 976 - DNA, 2165 bp, Avena sativa
ccgtcctcccacccctcgcgaggcagatctcgccgcgaccacccacagcagcggccagatccatccgcgcccggccacctcgcgaggaccatcggtccgccactcccccacgaccccacggacacgtccctcgtcggatcgcgtgtgtgcgctcgcgtgcggaagcggttagggaacggcagaaaggggtctcggaggcgatctgagagggaggggcgcgcgtgtcccatttcgtgctcccgtttgttgcgatctgttcatcggctgtagatccgtaagggcttgggtcgatttgtcactcaatggagactctggtcatctcgcagcagcgcagccaccaccaccaccactccggtcgccggaggaagcaatcgccgcacttctcatcgcctcatcccgtgcgtggctaccaggccttcaactgccgtgccttccactccagtgtcagcatcggcatcctgccgtccccgcccaccccaccacccgcacgccccgctcggacctactccccagagcccaagacgcccaagcagcagcatcagctgcacaatgggaaaaagcgcagccgagctatccctatcagtccatcacgatctcctccttcccctcccgagctttgggccggaccagcgtactccaactcgcccccacccagctcactgccgatacccaagttctccctccaccagaagcgcagcgtctcacttgagttgccggctgctgaccgatccgagcatgtagaggtgcttgtgcatgccaagtcagcaccttcaacacccactgctggctcaggtgctggcttctttagcgacagtgatactgccattgcgacggagaatctgaggaggatcctccatctggaaatcgcctagcactgaatgatgggcatcatcttgtatataggtcatcagaagctaacattggtactgtgtatagagtaacttagaatagcacccttccacctaggtccttcatcagttggagtactgttaggtgggttagcaagcatatcaagacttttggaaactgctgtgaaaaggatggggtggtggtgtatactgttggggtggatgagagcacagcagtttctgactcaccttgtagcttgtagtcaccctaatcgttccaactttctttaggtatctgttcttaggtgtaagatcttcatttccatccatggtagccatcataatccagtattggtagtctgcacgatcctagctagtaggaaactgcatcaggcaggggtagggtagtaagttagtattgttctgttctcagataactggagtttacactctgttatctgttcccgtgttagtctgtaggatatctgcatcttctgatacatacattctaccttgccatcttgacactcctccattcatactgacttctcctgtgctctgcaaagaacacagggatctgtctttactggctcttctgtattttttgaatgaagaggctcagtggtgattcaagaagtccccctccctcatccactactaacttctatctgtgcacctccccccctcttcagtttgttgcatatgtagcatgtccaatcccctcccctgccatcaaatcttcatttcatccataaactcaagttccatccagtagcagggatgcgcttgttccgtcaccctgtatatttcacggtccttattcgtgttcatggaacatgttgaggattcaacttcattggcatgtttggtaaaggacgcgagactccatatttcagagacctgcaagagtacaagccatgatagggtttgctttctccagtgcaacttcatggtacatgtacctgtagttcagattacctaagttctaaatctaggtttgcttctcaggtgcaacttcgtggacatgcacctggggttcaagatttacctatgttccaataaatctagttgcctgctttcttagtaaagccagcgcagcatgtgcttagactgatccttttatgtaatgcctgtatggctagctgttccttttactgtttaaaccttcttagtataaggttagtggtatttcattttattagcagatcttgctgctttctcaacgtgctgttttagcacaatcctgtgtcctaagatctgtgttgttgaccatttgtgaggatcagtcatgttttataatctagttggacagttggt

SEQ ID NO: 977 - DNA, 2514 bp, Brachypodium distachyon
caattccgtggtcgcgtaactaagctaaaacgccattcctctcccctcctcgtcacttccccccaaccgcaacacccccacctcctcagctcccacctaatcgccccccgtccttcctcctcgcgaggccggcagatctcgcctcagggctccagcagccagatccatccatccgccacgctgcctcgcgaggatcgttccgccgcctccccgcgacacccttctcccgggggtctccctgagccggctcgtctcgtcggatcgcttgtgtgcgggagtggtttgggtcttcgggacggcggatagaggcgcggcggcgatctgagagagcgaggggcatccacccttttgtgctttcgatcctcaagggcttggtaggatctgccactccgagcagtgccatggagaccctggtcatctcgcagcagcgcagccaccaccaccactccggtcgccggaggaagccatcgtcgcacttctcgtcgcctcagtccatgcgtggctacaactgccgtgccttccactccactgtcagcatcggcatcctgcgctccccgcccccaccaccacccactgctcctgctcggacccgctcatcccctgagcccaagacaccgaagcagcagcagcttgggaagaaacgcagccgcgttattcccataactccttcaggatctcctccctcccgtcctgagctctgggctggcccggcctactccaactcgccaccacccagctcactgccgatacccaaattctccctccaccagaagcggagtgtctcgcttgagttgccacctactggcccatctgttcatgtggaggtgcttgtgcatgccaagtcagcgccttcaacaccgactgctggctcaggttccgacttctttggcaatgatactgccattgcgacggagaatctgaggaggattctcaatttggaaatcgccgatcattgaatgatgggcaccaatggtgtacatagtcaccaacagctaaccttagtactgtgtatagagtaacttagaaggatagtgtgtcacctcggttctgcatcagcaggagtagcaagcacatcaagactagtaggaagctgctgtgaaggatgtagtttagtgatgttggtggaaacttatggggtggatgagagcacagcagtttccgagtcgcctctgtagcttgtagtcgcctatatggttcggacatttctttaggtgttagatcttcatttgcatccttcaaccttggtacctatcatgatcctgtagttgtagtctgcataatcctagcttataggaagatgcagtgaggcagggtagggtagtatctgttcctgtgtcaaatatatgtaggatagctgcatcttcattcctatgatactttcatcccgccttcccctcatgactgactcctaataataccgacctctctggtgctctgcaaagaacacaagaatctctccgaactggctcttctgttttttggtaggaagaggccaagtggagattttatgaagtccccctcccatgttctttctccttcatctgcctactaattttttatctgttcaccttttctcttctcagtttgttacatatgtagtatgtcaaatcccctccctgccatccaatcatcatttcttgcataaccttctaaagttccatctagtaccgggatgcctttgtttgggcaccctgtacaattccctgtcctagtccatgttcgtaaacatgttagggcattcaacttgtttgataaaggatgcgagactccagatttcagagacctgcacgcatacagaccagaatatgtgttgtaggtttgcttatccattgcacttcatggtacatctacctggggttcagatttaccatagtttcaataatctagttgcttgagtcagctgcaaacatacacaccagaatatggtttgcttatccagtgcacttcatgttacatctacctggggttcagatttaccatagtttcaataatctagttgcttgtttgcttcatagtcagctgcaaacatacaaaccagaatatggtttgcttatccagtgcacttcatggtacatctacctggggttcagatttaccatagtttctagtcagcaagcagcgcagcatatgctggactgttccctttatgtaatgtaatgtaatgtaatgcctgcttggctagctgtttctgctactattttgaccttcttagaaggtttcagtgtcgtttcattttccttagcagatctcactgctttcttcgtcagcttggatgttgagaacttaaatgctagatccttttgtcagtttaaattctaagtactgatcttaccagtaacagattaatcatgttttatagttggacgttgagcctcagtctttaatctgttctttctgtacggttttccatcatcagctggccagtttggtgttatactatcattctggcacaggttgagatgtatgtgtatggttgatgatgattttggatggtaaacgttgtgagacataacc

SEQ ID NO: 978 - DNA, 1881 bp, Triticum aestivum
cgtggctaccacgccttcaactgccgtgccttccactccagtatcagcatcggcatcctgccgtccccgcccccacccccacctccgcctgccccccgggctcggacctactccccggagcccaagacgcccaagcagcagctgcacaatggcaaaaagcgcagcagggcgattcctataactccatcaggatctcctccttcccgtcccgagctttgggctggcccggcatactccaattcgccgccacccagctcgctgcctattcccaagttctcactccaccagaagcgcagtgtatcgcttgagttgccacctgctgataggccagagcatgtggaggtgcttgtgcatgccaagtctgcaccttcgacacccactgctggctcaggacttggcttcttcggtgacaatgatactgccattgccacggagaatctgaggaggatccttaatttggaaatcaccgaggactgaatgatgggggcatcaccgtgtacataggtcatcagcaactaaccttgggtactttgtataaagtaacttagaatagcagccttccacctagattctgcatcaacaggagtactgttaggtgtgttagcaagcacatcatgactcgcgggaagctgccgtgaaggatgtggtggtggtggagactgttggggtggagagagcacagcagtttcagagtcaccttgtagcttgtgttcacctatagggttccaactttatttaggtgttagatcttcattcccatccatggtcagtgatccattagtggttggtagtctgcgtgatcctagctagtaggaaactgcagcaggcaggggtagggtaataagttctgttctactgttagataactagagtttacgctccagcatctgttcccatcttatattctgtaggatgtctgcatattatattcttctgatacatacattctgcctcgccatcttgacactcctctcacaccgacttccctggtgctctgcaaagaacacaaggatctctcctcgctggctcttctgtattttttggaatgaagaagccagtggaggttcaagaagccccccttcgatgccctttctccctcatctgtcaactgacttttatctgcacatctcccctcccaccttagtttgttgcatatgtagcatgtcagatcccctcccctgccatccaatcttcattccatgcatataatctaaagttccatccagtggcaccttgtgtagatcctcgttcatgttcatgtccatggaacatgtggagggtttgagttccgttggcatgtttgataaaggatgcaagattccatttcagagacctgcgagcggacaaaccataatacggttggcttatccagtgcacttcatggcgcacaaacctggggtgctcagccgagtttgcaataaatctagttgcttgtttcctttttagttaaagagcagcgcagcttatgctagactgtttcattttatgtaatacctgcttggctagctgtttctggtactgtttaaaccttggacctagtggtgttccaccttctaagcagatgttgctgctttctttgttagcttcgcttgtttgagcgcataaatgcaagacgacctttatgtcggtgttaaattctctggtgaacgtcgtgttgtcgaccatttgtgaagatcagtatgttttataatctagtttgttgttaacttctttgacctgaattaagttatgtgtgtgatttgacctgtttttaatgtactcgcctggtgtgatgcttgtgttctctgactgagacttaaggcattaagcattctattagtcagctggttttggattgcgaagcatatctctattatcaggtgctttgcgatggtattgtta

SEQ ID NO: 979 - DNA, 1149 bp, Secale cereale
cccgccggatcccgtcgaaccaaaccctagcaaccgctcgccaccccgtgacggctcgccgtcgtccccatgccccgccgcagccagagcagtgcccccatcgacctcgacgaagaggatgagtgcaagaccaagcgttctcgagcgagcataaggccagcgccaaaggtgcctgggagctcaaatcgcattgcaagtagcagaagagacaaggaaaatcaagacaaactggatacccgtatcttcgatttatacatggaggacctttggaagcgtacaaatgaagatcagaagaatacttacgcatatttggatccgttatggtttaacagttatgtcaatggggcgaacgaccagaaatcaagaattcttagatggacaaagaaactgaaaatattttcaagaaaatgtgtgtttgtccctattgttcgttggggacattggaacctccttgtcctatgccactttgacgagacagactgctcagatgcaaaaaaaggaccgcggatgctgctgctggattcacttaacacaacagatccgaagaggttggcacctgaaatcagacgattcattcgtggtatttatgaaattgaagagcgggaagaaagcgtgcacttcataaacaaaatccgtcttgagtttcctaaggtgccacagcaaaatggggaggaatgtggtatatatgttctttacttcatccactgttttcttcaaaacggaaaattggcagaagttcttcagaataaaacactggaagaagatttcagccagctgtttgatgatggcacgtttgatccagaggaactagagaacttccgcaaggatgttcatgcattccaagtggaaaggagtaccgaaaccggacagtaggtggatcgtagcattgtgctgcatatatgtagttggttattataaggcagtggaaaacttcatcttcactggtggcgaattctgaggaagctcgaaggtcgtggagaagctggtggtaatatacagcttatgcagccgagagaaagttgactccatggagctttgtgacagttagcaggtgttatatgatctgtattggtattctagatagaattgctgtgtatccatcttttgtatgacaccatgagagttatctactttatgggctggaatgat

SEQ ID NO: 980 - DNA, 1452 bp, Triticum aestivum
actggcacagtatggccaaaaccccaacccattccgttccgctcaccactgtttgagcttcctctcctagcccctttgcccacccgccggatcccgtcgaaccaaaccctagcgaccgctcgccacccgggacggctcgccgtcgtcgccatgccccgccgcagccagagcagtgcccccatcgacctcgatgaagaggatgagtgcaagaccaagcgttctcgagcgagtataaggccagcaccgaaggtgcctgggagctcaaatcgcattgcaagtagcagaagggacaaggaaaatcaagacaaactggatacccgtatcttcgatttatacatggagaacctttggaagcgtacagatgaagatcagaagaatgcttgcgcatatttggatccgttatggtttaacagttacgtcaatggggacaaagaacagaaatcaagaattcttagatggacaaagaaattgaaaatattttcaagaaaatatgtgtttgtccctattgttcgttggggacattggaacctccttgtcctatgccactttgacgagacagactgctcagatgcaaaaaaaggaccgcgaatgctgctgctggattcacttaacacaacagatccgaagaggttggcacctgaaatcagaggattcattcgtggtatttatgaaatcgaagagcgggaagaaagcgtgcacttcataaaaaaaatccgtcttgagtttcctaaggtgccacagcaaaatggggaggaatgtggtatatatgttctttacttcatccattgttttcttcaaaacggaaaattggcacaagttcttgagaataaaacactggaagaagatttcagccagctgtttgatgatggcacgtttgatccagaggaactagagaacttccgcaaggatgttcatgcattccaagtggaaaggagtaccgaaactggacagtaggtggatggtagcattgtgctgcatatatgtagttagttattataacgcagtggaaaatttcatctttgctggtggcgaattctgaggaactttgaaggtcgtggagaagctggtggtaatatacagcttatgcagccgagagaaagccgactccatggagtttcgtggcagttagcaggtgttatatgatctgtattggattctagaattgttgtgtatccatctttgtatgataccatgagagttatctactttatggactggaatgatctcaatagtcccaagtcttaagatagcagcatcacgtacaatgcttgctaggggtccaaaaaagaaagtaagaacaatgcttgcataatgattttttttttatgtgatcgcactttttccgaatgtacaatacacttcttaaaaagatccttcgttccaaagaggccttggatgtgagccacggcaaagcaagtttataaattctactctcacgtagcagagttatac

SEQ ID NO: 981 - DNA, 1187 bp, Leymus cinereus x Leymus triticoides
gcaaccgttcgccacctgggacggctcgccgtcgtcgccatgccccgccgcagccagagcagtgcccccatcgacctcgacgaagaggatgagtgcaagagcaagcattctcgagggagtacaaggccagcaccgaagatgcctgggagctcaaatcgcattgcaagtagcagaagggacaaggaaaatcaagacaaactggatacccgtatcttcgatttatacatggaggacctttggaagcgtacagatgaagatcagaagaatgcttacgcatattttgattcgttatggtttaacagttacgtcaatgcgggcaacgaaaagaaatcaagaattcttagatggataaagaaactgaaaatattttcaagaaaatatgtgtttgtccctattgttcgttggggacattggaacctccttatcctatgccactttgacgagacagagtgctcagatgcaaaaaaaggaccacgaatgctgctgctggattcacttaaaacaacagatccaaagaggttggaaggtgatatcagaagattcattcgtggtatttatgaaatcgaagagcaggaagaaagcgtgcacttcataaacaaaatccgacttgagtttcctaaggtgccacagcaaaatggggaggaatgtggtatatatgttctttacttcatccactgttttcttcaaaacggaaagttggcagaagttcttcagaagaaaacactgaaagaagatttcagccagctgtttgatgatggcacgtttgatccagaggaactagagaacttccgcaaggatgttcatgcatttcaagtggaaaggagtaccgaaaccggacagtaggtggattgtagcattgtgctgcatatatgtagttagttattataaggcagtggaaaatttcatcttcgctggtgacgaattctgaggaagcttgaaggtcgtggagaggctggtggtaatatacagcttatgcagccgagagaaagccgactccatggagcttcgtgacagtttagcaggtgttatatgatctgtattggcattctagaattgttgtgtgtccatcttttgtatgacaccatgagagttatctactttatggactgaaatgatctcaatagtctcaacttgttttccctaagtcttaagatagcagcatcatgtacaatgcttgctaggggtca

SEQ ID NO: 982 - DNA, 2265 bp, Brachypodium distachyon
ttcttctctattcatttttcttcacagtttccggttaacttttactactccacgttttactgcagccagtggagctgagctgagtaggcgaggaagcaacagcagcatagagcagagcagacgagggaggaagagatcggcggaggcagaggccggggctctagctagctaagctcaatcgaatcaatggcgaaccgccctcgccggtccgaaccctagcctctgtcaacccaacccgcgatgacccgtcaccatgtcctccccccgccaccctcccccgccgccgcccgctagggtgcgcctcgacgacgtggcggtccacgacggcgccgccgccccggcctacgcacgctccgtcgccgccctcgccgactccctcgcccgccgcaacgccgccgtgctcgagctccccgcccacgacgccgccgtcgtccgctgcgccctcgagtccgcaagggccttcttccgcggccgcgcctccgtctatgtctaccgcgccgggaggactttggaagatggagagttgtcccctgcttgcatgtctgatgctttcagatgtttgggtaaggcggcccgtgtcgctctctgcgcaatagcacgccatctgcgcttacgcactgatgtattcaaccatttgcttgatgatactccgttgcctattaacgaggtctcatcgtcagagttgctggtggcatactcgcatgaacagctccaaagtggacaagcacctatgggatttctcaggtcctcaatgcctgaagttgataggggttttgtgacgctagttgcttctgattgtccaggaattgaggtttgtgacccaaatggccattggtatctagcggatgggggttcaggcccaactgatctattgcttctgactggaagggccctaagtcatgttaccgctggtcttcgcccaatttcccagtacagggcttctaatgagaacagggcatcactcacttttaggttaatgcctcatgcaaatgctgtattgggttgctctccaattttagctgctgggcattgcataggacagatacaccaaccaattcctgcaagccaatttatggatgattcgtgtgctgaagagcatgctgtttccagtcgcttggaagaaccttctgaatctcagggcaattttgttagtgatccatcgctcagaagtgtcctctcagaccctctgtccggggcttttcttgaagatgctatggttctctcatgtgggcactcatttggtggcctcatgctgaagaaagttgttgaaatggctagatgcaccatttgccatggagaagttgacccagcctccttgtttcctaatctcgctttaagggcagtagctacagtggtgaagatggaagatgacaggagactctttcacaacgccgctcttcgaaaacgcaggaaagatgtgaccgggcatacagatgtgccgaaacgggccgggagtagcaaagacaacggtgagcttgttctggatgctgagagctcggcgccattcaagggagtgcagtacccatttgtggtgggcgagagagtactgatcatgggaaacaaaaggacgcccgagaaattcgtcgggaaggaggcagtcatcacctcgcagtgtttgaatggctggtatctcgtgaaggcggtcgacagcggagagagcatacggctgcagtaccgatcgctgaagaaagtgatggagctgcagatgcaggcgctggcattcctgcggtaaaaggggaacaacgacgtatcattatcatcatcttcgtcgatgatgaaactataaccatcatccaagccactgatccggacacatagatatgtggccaatcacgggacgacaaaaatgtactaccaagttagtattattagtatatatcaggcacagcgagcggagcaatggaattgtgtttagtgcaatgactggtggacgccacgaagcaaggaaggaaagaagaaaggaggttgtgaaaggaatctgaccagcgaacgtgttctccaagggtccaagttggcggcacctgcagacaaaatccaacagcgatatgacgaatctggcttccaatttatctttcatctatccatccatccatccattagcaaagcagcagcagtagtagtacaagtagtaaactgactaatcgttgtgtcaagtgtatccacataattaatcaatttaatgctgtacatacaggtaaaaacatgaactacgcagctgttaatttcatctgaaaattctttaggcattttttctgtgcgtgtgct

SEQ ID NO: 983 - DNA, 1771 bp, Triticum aestivum
gccttcttccgcggccgccacgccgcctacctctaccgctccgggaggactttggaagatggagagttgtcccctgcttgcatggctgatgctttcagatgtttgggcaaagcagcccgggccgccctctgtgcaatagcacggcacctgcgcctacgtaccgacgtattcaaccaattacttgatgatactccactgccggttaacgaggtctcctcatcagagttgctggtggcatattctcatgaacagctccaaagtggtcacacactcatgggatgtcccagcaggtcctcaatgcctcaagttgataggggatttgtgacgctagttgcttccgattatccaggaattgaggtttgtgacccaaatggccattggtacctagctgatggggtttcaggcccaaataatctattgcttctgactggaagggccctaagtcacgttactgctggtctttgcccaatttcccagtacagggtcactaatgaaaatagggcatcactcacctttaggttggtgcctcatgccaacgctatattggattgctctccaattttagctgctgggcattgcatacgacaggtgtaccaacccatacctgcaagccaatttatggatgattcttatgctgaagagcacgctgtttccagtcacttggaagaaccttctgaatctcagggcaactttgttagtgacccatcactcagaagtgtcctgtcagaccctctatctggggcttttcttgaagatgctatggttctccaatgtgggcactcatttggtggcgtcatgctgaagaaagtcattgaaatggctagatgcaccatttgcaatggagaagttgacccatcctccttgtttcctaatcttgctttaagagcagtagccacggtggtgaagatggaggatgacaggagactgtttcataacgctgctcttcggaagcgcaggaaagatgtgaccgagcatacggatgtgccgaagcggactgggagtcgcaaagacaacagtgagcttgctctggatgctgaaagcccggtggcattcaagggagtgcagtacccatttgtagtgggcgagagggtcctcatcatggggaacaaaaggacgcccgagaaattcatcgggaaggaggcggtcatcacgtcgcagtgtctgaatggctggtatcttgtgaaggcgctcgacagcggagagagtacgcggctgcagtaccggtcgctgaagaaagtgccggagctgcaactgcagacgcaagcgaggctgcagcccctggcatttctcggtggcagacaataggagatggcaatgacggatcatgcgtgtaccataaccaccgcccaaggtgtcggtcaggtaggacgaggaagatatggtggtagtgctgctgtgtgcaagttgtgtaccaatggatcttaatttcgtttccttgtgtgtatagctaggtagggcgctcccctcccttgttcgaaggcgagatcaatgtaaaagtcgagagtatgaaatggttccgtgcctgccttagggtattcgctatcaggccatgcggcggctgtagtagtaagcgacctatgtttgcgcgtcaaatctgttcatgtttgagcttgtagaggaagaatgtgtttacatgggttcttcaaggctggctccagattgtacaagaccattctgtgaactgtcgagtctacagtgccgtggctgggcaattataatcatttggcggtagtaggagtattcactaactatgtttgggcaattatatatc

SEQ ID NO: 984 - DNA, 2115 bp, Triticum aestivum
taagttgcttagaagaactaaagaattggatgcatgctttatggttccttctgaagaaatgagcgagcttaacatgctcagggataagagattgaactcaactgacattatgcagctggttctcagcttgattgaagatagaaagcaactggcgctcgaactatcttcacagattaaggcgcgtcttacagaaaggtttgcagccaaagaacaatataaccggtctagggtagaattagactctagaactagaaggctggagaatgagaagactgatgtgcaaactaccttggaacgggagcttgatagaaggtcaaatgattggtcagccaggctagcaagatttcaagccgaagaacagagactacgggatagagtaatggagctagcagagcagaatgtgtcatttcagagagaagttaatttgcttgaatcaaatcgagttgaagtttctaacaggattacaagtttggaactgcaaaacaaacaactgaataatgagctggagaaagttaaaggtgagcacaccagtctttacagatcctcagtagagttgcatgatagctttacaaaagctgcagaagaaagggaccaaatccaagaatgcttaaaatccaaggaagataacagtagggcactacacaaggtgattgcaagattacaaagggaatctaatgagcaggagaaaacaataaatgggctgagacaaggatttagtgctgaattagaaaagagatctgccggaagtagcgaaagcatcacaaggacgcaaatggaacttttgagacttgctggagttgagcaaaagctgagaaaagaaattcagtcctgtaaccttgaagtagagtctcttcagcaagagaacatagggattttaaatcatctagaaagtagtgggaatggattaagtttatccttgcttcgtgttgacctcgaacttcacgctagagtggacaacttgcagatgcaaggcttatcattacttgaagatactagttgtctttgtggcaagttgttggacgtcatgaaatccaagagtgagaatattcgcagtgttgatgcactagcagccattgaatacactttgaagtaccagaacataagacaaggaatggacaatttagcccttagtctgagaaaagttaagtctgtgttggttgaaaagcacaacgaagaagacaacacagtgggtgttcctgtgagacatgatacattatatagggatgacttcgaaattaagctgaaagaagaagctttactcaacagagtattgaaggagaagctattgtcaagggaactggacattgaacaattgcaggcagatgtagcatcttttgtccggatccaagatgccatggaaaatgagatccatagaactcaggatgaattatgtcgcgcaacccacaagtttaagcattttgaacttcaggttttgaagaaagacgagagcattaaccagatgcaacaggattttcaggaatctgcaaaggagttgaccactctccggtgcacccttaaatcagtaagtgatgaaagggatgccttgtggcaggaaacaaagcatttgcggaaaactgttagcgtgctgcaaaacgatgttgcctcattaaagcagaaaatcaaatcgctcgacaaagacatacagctgaaggaaggcgagatactgctgcgtgagggtgagatttccatattacaggacagcatcgataggccactcgacatcatctgcagtcctcatcaatgaaacagtttgacatggagtaaatttgcgtaattcacatccttctgtctggattctcaaatggccttttccttctgtctattcttttagaaacatagaaacttgggctggattctaaaatggccttttccttctgtctctacttttagaaacatagaagctcaggctggattctcaaatggctttttcctcctgtcccttcttttagaaacatactgtagttcacatcctttatccgtccttaaatatagttcactatattagcagttggataatggtctatccttcttgtttgcactttgacgatgcaacctgtgttgctaccttcatttagttttgtgatactgcactttgtctaaatctaattgtttgtt

SEQ ID NO: 985 - DNA, 1572 bp, Secale cereale
atcacccccaacctccactcgctggctggcagcgtagcatagcttagccagctcctgccctgctctgctctccccgccggtcggtcgccgatggaagccccgctgctcctccccgtctccaccaccgccgcctcctccacgtccatcaccgttgacgatgacagccacggcgcggccggcgcctcggtctccccgtcccgcgcctcgccttccggccggagcatcgccgcgcgctacctggccgtggccctcgtcgccgccgtctcgctgttcgcgcagcacgaggcctccaagggcttccgcatcgacgtcgtccggggcggcggcacggccggtgccgccggcaagcgcttcgacctcctcttcgtcgccaacggccgcgccgagcgcgtgctccaccgcgccagccgccgcatcgaggaggcgctcttcccggacccctcgttcccgcgccggcgggtcgcccgcgtcaccgtgcggctgatggccggcggcaacctcaccgccgacgacgcgaccgtcgacgctgtcacggacggggagtacgtcatctcgctgagcccacgcctcctgtcgccgtcctccggcgccggggccgccgaggccgtcgccgccgcggtgcgccgggccgtggcgcgcatgtggctgtgggacggccgcggcgccgcgccggcgcgcgtcacggagtccatggtggagtacctcgccaccgccgtcccggacgagccgtcgtcgccggcggaggagcacgcgtcggcgtcgaacacgcagtgcatctcggccgcggttcctggagcacctggagcggcggcgcgccgggttcgtggcgcggctgaacagggcaatgagggaccggtggagcgacgccgcggtggacgccgccctgggggcgccagcccggcccgtctgcgccgcctacctcgcggcggcgacggaaaccggcggccaacgaccggtggttggctccgcggtggcggcttgagccagcaaggcgtcggaacagcgcacgaagggtggtttgcgagagatcgcacatgcacgccatgcttgtcacgtgactcagtcggtcaatcccttgtacgtaaatgcaattgatccgccattatcggtgagtggttaattaagtaatgggatgagacgagtctacaaatgtagttaaacacacgccttctttgtaaatccacagtagttttttaagtttgtgtggtggaatatatatggcgatctcaaataattgtagaacgctcaagagaaaacaagacgacccgttacctcgatcacattgatttatgggctgcccttcctttcacgatgaaagtagaacaccccttcagggctcctttggtttgtaggaattttgtaggaactttataggataggatttggaaaggaaaaattcctttgaagccctttggtttgtaggaatggattcctattcctttgtaggataggaatcaatcattcacattttggaaaagggaaaaaaaaaaaaaaaaaaacaaaaaaaaaaaaagaaaaaaaaaaaactaaagaagaactagacaagacacacaggaagtagcaccacccccc

SEQ ID NO: 986 - DNA, 1137 bp, Secale cereale
ccccaacctccactcgctggctggcagcgtagcatagcttagccagctcctgccctgctctgctctctccgccggtcggtcgccgatggaagccccgctgctcctccccgtctccaccgccgcattcagcgactccacgtccatcaccgttgacgatgacagccacggcgcggccggcgcctccgtctccccgtcccgcgcctcgccttccgcccggagcatcgccgcgcgctacctggccgtggccctcgtcgccgccgtctcgctgttcgcgcagcacgaggcctccaagggcttccgcatcgacgtcgtccggggcggcggcacggccggtgccgccggcaagcgcttcgacatgctcttcgtcgccaacggccgcgccgagcgcgtgctccaccgcgccagccgccgcgtcgaggaggcgctcttcccggacccctcgttcccgcgccgccgggtcgcccgcgtcaccgtgcggctgatggccggcggcaacctcaccgccgacgacgcgaccgtcgacgctgtcagggacggggagtacgtcatctcgctgagcccacgcctcctgtcgccgtcctccggcgccggggccgccgaggccgtcgccgccgcggtgcgccaggccgtggcgcgcatgtggctgtgggacggccgcggcgccgcgccggcgcgcgtcacggagtccatggtggagtacctcgccaccgccgtcccggacgagccgtcgtcgccggcggaggagcacgcgtcggcgtcgaacacgcagtgcatctcgccgcggttcctggagcacctggagcggcggcgcgccgggttcgtggcgcggctgaacagggcaatgagggaccggtggagcgacgccgcggtggacgccgccctggggtcgccggcccggcccgtctgcgccgcctacctcgcggcggcgacggaaaccggcggccaacgaccggtggttggctccgcggtggcggtttgagccagcaaggcgtcggaacagcgcaccaagggtggtttgcgagagatcgcacatgcacgccatgcttgtcacgtgactcagtcggtcaatcccttgtaaatgtaattgatccgccattatcggtgagtggttaattaagtaatgggatgagacgagtc

SEQ ID NO: 987 - DNA, 1195 bp, Avena sativa
cgcagagctctcttttgcttacaagcttcgccaaggcgagctgaacttatctagctagctgctcctcctgagtcctgacctgtcgccggccggccagccagccagacatggaagccccgctcctcctcccggtctccaccgccgcgtcctgctcctcttcctacatcaccgtcgacgacgacaccgcctcggtcgtccctccctcccccaaaccgtcctccccttccggcctgagcatcctcgcgcggtacctcgccgtcctcctcgtcgcgtcggtctccctcttcgcgcaccacgaggcctccaagggcttccgcatcgacgtcgtcagcgccgcgccgcagggcagcgtcgcgggaaggcgcttcgacctcctcttcgtctccaacggccgcgccgagcgcgtgctccaccgcgcaagccgcgccgtcgaggacgcgctcttcccggacccgtccttcccgcgccgccgcgtcacgcgcgtcaccgtgcggatggccggcggcggcaacctcaccgccgccgacgcgaccctggacgccgccgcggacggggagtacgtcatctctctgagcccacgcctcctgtccgacgccaaggccgtcgacgccgtggccgccgcggtgcgccgggccgtggcgcgcatgtggctgtgggacgcccgcggtgccgcgccggcgcgcgtcacggagtccatggtcgagtacctcgccaccgccgtcccggacgccgccgaagccgagtcgtcctcgccagcggacgcgtcgaacacgcactgcatctcgccgcggttcctgaagcacctggagcggcggcgcgccgggttcgtcgcgcggctcaacagggcaatgagggaccggtggagcgacgccgcggtggacgccgccctcggggcgccggcccggccggtctgcgcggcctacctcgccgccagcgtccaacgaccggtggttggctccgcgccggtcgctgatggatccaccgtggcagttgtttgagccagccagaaccagcgaatgcacacagcacaccatgtgtgtgtgtcacggaccccttgtgattattagtccatcattatgggtggttaattaagtaatggcagtatggcaccatgtgtgggctagctagttaaacacttgttctttgtaccgtacatgtaaatgatagcgtcctgaatacatacggtgagtcacaa

SEQ ID NO: 988 - DNA, 1220 bp, Avena sativa
ttgcttacaagcttcgccaaggcgagcttagcttatctagctagctgctcctgagtcctgacctgtcgccggccggccagccagccagacatggaagccccgctcctcctccccgtctccaccgccgcgtcctgctcctcctcctacatcaccgtcgacgacaacaccgcctcggccgcccctccctcccccaaaccgtcctccccttccggcttgagcatcgccgcccgctacctcgccgtcctcctcgtcgcctccgtctccctcttcgcgcaccacgaggcctccaagggcttccgcatcgacgtcgtcagcgccgcgccgcagggcacgctcgccggccgccggttcgacctcctcttcgtctccaacggccgcgccgagcgcgtgctccaccgcgcaagccgcgccgtcgaggacgcgctcttcccggacccgtccttcccgcgccgccgcgtcacgcgcgtcaccgtgcggatggacggcggtggcaacctcaccgccgccgacgcgaacctggacgccgccgcggacggggagtacgtcatctctctgagcccacgcctcctgtccgacgccgtggccgccgcggtgcgccgctccgtcgcgcgcatgtggctatgggacgcccgcggcgccgcgccggcgcgcgtcacggagtccatggtcgagtacctcgccaccgccgtcccggacgccgcagccgacgtcgagtcgtcctcgccagcggacgcgcacgacgcgtcgaacacgcggtgcatctcgccgcggttcctgaagcacctggagcggcggcgcgccgggttcgtcgcgcggctcaacagggcaatgagggaccggtggagcgacgccgcggtggacgccgccctcggcgcgccggcgcggccggtctgcgcggcctacctcgccgccagcgtccaacggccggtggttggctccgcgtcggccactgatggatccacggtggcagttgtttgagccagccagaaccagcgagcgcacacggcacaccatgtgtgtgtgtcacggcccccttgtgattattagtccatcattatgggtggttaattaagtaatggcagtatggcgctttgtgtgggctagctagttgaacacttgttctttgtactgtacatgtaaatgatgatagcgtcctgaatacatacggtgggtcacaaatcattctggaaagctcgagagaaaaccccttcgtgcccgtt

SEQ ID NO: 989 - DNA, 899 bp, Triticum aestivum
tagctggactgacatgaggccgccgctggcgtcgtcgtcttcttcttccattgctgccgccgctgcaacggctccctcctcctcctctgctcctccggccacaaccaggagagcactgctcttgtccacctcagccctcacgctcgccgccgtcgttcctgcagtggcccaggcagccgccaaccccttctccacgccctactcccagtcccggacgctgcagctcggcctcgacaccaacgggaagattcggacatgcccctccaccaatcccgggtgcgtctgcacgaatcccaccgtcggcgcctcctcctccgtcgcctccccgctcatcatcccggagtccacctccgccgacgctgccgctcagatgttgcggcaagccatcctcaagacgcagaagaatgtcagcttcaacgttgatcagcgaactccccacggccagtacatccaggccgaggtggacggcggcttcggccgggacgtgatggagttcctcgtgaagaaggacgccggcgttgtggcctaccgctgcgtcgccaccaaggtcaccttcgtctaccccttcaccaccgccatcggtgactcgcggggccaggagcagagggtcgccgccgtcgcgcaggagctcggctggtacgcgccggacataagatcctccgtcgacgacgttgctacataattaagctatgtaacgcgccgactgtgagatgcatttcaagatcaaacggcatgcatgcatgagattggtatatgtatgtagatcgatcgatcatggtcagttggtcactgggtcagataatttgtcgtccaatagccaccgcgcgatgtgtactactatggatttttatgcttggaaacttggaactccaatttttcatttgacataataccgctct

SEQ ID NO: 990 - DNA, 916 bp, Secale cereale
aacagctccctcctctgctcctccggccacaaccaggagagcactgctcttgtccacctcacccctcacgctcgccgccgtcgttcctgcagtggcccaggccgccgccaaccccttctccacgccctactcccagtcccggacgctgcagctcggcctcgacaccaacgggaagattcggacatgcccctccaccaatcccgggtgcgtgtgcaccaaccccaccgtcggcgcctcctcctccgtggcctccccgctcatcatcccggagagcaccacggccgacgctgccgctcaactcctgcggcaagccatcctcaagacgcagaagaatgtcagcttcaacgttgaccagcaaactccccacggccagtacatccaggcggaggtggacggcggcttcggccgggacgtgatggagttcctcgtgaagaaggacgccggcgtggtggcctaccgctgcgtcgccaccaaggtcaccttcgtctaccccttcacaaccgccatcggtgactcgcggggccaggagcagagggtcgccgccgtcgcgcaggagctcggctggtacgcgccggacataagatcctccgtcgacgacgttgctacataattaagctatgtaacgcgccgactgtgagatgcattttaagatcaaacggcatggtatatgtatgtagatcgatcgatcatggtcactgggtcacataatttgttgtccaatggggtttgttaacctggtttctcgagagtcgagaggtgggccattgattttatgaagtagtgagtctgattaacatcagtgcgggttttgagatttcaggggccggggtggaactatagtccgaagctcttcgggggcccttagtataaatgtctaactagtaatcatcatattagatataatttcacgcaaaac

SEQ ID NO: 991 - DNA, 1123 bp, Secale cereale
ccaatcaaaccaagaaaatcctcctcagcggagtggcaaagccagcagaagccaagcaaaccaagaaaatcctcctcagcggagtggcaaagccagcagaagccaagggcatggagagcgacggcagcgcgagccccaatggcggcgccgcctgcgcggtctgcggcggcgccgcggccttgtactgtccggcggacgcggcggctctctgcgtgccctgcgacgcggctgtccactccgccaaccctctggcctcccgccacgaccgcgtgccgctcgcggccgccgtggccgcgacctccggcgtgtacgacctcttcgcggctgacgaagaaggtgcggcgtcctggccgacgccggggcaggggagccccaacagcggctcatcgtccggcttcagtaacggcggcggcgtcgagatgagcctgtttgacctgctctccgacgtcgacctcctggccaccggcgccggtggaagcatgctatcggacggcagcgtcgcgccgttgtggctgccgcccagcctcgccgcggacggctccgctgcgtggacctcctcgtggtcgcagtcggaggctgtcgtcgtcccgtcggcggcggacagggcggagagggtcaggcggtaccgcgagaagcgcaagaaccgcaagttccagaagaccatccgctacgcctcccgcaaggcgtacgccgaggcgcggccgaggatcaagggccgcttcgtcaaacgccccgcggcgccggcgtcggacgacggcgacaacacggccaaattctggctctccttctccgacaacagtgtagggttccaagttgcatcccatggagtcgtgccaagcttctagaagggtgaaggtacttgatcgtggcaatggcgtctgcccagcttgaggcaaaatccagcaaagggcataaacgttggcgccatagtcttcctgtcgtgccgtcgttacagtcaatattcatggtaaaaccccgccatcgctatttttaactgatgacgcggggttttcgatcgatgggcgtaattttatttccatcgatgaactagtaggcgatcaatgtacttcctcggtctgttgttagtttcatgtgctaagatgaataaacaatcatgttaaat

SEQ ID NO: 992 - DNA, 1302 bp, Secale cereale
gactcgctcggtgattgctccgttgaccaatcaaaccaagaaatcctcctcagcggagtggcaaagccagcagaagccaagggcatggagagcgacggcagcgcgagccccaacggcggcgccgcctgcgcggtctgcggcggcgccgcggccttgtactgtccggcggacgcggcggctctctgcgtgccctgcgacgcggctgtccactcggcgaaccatctggcctcccgccacgagcgcgtgccgctcgcggccgccgtggccgcgacctccggcgtgtacgacctcttcgcggctgacgaagaaggcggctcgtcctggccggcgccggggcaggggcaggggagccccagcagcggctcgtccggcttcagtaaccgcggcggcgtcgagatgagcatgtttgacctgctctccgacgtcgacctcctggccaccggcgccggcggaagcatgctatcggacggcggcgtcgcgccgttgtggctgccgcccagcctctccgcggacggctccgccgcgtggacctcctcgtggccgccgtcggaggcagtcgtcgtcccttcggcggcggacagggcggagagggtcaggcggtaccgcgagaagcgcaagaaccgcaagttccaaaagaccatccgctacgcctcccgcaaggcgtacgccgaggcgcggccgaggatcaagggccgcttcgtcaaacgccctgcggcgccggcgtcggacgacggcgacaacacggccaaattctggctctccttctccgacaagagtgtagggttccaagttgcatcccatggagtcgtgccaagcttctagaagggtgaaggtacttgatcgtggcaatggcgtctgcccagcttgaggcaaaatccagcaaagggcataaacgttggcgccttagtcttcctgtcgtgccgtcgttacagtcaatattcatggtaaaaccccgccatcgctatttttaactgatgacgcggggttttcgatcgatgggcgtaattttatttccatcgatgaactagtaggcgattaatgtacttcctcagtctgttgttagttccatgtgttaagatgaataaacaatcatgttaaattcttgtaggaaccaaaaaaaaaaaaaaacaaaaaaaaaacaaaaaaaaaaaaacaaaaaaaaacaagaacaacacaacgaaacgaacaaacaacggaaggaagtaaggagaacacacacacacacacacacacacacacacacacacacacacacacacacacacacacacagtacagagatatacagtagtagtactatag

SEQ ID NO: 993 - DNA, 1004 bp, Leymus cinereus x Leymus triticoides
  misc_feature (95)..(95): n is a, c, g, or t
  misc_feature (98)..(98): n is a, c, g, or t
gcacgaggggcaagcagagaagtgcgagctcctccctcccctccgacccacgccgccgccaataacgaccaactcacgtgccctatccttcttcnccntctccttctccccccttttgttcgtctcctaaaccgccgccaacatggacgccaagaagaggtcgccgcccaccccctcagccgacggagccgcgccgcccgcggcgaacggatacttcagctccgtcttctcctcgtcgcctgcggcaaatccaagagacgctaggcagatggacctgtacaccttactgaacaagcagaaccccaaagggcagagtggtgggggcattgcagatgccaaatcccaaggcagccctactataggtcgtgttgcttacaaagatggaaaacagttttatccaaacgagtcctcagagtcaccttattttggctcctctgtgcattacggtggccgggacttctatgacagctctccacacaagcaagccaatgaatcatccagaaattataaggaggataatacggatggctccctggctaccagaggtgattggtggcaaggttcactttactactaaatacttcgcaatggactctcctactgtgaacaaggaataaaaaggagcaggtcgagctggtaggctgtagagttgacatgagtcatcaggcataagaaaagtcatagtggaactacatctgttctgtcggtggtggcagtatttagatgcatcagtcacctaggcagatgtagacgtactatgtgtttctcttttctttgccctatgtaccagatttgagtgatgaaatgtaatggaactggtagggcagcagcaagtaggtcttgcaaaaagttgctgctattttgcaactgacgagatcacttgttgtatgcgttatgtatcctggttcatggttgtgttttggtaatatttggatttgtacatctggtttggtctaccatttgtttgctgaaagaaccatgatataaacttgtgacaatggtta

SEQ ID NO: 994 - DNA, 939 bp, Avena sativa
ccacgaggcaagcagagaagtgcgagctcctccgtcccctccgacccgcgccgccgcctataacgaccacttcacgtgccctatccttctccccccccttttgtccgtctcctaaaccaccacacacatggacgccaagaagaagtcgccgcccacccccgcagccgccggagccgcgccggcggcggcgaacgggtactttagctccgtcttctccgcgtcgcctgcggcaaatccaagagacgcgaggcagacggacctgtacacgatgctgaacaagcagaaccccaaagggcagagtggtgggggcattgcagatggcaaatcccaagtcagtcctactaaaggttgcgttgcatacaaagatggaaaacagttttatccaaacgagtcctcagagtcaccttattttgggtcatctgtgcattacggcggacgagacttctatgacagctcgtctatcaagcaagccaacgaaccatcaagaaattataaggaggacaatccggatggctccctggcaaccagaggtgattggtggcaaggttcgctttactactgaataagttgccgatgactctcctattgttaacaaggaataaaaaggaggcaggtcagagatgatatgttgtagagttgacctgagtcatcaggcataaaaaggtcatagtggaactacatctgttatgtcggtggaggcagtatttagatgcatcatcccacctggacagatgtaggcttgtcatgtttctttttctttcttttcttccgccgtcgttacctatctagtgctgaaatgtagtgacgactggtacggcatcagcaagtaggtcctgcagaaaagttgctgctattttgcaactgtctagatcacttgctgtatgcgtcatgtatccttgttcgtggtatattttgggaatatttggatttgcacatcag

SEQ ID NO: 995 - DNA, 1057 bp, Triticum aestivum
gtcaagcagagaagtgcgagctcctccctcacctccgacccacgccacgccgccgccgccaataacgaccaactcacgtgccctatccttctccccccttttgttcgtctcctcctaaaccgccgccagcatggacgccaagaagaggtcgccgcccacccccgcggccgccggagccgcgccgcccgcggccaacgggtacttcagctcggtcttctccgcgtcgccgtcgcctgcggcaaatccaagagacgccaggcagatggacctgtacacgatactgaacaagcagaaccccaaagggcagagtggcgggggcattgcagatgccaaatcccaaggcagccctaccataggtcgtgttgcttacaaagatggaaaacagttttatccaaacgagtcctcggagtcaccttactttggctcgtctgtgcattacggtggccgggacttctatgacagctctccacacaagcaagccgatgagtcatccagaaattataaggaggataatgcggatggctccctggctaccagaggtgattggtggcaaggttcactttactactaaaaacactttgcaatggactctcctactgtgaacaaggaataaaaaggagtacgtcgagctggtaggctgtagagttgacatgagtcatcaggcataagaaaagtcatagtggaactacatctgttctgtcggtggtggcagtatttagatgcatcactcacctaggcagatgtagacgtactatgtgtatcttttctttgccttactagatttgagtgatgaaatgtaatgggactggcagggcagcagcaggtaggtcctacaaaaagttgctgctattttgcaactgacgagatcacttgctgtatgcgttatgtatcctggttcgtggttgtgttttggtaatatttggatttgcacatctgtttcggtctaccatttgtttgctgagagaaccatggtatgaacttgtgacagttatttataacctggtgcatttcttaagcttttagcctccttcacacggcacccagttggcattctact

SEQ ID NO: 996 - DNA, 1017 bp, Secale cereale
ccctccgacccacgccgccgccaataacgaccaactcacgtgctccatccttctccttctccccccttttgttcgtctcctaaaccgccgccagcatggatgccaagaagaggtcgccgcccgccccctcggccgccggagccgcgccgcccgcggccagcggatacttcagctccgtcttccccgcgtccgcgtcgcctgcggcaaatccaagagacgccaggcagatggacctgtacacgatactgaacaagcagaaccccaaagggcagagtggtgggggcattgcagatgccaaatcccagggcagccctactatagggcgtgttgcttacaaagatggaaaacagttttatccaaacgagtcctccgagtcaccttactttggctcgtctgtgcattacggtggccgggacttctatgacagctctccacacaagcaagccgatgaatcattcagaaattataaggaggataatgcggatggctccctggccaccagaggtgattggtggcaaggttcactttactactaaaaatactttgcaatggactctcctactgtgaacaaggaataaaaaggagcacgtcgagctggtaggctgtagagttgacatgagtcatcaggcataagaaaagtcatagtggaactatatctgttctgtcggtggtggcaatatttagatgcatcagtcacctaggcagatgtatacatactatgtgtctcttttctttgccttactagatttgagtgattaaatgtaatgggactggtagagcagcagcaagtaggtcatacaaaaagttgctgctattttgcaactgacgagatcacttgctgtatgcgttatgtatctggtttgtggttgtgttttggtaatatttggatatgcacgtctgtttcggtttaccatttgtttgctgagaggaaccatgatatgaacttgtgacaactagtagcgtgcatgtgcaatgcacgtctcgaaattcaaaaattagacgtaaccttgtaattcg

SEQ ID NO: 997 - DNA, 1128 bp, Triticum aestivum
gccacgaggcaagcaaagaagtgcgagctcctccctcccctccgacccacgccacgccgccgccaataacgaccaactcacgtgccctatccttctccttctcccccctttcgttcgtctcctaaaccgccgccagcatggacgccaagaagaggtcgccgcccgccccctcggccgccggagccgcgccgcccgcggccaacggatacttcagctccgtcttctccgcaccggcgtcgcctgcggcaaatccaagagacgccaggcagatggacctgtacacgatactgaacaagcagaaccccaaagggctgagtggcgggggcattgcagatgccaaatcccaaggcaaccctactaatggtcgtgttgcatataaagatggaaaacagttttatccaaacgagtcctcagagtcaccttattttggctcgtctgtgcattacggtggccgggacttctatgacagctctccacacaagcaagctgatgaatcatccagaaattataaggaggataatgcagatggctccctggctaccagaggtgattggtggcaaggttcactttactactaaaaatactttgcaatggactctcctactgtgaacaaggaataaaaaggagtacgtcgagctggtaggctgtagagttgacatgagtcatcaggcataagaaaagtcatagtggaactacatctgttctgtcggtggtggcagtatttagatgcatcagtcacctaggcagatgtagacgtactatgtgtctcttttcttcgccttactagatttgagtgatgaaatgtaatgggactggtagggcagcagcaagtaggtcctacaaaaagttgctgctattttgcaactgacgagatcacttgctgtatgcgttgtgtatcctggttcgtggttgtgttttagtaatatttggatttgcacatctgtttcagtctaccatttgtttgctgagagaatcatgctatgaacttgtgacaatggtttataccctggtgcatttcttaagcttttagcctccttcacacggcacccagttggcattctactactatgttctttcctgtttatatggcttgtattcctagattgtcaatttagtcaatgaaataaa

SEQ ID NO: 998 - DNA, 1114 bp, Triticum aestivum
cgagctcctccctcccctccgacccacgccacgccgccgccaataacgaccaactcacgtgccctatccttctccttctccccccttttgttcgtctcctaaaccgccgccagcatggacgccaagaagaggtcgccgcccgccccctcggccgccggagccgcgccccccgcggccaacggatacttcaactccgtcttctccgcgccggcgtcgcctgcggcaaatccaagagacgccaggcagatggacctgtacacgatactgaacaagcagaaccccaaagggcagagtggtgggggcattgcaggtaatgccaaatcccaaggcagccctaccataggtcgtgttgcttacaaagatggaaaacagttttatccaaacgagtcctcggagtcaccttactttggctcgtctgtgcattacggtggccgggacttctatgacagctctccacacaagcaagccgatgagtcatccagaaattataaggaggataatgcggatggctccctggctaccagaggtgattggtggcaaggttcactttactactaaaaacactttagcaatggactctcctactgtgaacaaggaataaaaaggagtacgtcgagctggtaggctgtagagttgacatgagtcatcaggcataagaaaagtcatagtggaactacatctgttctgtcggtggtggcagtatttagatgcatcagtcacctaggcagatgtagacgtactatgtgtctcttttctttgccttactagatttgagtgatgaaatgtaatgggactggtagggcagcagcaagtaggtcctacaaaaagttgctgctattttgcaactgacgagatcacttgctgtatgcgttatgtatcctggttcgtggttgtgttttggtaatatttggatttgcacatctgtttcggtctaccatttgtttgctgacagaaccatgatatgaacttgtgacaatggtttacacgctggtgcatttcttaagcttttagcctccttcacacggcacccagttgggaatctactactctgttcttttctgtttataaggctcacgtgtattcctagattatcaatttagtcaatgaaataaaa

SEQ ID NO: 999 - DNA, 940 bp, Pseudoroegneria spicata
ggcaagcatagaagtgcgagctcctccctcccctccgacccgcgccgccgccaataacgaccaactcacgtgccctatccttctccttctccccccttttgttcgtctcctaaaccgccgccagcatggacgccaagaagaggtcgccgcccaccccctcggccgccggagccgcgccgcccgcggcgaacggatacttcaactccgtcttctccgcgtcggcgtcgcctgcggcaaatccaagagacgctaggcagattgacctgtacacgatactgaacaagcagaaccccaaaggacagagtggtgggggcattgcagaagccaaatcccaaggcagccctactattggtcgtgttgcttacaaagatggaaaacagttttatccaaacgagtcctccgagccaccttattttggctcctctgtgcattacggtggccgggacttctatgacagctctccacacaagcaagccaatgaatcatccagaaattataaggaggataatgcagatgactccctggctaccagaggtgattggtggcaaggttcactttactactaaatactttgcaatggactctcctactgtgaacaaggaataaaaaggagtacgtcgagctggtaggctgtagagttgacatgagtcatcaggcataagaaaagtcatagtggaactacatctgttcgtcggtggtggcagtatttagatgcatcagtcacctaggcagatgtagacgtactatgtgtgtctcttttctttgcctttccagatttgagtgatgataagtaatgagactagtagggcagcagcaagtaggtcctacaaaaagttgctgctattttgcaactgacgagatcacttgctgtatgcgttatgtatcctggttcatggctgtgtgttggtaatattttgatttgcacatctgtttcggtcta

SEQ ID NO: 1000 - DNA, 1014 bp, Secale cereale
agctcctccctcccctccgacccacgccgccgccaataacgaccaactcacgtgctctatccttctccatccttctccttctccccccttttgttcgtctcctaaaccgccgccagcatggacgccaagaagaggtcgccgcccgccccctcggccgccggagccgcgccgcccgcggtcagcggatacttcagctccgtcttccccgcgtcggcgtcgcctgcggcaaatccaagagacgccaggcagatggacctgtacacgatactgaacaagcagaaccccaaagggcagagtggcgggggcattgcagatgccaaatcccaaggcagccctactaatggtcgtgttggatataaagatggaaaacagttttacccaaatgagtcctcagagtcgccttattttggctcctctgtgcattacggtggccgggacttctatgacagctctccacgcaagcaagccgatgaatcatccagaaattataaggaggataatgcggatggctcgttggctaccagaggtgactggtggcaaggttcactttactactaaatactttgcaatggactctcctactgtgaacaaggaataaaaaggagtacgtcgagctggtaggctgtagagttgacatgagtcatcaggcataagaaaagtcatagtggaactacatctgttctgtcggtggtggcagtatttagatgcatcagtcacctaggcagatgtatacgtactatgcgtctcttttctttgccttactagatttgagtgatgaaatgtaatgggactggtagagcagcaggaagtaggtcctacaaaaagttgttgctattttgcaactgacgagatcacttgctgtatgcgttatgtatcctggttcatggttgtgttttaataatatttgcatttgcacgtctgtttgggtttaccatttgtttgctgagagaatcttgatctgaacttgtgataactagtaagcgtgcacgtgcaatgcacgtctccaaattaaac

SEQ ID NO: 1001 - DNA, 1090 bp, Triticum aestivum
agagcgccacgaggcaagcagagaagtgcgagctcctccctcccctccgacccacgccacgccgccgccaataacgaccaactcacgtgccctatccttctccttctccccccttttgttcgtctcctaaaccgccgccagcatggacgccaagaagaggtcgccgcccgccccctcggccgccggagccgcgccccccgcggccaacggatacttcaactccgtcttctccgcgccggcgtcgcctgcggcaaatccaagagacgccaggcagatggacctgtacacgatactgaacaagcagaaccccaaagggcagagtggtgggggcattgcagatgccaaatcccatggcagccctactataggtcgtgttgcttaccaagatggaaaacagttttatccaaacgagtcctcagagtcaccttattttggctcgtctgtgcattacggtggccgggacttctatgacagctctccacacaagcaagctgatgaatcacccagaaattataaggaggataatgcggatggctccctggctaccagaggtgattggtggcaaggttcgctttactactaaaaatactttgcaatggactctcctactgtgaacaaggaataaaaaggagtacgtcgagctggtaggctgtagagttgacatgagtcatcaggcataagaaaagtcatagtggaactacatctgttccgtcggtggtggcagtatttagatgcatcagtcacctaggcagacgtagacgtaccatgtgtctcttttctttgccttactagatttgagtgatgaaatgtaatgggactggtagggcagcagcaagtaggtcctacaaaaagttgctgctattttgcaactgacgagatcacttgctgtatgcgttatgtatcctagttcgtggttgtgttttggtaatatttggatttgcacatctgtttcggtctaccatttgtttgctgacagaaccatgatatgaacttgtgacaatggtttacacgctggtgcatttcttaagcttttagcctccttcacacggcacccagttggcattctactactatgttctttcctgtttat

SEQ ID NO: 1002 - DNA, 488 bp, Hordeum vulgare
tagagagaagtgcgagctcctccctctcctccgacccgcgccgccgcctataacgaccacttcacgtggcctatccttctccccctttttgttcctcgcctaaaccaccacaagcatggaggccaagaagtcgccgcccacccctgcctccaccggatcggcggcggcggggaacggatacttcagctccgtcttctccgcgtcgcctgcggcaaatccaagagacgccaggcagatggacctgtacacgatgctgaacaagcagaaccccaaagggcagagcggtgggggcactgcagatggcaaatcccaaggaagccctgctaaaggtcgggttgcttacaaagatggaaaacaattttacccaaacgagtcctcagagtcgccttattgtggttcggctgtgcattacggcggccggggcttctatgacagctctccacacaaggcgggccaatgaatcattgagaaatataaggaggatacac

SEQ ID NO: 1003 - DNA, 901 bp, Pseudoroegneria spicata
agatagccgcccgcctcccctctccccaccacacggccacaacccgactcaccaccgcgcctcttcctcctccctctccacccatggcgacggctatgatggctgcagccaccacctcctgctccccgcgccgggcgctcctcaagcccgtggcctcctccagctccgcgccgccgcccaggccgcagccacggtccttcctcaagcagctcccggggctcgccgcgacggcggcggcggcggccgtcgcctccgtgcctctcccggcgctggccgtggagatggagaaggcggcgctgttcgacttcaacctgacgctcccggcgatcacgatcgagttcctgctgctgatggtggcgctggacaagctctacttctcgccgctgggcaagttcatggacgagcgggacgccaagatccgcgcggagctcggcggcgtcaaggacgcctccgaggaggtgcggcagctggaggagcaggcccaggccattctcaaggcggcgcgcgcggagatcgcggcggcgctcaacaagatgaagaaggagacgaccaaggagctggaggcgaagctggacgagggccgccgccgcgtggaggccgagctggtggaggcgctcgcgagcctcgaggggcagaaggaggaggccatcaaggcgctggacgcgcagatcgtgtcgctcagcgacgagatcgtcaagaaggtgctcccatccgcgtgaaaacactagtagatcacgcagcgcgcagcagccggcgcaatcccccgtttcatagtaaagatttctagttcttggtgtgtaatgtatacgcccactgggctgcctcccctaagaatgtaactgaaccaaacattctgtgatcgggtataaatgaatgatccttttgtacattaaaaaaaaaa

SEQ ID NO: 1004 - DNA, 939 bp, Secale cereale
cgtgtggcctccgttggttggcaaaccacaggccaccccgttcggatagatagccgcccgcctcccctctccccaccacacggccacaacccaattcaccaccgcgcctctccctcctccctctcacccacccatggcgacggctatgatggctgcagccaccacctcctgctccccgcgccgagcgctcctcaagcccgtggcctcctccagctccccgccgccgcccaggccgcagcctcggtctttcctcaagcagctcccgggtctcgccgcgacggcggcggcggcggccgtcgcctccgtgcctctcccggcgctggccgtggagatggagaaggccgcgctgttcgacttcaacctgacgctcccggctatcacgatcgagttcctgctgctgatggttgcgctcgacaagctctacttctcgccgctgggcaagttcatggacgagcgggacgccaagatccgcgcggagctcggcggcgtcaaggacgcgtccgaggaggtgcggcagcttgaggaacaggcccaggccattcttaaggccgcgcgcgcggagatcgcggcggcgctcaacaagatgaagaaggagacgaccaaggagctggaggcgaagctcgacgagggccgccgccgcgtggaggcagagctcgtggaggcgctcgcgagcctcgaggggcagaaggaggaggccatcaaggcgctggacgcgcagatcgtgtcgctcagcgacgagatcgtcaagaaggtgctcccatccgcgtgaaaacactagtagatcacgcagcaagcagcagccggcgcaatcccccgtttcatagtaaagatttctagttcttgatgtgtaatgtatacgcccactgggctgcctcccctaagaatgtaactgaatcgacattctgtgatcacgtataaatgaatgatccttttgtacac

SEQ ID NO: 1005 - DNA, 914 bp, Leymus cinereus x Leymus triticoides
  misc_feature (774)..(774): n is a, c, g, or t
  misc_feature (803)..(803): n is a, c, g, or t
gcacgaggcaacccgactcaccaccgcgcctcttcctcctccctctcacccacccatggcgacggctatgatggctgcagccaccacctcctgctccccgcgccgagcgctcctcaagcccgtggcctcctccagctccgcgccgccgcccaggccgcagccacggtccttcctcaagcagctcccggggctcgccgcgacggcggcggcggcggccgtcgcctccgtgcctctcccggcgctggccgtggagatggagaaggcggcgctgttcgacttcaacctgacgctcccggcgatcacgatcgagttcctgctgctgatggtggcgctggacaagctctacttctcgccgctgggcaagttcatggacgagcgggacgccaagatccgcgcggagctcggcggcgttaaggacgcctccgaggaggtgcggcagctggaggagcaggcccaggcgattctcaaggcggcccgcgcggagatcgcggcggcgctcaacaagatgaagaaggagacgaccgcggagctggaggcgaagctcgacgagggccgccgccgcgtggaggccgagctcgtggaggcgctcgcaagcctcgaggggcagaaggaggaggccatcaaggagctggacgcgcagatcgtgtcgctcagcgacgagatcgtcaagaaggtgctcccatccgcgtgaagacactactagatcacgcagcacgcagcagccggcgcaatcctccatttcatagtaaagatttctagttcttgatgtgtaangtatacgcccactgggctgcctcccctangaatgtaactgaatcaaacattctgtgatcaggtataaatgaatgatccttttgtacactactgtgtcttcaatctgggtggtgctttcagctttgatccccaaatcatta

SEQ ID NO: 1006 - DNA, 1101 bp, Triticum aestivum
gtggcctccgttggctggcaaaccacaggccaccccgttcggatagatagccgcccgcctcccctctccccaccacacggccacaacccgactcaccaccgcgcctcttcctcctcccgctcacccacccatggcgacggctatgatggctgcagccaccacctcctgctccccgcgccgagcgctcctcaagcccgcggcctcctccagctccgcgccgccgcccaggccgcagcctcggtccttcctcaagcagctcccggggctcgccgcgacggcggcggcggcggccgtcgcctccgtgcctctcccggcgctggccgtggagatggagaaggcggcgctgttcgacttcaacctgacgctcccggcgatcacgatcgagttcctgctgctgatggtggcgctggacaagctctacttctcgccgctgggcaagttcatggacgagcgggacgccaagatccgcgcggagctcggcggcgtcaaggacgcctccgaggaggtgcggcagctggaggagcaggcccaggccattctcaaggcggcgcgcgcggagatcgcggcggcgctcaacaagatgaagaaggagacgaccacggagctggaggcgaagctcgacgagggccgccgccgcgtggaggcagagctcgtggaggcgctcgcgagcctcgaggggcagaaggaggaggccatcaaggcgctggacgcgcagatcgtgtcgctcagcgacgagatcgtcaagaaggtgctcccatccgcgtgaaaacattagtagatcacgcagcgcgcagcagccggcgcaatcccccgtttcatagtaaagatttctagttcttgatgtgtaatgtatacgcccactgggctgcctcccctaagaatgtaactgaatcaaacattctgtgatcgggtataaatgaatgatccttttgtacactactctgtcctgaatctaagtggtcctttaatccccaattcatttatttccgggagaacccaaatatagtgttaaaaacgctattatattataggacgggggaatactaaagtagaatgtcctttgtttatgacatgttgttagacattattctttagcaattt

SEQ ID NO: 1007 - DNA, 897 bp, Avena sativa
ctcccggcgctggccgtggagatggagaaggccacaactccactctcctcctccctctcacccagacccagccatggcgacggctatgatggctgcagccaccacctcctgccgggcactcctgaagcccttggcctcctccagctccgcgccgccgccgaggccgcggtccctactgaagcagctcccgggtctcgtcgccaccgcggcggcggcggccgtggcctccgcgccgctcccggcgctggccgtggagatggagaaggccgcgctgttcgacttcaacctgaccctcccggcgatcacgatcgagttcctgctgctgatggtggcgctggacaagctctacttctcgccgctgggcaagttcatggacgagcgggacgccaagatccggtcggagctgggcggcgtcaaggacgcctccgaggaggtgcggcagctggaggagcaggcccaggccatcctgaaggcggcccgcgcggagatcgccgcggcgctcaacaagatgaagaaggagaccaccacggagctggaggcgaagctggacgagggccgccgccgcgtggaggccgagcttgtggaggcgctctccagcctcgaggcacagaaggaggaggccgtcaaggcgctcgacgcacagatcgcgtccctcagcgacgagatcgtcaagaaggtgctcccgtccgcttgaaaacaaaacacaacaccagatcacgcagcagccggcgcgatcctccattttactcgcctcgtaaagattcttattatctagtagttcttcccttgtaatgtatacgccgctgggttagtagccctgccccacttcagaatgtaactgaatcaacattttgtgatcaagtataaatgaatgatccttttgtaataaaaaaaaaa

SEQ ID NO: 1008 - DNA, 845 bp, Avena sativa
ctctcacccagacccagccatggcgacggctatgatggctgcagccaccacctcttgccgggccctcctgaagcccgtggcctcctccagctccgcgccgccgccgaggccgcggtccctactgaagcagctcccgggtctcgtcgcgaccgcggcggcggcggccgtggccgccgcgccgctcccggctctggccgtggagatggagaaggccgcgctgttcgacttcaacctgaccctcccggcgatcacgatcgagttcctgctgctgatggtggcgctggacaagctctacttctcgccgctgggcaagttcatggacgagcgggacgccaagatccggtcggagctgggcggcgtcaaggacgcctccgaggaggtgcggcagctggaggagcaggcccaggccatcctgaaggcggcccgcgcggagatcgccgcagcgctcaacaagatgaagaaggagaccaccacggagctggaggcgaagctggacgagggccgccgccgcgtcgaggccgagcttgtggaggcgctctccagcctcgaggcgcagaaggaggaggccgtcaaggcgctcgacgcacagatcgcgtccctcagcgacgagatcgtcaagaaggtgctcccgtccgcttgaaaacacaacaccagatcacgcagcagccggcgcgatcctccattttactcgcctcgtaaagattcttattatctagtagttcttcccttgtaatgtatacgccgctgggttagtagccctgccccacttcagaatgtaactgaatcaacattttgtgatcaagtataaatgaatgatccttttgtataaatactgtgacggttgc

SEQ ID NO: 1009 - DNA, 1728 bp, Brachypodium distachyon
cgggccggccccgttcggatagatagccaataggccaggccgcgcatcgtgtggcctccgttgcccggaacaccaggagccaaccgtttggatagatagccgatagcccgcctccctctctcctctcctctcccctccccaccgcaactggactcgccgcgcctcctctcactcccctcctcctctcgcccccacccatggcgacggctatgatggctgcagccaccacctcctgctccccgcgccgagcgccgctggccctcaagcccgtggcctcctccagctccgctccgccgccgcccaggccgcagccgcggcggtccttcaagcagctcccggggctcgtctcaacggcggcagcggctgcggcggcggccgtagtctccgcgcctctcccggcgctagcagccgatatcgagaaggcggcgctcttcgacttcaacctcacgctccccttcatcacgatcgagttcctgctgctcatggtggcgctggacaagctctacttctcgccgctgggcaagttcatggacgaccgggacgccaagatccgcgccgagctgggcggcgtcaaggacgcgtccgaggagctgcggcagctggaggagcaggcccaggccgtgctcaaggcggcccgcgcggagatcgccgccgcgctcaacaagatgaagaaggagaccaccacggagctggaggccaagctggacgagggccgccgcgccgtggaggccgagctcgtcgaggcgctcggcaacctcgaggcgcagaaggaggaggccatcaaggcgctggacgcgcagatcgcgtcgctcagcgacgagatcgtcaagaaggtgctcccgtccgcgtgaagatctcacccagcagccccgcccaatcctccatttcctcgtaaagattccacttcttgacgaatgaatcatgtgtgtaatgtagtatacgcccttgggctgcttcacattagtggccctatttatcttgtgatcaggtataaatgaatgatccttttgtacataattgtgtccttattgttgcttgggtcccctattttgatcctcttcctgcaagccgcgattggatccccgctcatggactgggaggcagagagctaccgcgcctgcccggactttgcggccctcaacttcttcatcgtgccccgaggctgtaaaagcgtacacgattcccccctgcgccgctcagtttcgaatcgtttgttctgtgtgccttcatctgatcaaactgtgaagcttgagttgtttggttactagagtagataatgggggtgttgaagatgagtgtttctgttaattatttgatctaagggctgctagtgtggtcataattaacacatgttggtagaatgaagaaatttagacatcaaattaaaatgttaatgagtggatatttatcaagctggtttatgttaattcaagtatattgccttcatataagttgtaatcatcacacaaattttagattctctgctcgtcataattcaagtggtgagaactgtgcttgctaggatgcatgaattaatgtatggggagttatcatttgattttgtgagctactgaacacacatgtctacctgcataagtgcatcttcttttttcaatgcaaacactggtagatctccacatcgatttgtaacatgtaattaacaaattcagacttcagaatacatattgtgtctaccattggatattgttcttatcatattcgtgtaca

SEQ ID NO: 1010 - DNA, 1017 bp, Oryza sativa
gatggagcagcggcgtcgtgtggccttggttgcttcggaatctcaccacccaacccgttcggattagatagcccgcttcctcctctctctctcagctcaccacacctcgagtcgccgccgccgccgccgctgctgctgcttacctcctccgcgccgcgcactccttgcactagcccatggcgacggctatgatggctgcgaccgccacctcgtgctcccctcgccgcgcgccggtcgtcgcgtcgtcgtccgtgcagccgcccaggcggcagcagcagcagcaaccgcggaggggattgaagcagctgccggggctcgtggcgacggcggccgtggccgtggccgcggcgccgctaccggcgctggcggagcagatggagaaggcggcgctgttcgacttcaacctgacgctcccgctgatcgcgaccgagttcctgctgctgatggtggcgctggacaagctctacttcacgccgctgggcaagttcatggacgagcgcgacgccaagatccgtgccgagctcggcggcgtcaaggacgcgtccgaggaggtgcggcagctggaggagcaggccgccgccgtgctgaaggcggcacgcgccgagatcgccgcggcgctcaacaagatgaagaaggagaccacccaggagctggaggcgaagctggacgaggggcgccgccgcgtcgaggccgagctcgtggaggcgctcgccaacctcgaggcgcagaaggaggaggccgtcaaggcgctcgacgcccagatcgcctccctcagcgacgagatcgtcaagaaggtgctcccatccgcgtaatggccgccccgccgccggccgttcttgcctcccaaacaccaaccatctctcgtaaagattttctccgtgttttatccgtgtgtatacgctgcttctcctaagaatgtaatttcagtgaacttctcgtgataagtataaaatcaatgatccttttgctagaaattggattgaaattataaactgctttaataagtgcttactcatt

SEQ ID NO: 1011 - DNA, 4378 bp, Oryza sativa
ctcctcacactataccacaactatcgcgtatagagctcccacctccatatagacttacgcgacctccccttcttatttcaagtaggttgtgttctataggaaaggacgaagagtagtttttcatgcgcaatttcgccttgtgtttttttaaaaaaatttctatatggaagttgtaaaaaacttattgatatattgtttcagttcacaatcctcacaaataatgcagtaagcacttattaaagcagtttataatttcaatccaatttctagcaaaaggatcattgattttatacttatcacgagaagttcactgaaattacattcttaggagaagcagcgtatacacacggataaaacacggagaaaatctttacgagagatggttggtgtttgggaggcaagaacggccggcggcggggcggccattacgcggatgggagcaccttcttgacgatctcgtcgctgagggaggcgatctgggcgtcgagcgccttgacggcctcctccttctgcgcctcgaggttggcgagcgcctccacgagctcggcctcgacgcggcggcgcccctcgtccagcttcgcctccagctcctgggtggtctccttcttcatcttgttgagcgccgcggcgatctcggcgcgtgccgccttcagcacggcggcggcctgctcctccagctgccgcacctcctcggacgcgtccttgacgccgccgagctcggcacggatcttggcgtcgcgctcgtccatgaacttgcccagcggcgtgaagtagagcttgtccagcgccaccatcagcagcaggaactcggtcgcgatcagcgggagcgtcaggttgaagtcgaacagcgccgccttctccatctgctccgccagcgccggtagcggcgccgcggccacggccacggccgccgtcgccacgagccccggcagctgcttcaatcccctccgcggttgctgctgctgctgccgcctgggcggctgcacggacgacgacgcgacgaccggcgcgcggcgaggggagcacgaggtggcggtcgcagccatcatagccgtcgccatgggctagtgcaaggagtgcgcggcgcggaggaggtaagcagcagcagcggcggcggcggcggcgactcgaggtgtggtgagctgagagagagaggaggaagcgggctatctaatccgaacgggttgggtggtgagattccgaagcaaccaaggccacacgacgccgctgctccatcgccgccactaaaaaacctctcctcgatatatcacgccaatttgggccgtacaaaactagttgggcccattagcccatccaaattttaggcccctacaaaagcacaacgggccgtagcctgtttagtactactacaatcccgagcgttcactccccctcccgcatccaacggctctggagaaattctacgtcatcgatccgcctcccacccatgtcgaccaatggggttccaccacgcgcctatatataattgaggccttcttccccttttgcctcaactccacgcgaagggaaaaggtcttcctcctcctcacgaatcccgcctctctctctctctctctctctctctctctctctctctctccatttgagccgatccctcgagaggcagctccgatggcgcccaaggcagagaagaagccggcggagaagaagcccgcagccggcgaggagaagtcggcggagaaggcgccggcggggaagaagcccaaggcggagaagcggctgccggcgtcgaaggcgtcgtccaaggagggcggcgccggcgacaagaaggggaggaagaaggcgaagaagagcgtcgagacctacaagatctacatcttcaaggtcctgaagcaggtgcacccggacatcggaatctcctccaaggccatgtcgatcatgaactccttcatcaacgacatcttcgagaagctcgcgcaggaggccgcccgcctcgcccgctacaacaagaagcccaccatcacctcccgcgagatccagacctccgtccgcctcgtcctccccggcgagctcgccaagcacgccgtctccgagggcaccaaggcggtcaccaagttcaccagcaactaggcctgtctctctagggtttcgatgccatgcttctctccttccctttcccctcgtgtgcagtgtgctaggtggcagtagttgcaaacttgtgcctgctttgtaaattgtgcttgatcataatgggcagcttggatttgaagtaatagacgtgtcgagtgttatttattgtcggtggctgattcgcatcttgtgtttttcttttctctttgcgattgcgatttggggatctagggtttgaggagatgatgctgcgaggtgggcggctgggtggcttggcctctcggatggttggagccaagcctttcagcacggagatatttgtgagcagtccgcttgtgatgatctgtgcgtcagaacttcatgagtgaatggggtttcttgatctggtgtgattctggggggtgtggtggatgaaatgagcactaaatgggctatcattttacacaacagaggaagaacttaaaaatgtcttctcaccatttggcgctgttgaggaagctcgattggtaagagaaccaaactggaaggccaaaaggatttggttttgttaaatattcttctcaagcagacggagagaaagctgttaaggaaatggatggacggatcattcgtggaagactaatttttgtggaaattgcaaaagaataaaactgcatagggcatagtctatcaccatcgttgctgaactggtgcagttttcctgccttaaaccgtactcgtacatggctaatctggctcagttccaacaagacctatgagcacttctcctgtcctgaatgcgtaattttgtgacttttgttgagcccagtattggtttgcgaacaacattgtttgttttttttttaagacaaaagaaagctttcaaacaggaaaattgttgttggaaggttaggttgaatttatgaacccgggctggaaggttatatgtgcgtagaatgctggatgacccatatacccgcccctgctccactagctatttcttccaccgttttcttctgtgtcatctataaagcgatattgtttgaatttgatctcaaaagtattaaagccgtgatgtatatccgatgaactggttttggatggctttgtaccctacgtcagagtaatgtgatcattgacatgtggaccatgtggacctatgaacacattacctaagagcatctccaactgtctctccaaattaaactctctaaatacccatatagtcagctttcagtcgatttagcaagccaaacttattcctcactccaatattcttttcatctacactcttcattacaagcctatgacactgggacccacacgtcagcctctactcctctctccctcttcctcttctgtcggccctcttcccgtgcaggtgattggcgacggcggtgacgcggtgattggcgatggcggcggcggcttgcaacggttacctcgacgacggccatggagcagaggtggaggccgcgcggcccccgaatccaccccgccggccaaatacgcgcggggccggaggccgcgcagaggcagtggaggtcacgccccccaccctgaatccggcggcggtggaggcggcggaggcggcgctagggagtggcgcgacgttgggacgacgatgcggggaggcggcggacgcggacgcggcaaatcggcgcaggcagcggaccgctgttgccgacgcatgccgatggacggcggccccccaacgccgacgctcgccgaggtgctctccctctccccgccaactactccccgtagtcgagcgccgtcgagctccagacggcgaaggatggcggcccagaccttggcgacgacagcagctggcggccagacggcggcggaggtcgcgcggccccctgattccacgccgccggccgaatccggcgaggaaggaggcgtaggagtccacacgggggaagaaggcaaagcggctgccgccggagagggatccgaccccttcttccccatcatcgctgctccctcgttgccgtcgccaacacagcctcccttgctcctgcctcgtcatcgcggagctctcttggtgacggaggaaatcggacggcgacgacggtgcaggtgggaggcggcgacagcgcgggacggcgatggcgcggtacgacgatggcggcggcgattgatctgtgcggggagagagagagagagagagagaggagagatttgggggggggggagcaacgtggggcccatggctagcagccaatttggctaggcaggcgggatggccaaatttggcgtagccaagagccaatttggtggccagtcggatggagaggctgtt

SEQ ID NO: 1012 - DNA, 1666 bp, Panicum virgatum
ccgccgcgcgaggtgattggtcaagaggggtgggatgcggatcgatgaggtggcgtaagccatagacgttggattttttgggagcgggaggacggatggtggagagtgcatcttattttccgcgggtagtgacgcaccgacgtaatagatgggcgcctctgcgcgtgtttttccggtggaaaatttcagaccctgatgataacagttcgggaatttcgccccattccgtttgttttcatttcttgggcttggcgcttgctctctcaaccagggcccatttgcactatacgggctcgatggagtggtgaggattctgagccaacgtgcggcgccatggagagtagggaagaatttcggcccaggaaacatcccggacccaaagcgggcgggaaactactagcccagaaggggctcggaatgacacgggccttctccgaagcacaaaactgactggacgggaatatcgggaaggaacgtggtagcgaagcgtgcatcggcatcgtgtggccgccgttcgtcggggcacggcaacccaagccgttcggatagatagccggtggcccgcctcccctcttcctaccgcaccaccaccaccactgaactagccgccgccgcacttccacccccaactctccccgcctcgcacccatggcgacggccctgatggctgcggccaccacctcatgctccccgcgccgcgcggcgccgctcctgaagccggtggcctcctcctcgtctagctcggcgcggccgcgacggccctcggcgcagcagctcccgcggctgctggcgacggcgacggcggcggtggcggccgcgccgctcccggcgctggcggagcagatggagaaggcggcgctcttcgacttcaacctgacgctcccggcgatcgcgatcgagttcctgctgctcatggtcgcgctggacaagctctacttcacgccgctcggcaagttcatggacgagcgggacgccaagatccgcggcgagctaggagacgtcaaggacgcctccgaggaggtgaagcagctggaggagcaggccgccgccatcctgaaggccgcgcgcgccgagatcggcggcgctcaacaagatgaagaaggagaccaccgcggactggaggccaagctggacgagggccgccgccgcgtggaggccgagctcgtcgaggcgctcgccaacctcgagtcccagaaggaggaggccgtcaaggcgctcgacgcgcagatcgcctcgctcagcgacgagatcgtcaagaaggtgctcccatccgcgtgagcgaatcaaaacagcgagccggccggccggccttcttccttgcttagcttctgatctgtgtgtatacgcttgttgggctgccgtccattgccggccctgctttatcctatgatgtgtgtaattgcatcaacattttgtggcaagtataaatgaatcaatcatatttctgaagaaatttgggtggtttagattctacagtcgcttataaaatgtttgggattattggcgacttgcactgaggttgttctgtaaaagttgcctgaatctttcacgcttcttgtgtgatcctggttcgagtcaggcgaaagggaatgtttactgttctttaggtcaatcgccaaggcgttctcaaatcacaatcaagtttagtatggagccatctgaatca

SEQ ID NO: 1013 - DNA, 1066 bp, Setaria italica
gaatatcgggaagggaatgcactcgtggtagtgaagcgagcatcggcatcgtgtggccgccgttcatcggccaccacaacccaacccgttcggatagatagccggtcgcccgcctcccccctccgtctctccccaccacccctccactgagctagccgccgctcttccacacccacccctccggctccccgcctcgcacccatggcgacggctctgatggctgcggccaccacctcctgctccccgcgccgcgcggcgccgctcctgaagccgatggcctcctcctcgtcctcgcccagctcggcgcgggcgcggcggcccctggcgcagcagctcccgcggctgctggcgacggcggcggcggcggtggcggccgcaccgctcccggcgctggcggagcagatggagaaggcggcgctcttcgacttcaacctgacgctcccggcgatcgcgaccgagttcctgctgctcatggtggcgctggacaagctctacttcacgccgctcggcaagttcatggacgagcgggacgccaagatccgcggcgagcttggcgacgtcaaggacgcctccgaggaggtcaagcagctggaggagcaggcggccgccatcatgaaggccgcgcgcgccgagatcgccgcggcgctcaacaagatgaagaaggagaccaccgccgagctggaggccaagctggacgagggccgccgccgcgtcgaggccgagctcgtcgaggcgctcgccaacctcgaggcgcagaaggaggaggccgtcaaggcgctcgacgcacagatcgcctcgctcagcgacgagatcgtcaagaaggtgctcccatccgcgtgaggaaaccggaccagcgagccggccggatggcctcttcttcctcgcttagctttctgatctgtgtgtatacgcttgttgggctgccgtccatcggcggccctgctttatcctatgactgtaattgcatcgacattttgtgccaagtataaatgaaatatttttttgaagaaaattggggtggatttaagattctacagtcgcttacaagaagttcgggattattgac

SEQ ID NO: 1014 - DNA, 886 bp, Pennisetum glaucum
accaccccatctcctgagctagccgccgctcttccacgcccacccctctccggctctccctgccacgcacccatggcgccggctctgatggctgcggccaccacctcctgctccccgcgccgcgcggcgccgatcctgaagccggtggcctcctcctcgtcctcgcccaactcggcgcggccgcggcggcccctggcgcagcagctcccgcggctgctggcgacggcggcggcggtggtggcggccgcgccgctcccggcgctggcggagcagatggagaaggcgcagctcttcgacttcaacctgacgctcccggcgatcgcgaccgagttcctgctgctcatggtggcgctggacaagctctacttcacgccgctcggcaagttcatggacgagcgggacgccaagatccgcggcgagctcggcgacgtcaaggacgcctccgaggaggtcaagcagctggaggagcaggccgccgccatcatgaaggccgcgcgcgccgagatcgctgcggcgctcaacaagatgaagaaggagaccaccgccgagctagaggccaagctggacgagggccgccgccgcgtcgaggccgagctcgtcgaggcgctcgccaacctcgaggcgcagaaggaggaggccatcaaggcgctcgacgcgcagatcgcctctctcagcgacgagatcgtcaagaaggtgctcccatccgcgtgaggaagccacaccagcgagccggccggatggcctcttcttcctcgcttagctttctaatctgtgtgtatacgcttgttgggctgccgtccattggcggccctgctatatcctacgatctcactgtaattgcatcgacattttgcggcaagtataaatgaaacgatatttttgaaga

SEQ ID NO: 1015 - DNA, 1413 bp, Panicum virgatum
tgctagtagcccgagccattcataacatttgacaaaatttcggccgaggaaacatccggggcccgaagcgggcgggaagactactggcccaggaggggctcggaatgacgacacgggcctggcctttaccgaagcacaaaactggacgggaatatcggcaatgcactcgtggtagcgaagcgtgcatcggcatcgtgtggccgccgttcgttagcgcaccgcaacccaacaacccgttcggatagatagccggtggcccgcctcccctcttcctaccacaccaccacggaactcgccgccgccgcacttccactccccgcctcgcacccatggcgacgaccctgatggctgcggccaccacctcctgctccccgcgccgcgcggcgccgctcctgatgaagccggtggcctcctcctcgtctagctcggcgcggccgcggcggcccttggcgcagcagctcccgcggctgctggcgacggcggcggcggcggtggcggccgcgccgctcccggcgctggcggagcagatggagaaggcggcgctcttcgacttcaacctgacgctcccggcgatcgcgaccgagttcctgctgctcatggtcgcgctggacaagctctacttcacgccgctcggcaagttcatggacgagcgggacgccaagatccgcggcgagctcggcgacgtcaaggacgcctccgaggaggtcaagcagctggaggagcaggccgccgccatcatgaaggcggcgcgcgccgaatcgccgggcgctcaacaagatgaagaaggagaccaccgccgagctggaggccaagctggacgagggccgccgccgcgtcgaggccgagctcgtcgaggcgctcgccaacctcgaatcccagaaggaggaggccgtcaaggcgctcgacgcgcagatcgcctcgctcagcgacgagatcgtcaagaaggtgctcccatccgcgtgagggggaatcgaaacagcgagccagccttcttccttgctcagctttctgatctgtgtgtatacgcttgttgggccgccgtccgttgccggccctgctttatcctatgatgactgtaactgcatcaacattttgtggcaagtataaatgaatcaatcatatttttgaagaaatttgggtggcttagattctacagtcgcgtataaaatgtttgggattataggcgagttgcactgaggttgttatgtaaaaattgcctaaatctttcacgcttcttgtgtgatcctggctccaagctccaagctgcctgaaacattaggagctgtgtacaataaaacaccatgaactgtgctaccgtgaagaggaagattagaagtccaacacaaaagaagtattttgatatgtgatttcttcgaatgaaaaatccaatatctaactgagtgtagttcaact

SEQ ID NO: 1016 - DNA, 856 bp, Zea mays
agctggtcgcccgcccgcctcccttcttcccaccacacctccagtcctccactgacaagccgccgccgctcttccacctacctctccccggcctcgcacccatggccacggctttgatggttgcagccaccacctcctgctccccgggccgcgccgcgccgcgcctgaagccggtggcctcctcctcctccagcagcagcagcagcgctcggcgcggccgcggcggcccttggcgcagcagctcccgcggctgctggcgacggcggcggcggcggcggtagcagccgcgccgctcccggcgctggcggagcagatggagaaggccgcactgtttgacttcaacctgacgctcccggcgatcgcgaccgagttcctgctgctcatggtggcgctggacaagctctacttcacgccgctaggcaagttcatggatgagcgggacgccaagatccgcggtgagctcggcgatgtcaagggcgcctccgaggaggtgaagcagctggaggaccaggcggcggccatcatgaaggcggcgcgcgccgagatcgcggcggcgcttaacaagatgaagaaggagaccaccgcggagctggaggccaagctggacgagggacgcagccgtgtggaggccgagctcgtagaggcgctcgccaacctcgaggcgcagaaggaggaggctgttaaggcgctcgacgcccagatcgcctcgctcagtgatgagatcgtcaagaaggtgctcccatccgcgtgatgaaaccaaaccggccctgccttatcctatgactatagttacatgaacatcataaattaatgataattttgaagaaattggccgatgactccgacactgtactca

SEQ ID NO: 1017 - DNA, 1476 bp, Sorghum bicolor
ttgggccaagaatcacacgggccttttctgacgaagcacaaaatagaatatcggggagagcattcgtggtagcgaagcgagcatctgcatcgtgtggccgccgttcgtcgggacaccgcaacccaaccccgttcggatagatagccggccgcccgcctccctcccttctccccaccacacctccactgacaagccgccgccgctgctcttccacgcccccaccgcacctctcccggcctcgcacccatggccacggctatgatggctgcatccaccacctcgtgctctccgcgccgtgctgcgccggtcctgaagccggtggcctcctcctcctcctcctccagcagcagctcggcgcggccgcggcggcccttggcgcagcagctcccgcggctgctggcgacggcggcggcggcggtggctgcagcgccgctcccggtgctggcggagcagatggagaaggcccagctgttcgacttcaacctgacgctcccggcgatcgcgaccgagttcctgctgctcatggtggcgctggacaagctctacttcacgcccctgggcaagttcatggacgagcgggacgccaagatccgcggcgagctcggcgacgtcaaggacgcctccgaggaggtgaagcagctggaggaccaggcggccgccatcatgaaggcggcgcgcgccgagatcgcggcggcgctcaacaagatgaagaaggagaccaccgcggagctggagggcaagctggaggagggccgcagccgcgtggaggccgagctcgtcgaggcgctcgccaacctcgaggcgcagaaggaggaggccgtcaaggcgctcgacgcgcagatcgcctcgctcagcgacgagatcgtcaagaaggtgctcccatccgcgtgagggaaccaaaccagcgagccggcgggcgttcctttctttagctttctgatgatcagtgtgtatacgcttgtcgggctgccgtccatgggcggccgcggccctgccttcttatcttatgactgtaattgcatcgagaaaataaacgaatgataattttgaagaaatctcagactctgtactcaactactcatgaaagattactggatggtgctgtgttcaccgcctgtgttggattgctggcagactcgcagtgaggtttacttgatacgcttgtgcaactagtgattgcaaccattaaaaccataggatacatttcgtcctagtgatttaccattcaatcttaagttatatccaatccaaatgattcttcatttggcactaatatgtaactcggctcactcgctattcgttctaggccttgagccaagttcaaagttggatcatgctctgggcactctcgaaccatctcagatcttcaactgcaaccatcatgcctcaatgggtccttactcatcatcatcatcttcttcctctgagcgtgagatctcatcgctgctactctcgcagcctcttaacacctgtttc

SEQ ID NO: 1018 - DNA, 1776 bp, Triticum aestivum
aaaacaagcggagcgaagcgagccacctccaagtccaaccccacagccaccggaaccgaaacgagacgcacgccccacgccgactccgccgttcgctcactccccgccccgccgttcccgtcgccacccttcgccgacgcgggcaagagaagaagccgaaagagagaaagcgtcccccacctcgcccggatcccgcgagcgggcccatgtcccactcgacactgctcgtccggccgccggcgccggcgaatccgtcccttccgcttcgccggtgcgcgcccgtatccgcagcggcggcgacgctccgcacgtttcctgccgcctcctccgtggctcagttctctaggctgcgcaccaagtgcaggtttgccgcccccggtgtcagagaagattactcttctacgccaatcgatgtcgtagcagacgtgaaaacagaaaagattgtagtgttgggaggaagtggatttgttggttctgctatatgcagagctgcagtagctaaaggcattgaggttgtgagcctcagcaggtcaggaagaccatcttactctgatccttgggctgatgaagttacttggctagcaggagatgttttctatgcaagatgggaggacgtgctagtaggggctactgctgttgtgtctacccttggaggatttggtaatgaagaacagatgaaaaggataaatggtgaagcaaataccatagcagtagacgccgcgaaagaatttgggatcccgaaatttattttgatctctgttcatgattacaaccttccatcctttctccttacctcgggctatttcactggtaagagaaaggctgaatctgaagtcctctccaaatacccatcctcaggtgttgtattgaggcctgggtttatttacggtaaaaggaaagtcgatggctacgagataccactcgacatagtaggacaaccactagagaagctactttcctctgtcgaaaatttcaccaaaccattgagtgcattgcctggttcggacctggtccttgcatcccctgtgaacgtggacgatgtcgcctacgccgtgatcaacgccgtcatagacgacagcttcttcggcgtattcacaatcgaacaaatcaaggaagcggcagccagtgccagagtgtagagatctccatatctggaagtaccttacgagggatgctcatgttgttgcaaatcttccataataggggatagctcaaggccaaactcagtactgcaatgctgtgcttagagagtttaaatgcactaacacaatccattccaaaagctgtagttgttcatagcaggcaacactcttcacaagggttcatcttgtaacggcccatgcatacatagctgaaatacgagcacaaaaatgggttgcaacaagcttcaccatcagaagaaccccacgtttattctttaacctcacacataacctcggttgcctagtacggcctcaggcaatcgaagaggcggcggtgatccgatgagacggcttcctccgacgagcctgataacggagacctgatgatggacgacggtgagatgccggttggcgtcaggcactgcctcggcgctcccgctcccgggctgtcttccccgtgcgccggcggcggccggcacgcgcctgggctgccaagctgcagcacctgcatctgcatcttcatcctctgctccctcctcaccatgttgcgcttgttcacgtagtcctcgtggatgaacacgtccattgacgcctctctatctctctccgattctggactactcctgcctccaaa

SEQ ID NO: 1019 - DNA, 1332 bp, Leymus cinereus x Leymus triticoides
  misc_feature (17)..(17): n is a, c, g, or t
  misc_feature (59)..(60): n is a, c, g, or t
  misc_feature (669)..(669): n is a, c, g, or t
  misc_feature (1305)..(1305): n is a, c, g, or t
agccaccggaaacgaancgagacgcacgccccacgccgttcgcccactccccgccccgnngttcccgtcgccacccttcgccgacgcgggcaagagaagaagcggaaagagagaaagcttcccccaccccgccgggatcccgcgagctggcccatgtccccctcgacactgctcgtccggccgccggtgccggcgaatccgtcccttccgcctcgccggtgcgtgcccgtatcagcagcggcagcgacgctccgcacgtcacctgccgcctcctccgtggctcagttctctaggctgcaaaccaagtgcaggtttgctgcccccggtgtcagagaagattactcttctacgccaatcgacgtcgtagccgacgtgaaaacagaaaagattgtagtgttgggaggaagtggatttgttggttctgctatatgcagagctgcagtagctaaaggcattgaggctgtgagcctcagcaggtcaggacgaccatcttactctgatccttgggctgatgaagttacttggctagcaggagatgttttctatgcaagatgggaggacgtgctagtaggggctactgctgttgtgtctaccattggaggatttggtaatgaagaacagatgaaaaggataaatggtgaagcaaataccatagcagtagacgctgcnaaagaatttgggatcccgaaatttattttgatctctgttcatgattacaaccttccatcctttctccttacctcgggctatttcactggtaagagaaaggctgaatctgaagtcctctccaaatacccatcctcaggtgttgtattgaggcctgggtttatttacggtaaaaggaaagtagatggctacgagataccgctcgacatcgtagggcaaccactagagaagctactttcctctgtcgaaaatttcaccaaaccattgagtgcattgcctggttcggacctggtcctcgcatcccctgtgaacgtggacgatgtcgcctacgcggtgatcaacgccgtcatagatgacagcttcttcggcgtgttcacaatcgagcaaatcaaggaagcggcagccagtgccagagtgtagagatctgcatatctggaagtaccttacggaattatgagggatgctcatgttgttgcaaatcttccataatagtgggtagctcaaggctgcaatgctgtgcttagagagtttaaatgcactaacacaatccattccaaaagctgtagttgttcatagcaggcaacactggttactttactaggattgatcttgtaacggcccatacatacatagctgaantacgagcacaaaaatgggttgcaacaa

SEQ ID NO: 1020 - DNA, 1730 bp, Secale cereale
aaccccacagtcaccgtaaacgaaacgagaagcacgcccactccccgccccgccgttcgcctcgccagtcgccactcttcgccgacgcgggcaagagaagaagccgaaagagacaaagcgtcccccaccccgcccagatcccgcgagcgaacccatgtccccctcgacactgctcgtccggccgccggcgccggcgaatccttcccttccgcatcgccggtgcgcgcccgtatcagcagcgtcagcgacgctccgcacgtctcctgccgcctcctccgtggctcagttctctaggctgcgcaccaagtgcaggtttgctgccaccggtgtcagagaagattactcttctacgccaatcgatgtcgtagcagacgtgaaaacagaaaagattgtagtgttgggaggaagtggatttgttggttctgctatatgcagagctgcagtagctaaaggcattgaggttgtgagcctcagcaggtcaggaagaccatcttactctgatccttgggctgatgaagtcacttggctagcaggagatgttttctatgcaagatgggaggatgtgctagtaggggctactgctgttgtgtctacccttggaggatttggtaatgaagaacagatgaaaaggataaatggtgaagcaaatacgatagcagtagacgctgcgaaagaatttgggatcccgaaatttattttgatctctgttcatgattacaaccttccatcctttctccttacctcgggctatttcactggtaaaagaaaggctgaatctgaagtcctctccaaatacccatcctcaggtgttgtattgaggcctgggtttatctatggtaaaaggaaagtcgatggctacgagataccgctcgacatcgtagggcaaccactagagaagctactttcctctgtcgaaaatttcaccaaaccattgagtgcattgcctggttcggacctggtcctcgcaccccctgtgaacgtagacgatgtcgcctacgccgtgatcaacgccgtcataaatgacaacttcttcggagtgttcacaatcgagcaaatcaaggaagcagcagccaatgccagagtgtagagatctgcatatctggaagtaccttatggagttgcaaatcttctataatactagtggatagctcaaggccaaactcagtactgaaatgttgtgcttagagagtttaaatgcactaacacaatccattccaaaagctgtagttgttcatagcgtgcagcactctttgctatggttgatcttgtaacggcccatacatacgtacatagctgaaacacgagcacaaaaatgggttgcaacaactttcaccatcagaagaaccccaggtttattcttgaacctcacacataacctcggttgcctagtacggcttcaggcaatcgtagaggcggcagtgatccgtggagacggtttcctccggcgagcctgacgcgggagacccgagggtggatgatggtgagacgccggtcggcgtcggcgtctgctgcagcgctcccgggctcttcatgtgtgccggcgctggccgacacgcgcctgggtcgcccagcttcagcacctgcatctgcatcttcttcctctgctccctcctcaccatgttgcgcttgttcacgtagtcctcgtggatgaacacgtccatcgacgcctccctctccgattctgaactagtacttccaaagtcctaacataaatggccgcaaaacaagtc

SEQ ID NO: 1021 - DNA, 2554 bp, Avena sativa
ataggcccacaacatccccagaagacaaccctctcgcagctctgctcggctggagaggtcgtccagcaggctgatgccggaggaatcgtggtgggcagcggtggggatgacgtccaataggcggtggccggaggaatccttgtggaagacggtgaggaggacgtccagaaggcgcgcgagagaaacaatagaggagaggttggggaatgaccgcctcggccagacctgatgtgcgacggcgccggccaggaactcgccggcgagctggtaggacaggagggaaccttatctgtttgacgtttatttaatttagccctgttgttttgttttattcaaaaataacccatgtgaatggttagtgcctgtcagatggggtcaatgtagtgccaagtcaacagatacgacgttgtaccagccccggtgactagagatgatcctctaactcgtatttagtgaccgtataatagtatttttgatgtacaatgatcgaactaattttgtttgacaagttcagtgactattgatgaatttaactctaaactgagaaccgttgttcatgtcgaccgcgggtccgcggccgtgtcactgctccccgcgccacaccaggcccgaaccacaggagaacgagtgaagcgagccacaggaaacggaaggagacacacatcccacgcccactccccgccccgccgctcccttcgccgacgcgggcaagagtagaggcgaaacgagagcgcgcccgggtcccgcatgtccccctcggcactgctcgtccggccgccggcgccgacgagtccgtctgttccgcctcgccggtgcgcggccgcgtcagcatcagcagcggcagcgacgctccgcacgtctcccgccgtctcccacttctccaggctgcggaccaagtgcagatttgccgcccccggtgttagcgaggactactctgcgccaatcgatgtcgtcgccgacgtgaaaacagagaagattgttgtattgggaggaagtggatttgttgggtctgctatttgcagagctgctgtggcaaaaggcatcgaggttgtgagcctgagcaggtcaggaagaccatcttactccgacccctgggctgatgaagttacttggctagcaggagatgttttctatgcaagatgggaggacatcttagtaggggctactgctgttgtgtctacccttggaggttttggtaacgaagaacagatgaaaaggataaatggtgaagcaaatgctatcgcagtagacgccgcgaaagaatttggagtcccaaaattcattttgatctctgtgcatgattacaatcttccatcgtttcttcttacctcgggctacttcactggcaagagaaaggctgaatctgaagtcctctccaaatacccttccacaggtgttgtattgaggccgggctttatttacggtaaaaggaaagtggacggctttgagataccgctcgactttgtaggacaaccattagagaagctgctttcgtctgtggaaaatttcaccagaccactgagcgcattgcctggttcagacctggtccttgcgccgccggtgagcgtggacgatgttgcctatgcagtgatcaacgccgtgatagatgacaccttcttcggcgtgttcacaatcgagcaaatcaaggaggccgcggccaacgtcagagtgtaaagatttttcctgcctagctggaagtgcgttatgtaagttatgagggatgttcctgtcctcgcaaatctctcataatactagtggattagcttacggccaaactcaatgctgcagtgcagtgcttagagtgtttattaaatgcactagtaacaagttccagtgagaagttgtggagaagttggtcatggctggcaacactcatagtacttcactagggtttatctatcttgtaacagtccatgcatacatggggtaaaattaaggttttgctacatcaagtacagtagataccgaacagcacgagagctacagcttgtgctggcatccatttgagccagataggtgaggtgaggtgaggtagtacacggcgaatggctgacacgaacgcaaaagatgagctgcaagttgcaacgaaaggaccgaatcaccaccatcaaaaccccatgtttattcagactgtcgcataacctcggttgcctagtacggcttgaggcagtcgaagaggcggcggtgatcagaagaaacggctccctccgctgggcttgccgtgggggacctgagggtggacggcgacatgccggtgggcgtcgtgcactggctcggcactctggggctctcctcccgccgtgccgacgctgacgccgacgccgaccgagaagcgccaggattgcccgacgccggccgcagctgcagctcctgcatctgaatcttcttcctctgctcccgcctcacctcgttgcgcttgttcacgtagtcctcgtggatgaacacgtccatcttctcctcgctcactccacaacaatcaactatactctagactcgtcgcatgctatgctactaagatgaagggcacatcacttagactactactactaccaag

SEQ ID NO: 1022 - DNA, 1895 bp, Brachypodium distachyon
cagcgccaagcgagccagccacctccaaagtctccaaccccacaccgcccacaggaaacgagtcgacgacacatttgtagaagcgggagaggacgcgtccggcctccccctcgatgtccccttcgacactgccgcttgtccggccgccggcgccggcaaatccgtcccttccgcctcgccggtgccctccgttatcagcagcgacgctgcgcgcggctcctgccgcctccgccctcgcccagttctctaggctgcgcaccaagtgcaggttttctgcttctggcgtcagagaagactactcttctacgccaatcgatgttgttgccgacgtgaaaacagagaagattgtagtgttgggagggagtggatttgttggcactgctatatgcaaagctgctgtcgctaaaggcattgaggttgtgagcttcagcaggtcaggaagaccatcttcctatgatccctgggctgatgaagttacttggctagcaggagatgttttctatgcaagatgggatgaagtgttggtaggggctactgctgttgtgtctacccttggaggatttggcaatgaagaacagatgaaaaggataaatggtgaagcaaataccatagcagtggatgctgcaaaagaattcggaatcccaaaattcattttgatttctgttcatgattacaaccttccgtcctttcttcttacctcgggctatttcactggtaagagaaaggctgaatctgaagtcctctccaagtacccttcctcaggtgttgtgttgaggccaggatttatttacggtaaaaggaaagtagatggcttcgagataccactcgacattgtagggaaaccactagagcagctactttcatctgtcgaaaatttcaccaaaccgttgagtgcattgcctgcttcagacctgatccttgcacccccagtgaacgtggatgatgttgcctatgctgtgatcaacgctgtcatagatgacagcttctttggcgtgttcacgatcgagcaaatcaaggaagctgcagccagcgccagagtgtaaagatttccatacctggaagtaacttctgaagtcatgagggatattcctgttcttgaagaaggaaaacaaaatcttgggttatagtggatagttaagtccaaactctatgcagtgcagtccttagagagttgaatacactaacaagttttattcaaaaagctgtggttcatggcagacaatactcacttcaccagggtttaccacgttacacatatggtaaaacctggagctacaatgaataccggagttacggaacaagcacacgccaacagcagtcaaagaaggctggctgctagctgatctatttgagccgggtgcaggcaaggcaaagttgcaacgaaatgcaaagtcttcaccatcaaaaccccacgtttattcagccctagatgcctagtatggcttgaggcagtcgaataggcagcggtgatccgacgaaacgccttcctctgccaccgccgacgagcttgacgtgggagacctgacggtggacgatgacatgccggtcggtgtcgggcaccggctcggtgctcccgggctctcctccccacacgccggcgccggacgagacgccgtctgcctccgctggagcatctgcaactgcttcctctgttctcttctcacctcgttgcgcttgttcacgtagtcctcgtggatgaacacgtccatcgcttcctctggaacctgaactacccccgaagactcctcacatgctacggactacttgagcactaataacacgaacaaaaacgcaagagcaaggggacagtttatactgcggatggtgtccagcagtgacgacgaggtcgctgtcgcattttgacatttcttacaaggtgtaggagctggattggt

SEQ ID NO: 1023 - DNA, 10654 bp, Oryza sativa
gtcatctcctcctcccctcccttcccatggaggcggagccgccgccggagaaccgccacgacgaccaccacccctccacttccggcggaggcctgggctacttccacctccgcctcctctgccccgccgcgccactcctcctcctcctccgctccgaccgcctctactccctctccctctcccgccgccgcggcccccgcctccgcctcctcgcctcccctcgccgccgccacggccggcgacggcgggccctcctcctcagcacatcgggctgcgccctccgcctcacccaccgctcctccagcgccgacgccgtgcgcgtcaacggccggcccctcctccgcggtgggtgcccggccgatctggccgtcggcgacgaggtctcgctactccgccgtggcaccaggtatggattcttggtggagaaattcgtctcctgcgaacggcccaaattggcggcggcggagccctgcggggaggttcttgtgctgcgggccgagtcgctccggaagcggctgagggcgatctcggagagtcatgatcctctctctttcttgagggattcacattgtgtggagaacggcagcgatgatgttagggtgaaaaaggcgagagaagaagatgttttcttgcccctgaacctgaatgctccaattgaccctgttgccgtggagggtttactgcgagaagactgtaatcttggccaggggaaattggagcactgcactgattcagcaattgcaaaaaatgaaactgatgaattgattcaacggagcaaggggtcctgcgatggcaatacagagcagaaggaatacagcaatgagaacacagagcagcagcacaatgagaatgagggttgctattcagatgggagcacattcttcctgaatcgcctcattggtattgggtctgatatgagggtggagcaacggagtggagtgacacttccacagcttctgcatcccatggatagcttggagcgagtatttatcgcaacattcacctccgatgtttcctggtttctggattactgtaaggttccacagaacctgccggtgacgatagcatgccacaacaaggagaggtgctggagtgcgagtcgcgaaagtagaaccgctgcccctttcggaagttatcctaacctactattagtttacccccaattcccagaggagatagcatttggaaaggataggaagaagcaaggagtggcatgccaccatccaaagctcttagtgctacagaggaaagacagcatgcgtgtcattgtcacttcagctaacttagtacctaggcagtggcatctcataacaaacacggtgtggtggcaagatttcccttgtaggacatccacagattattcagctctttttagtaaagttgaggaatcaaaatcagatttcgctactcaattagtttcattcatagcattccttatcaatgaagttcctagccaatcatattggataaatgagatagccaagtataattttgaaggagctgctggatacctcattgcttccgttccagggatatatgcacgcaatcctcactatctggagtccaattattgcctttcaagaaaacagatattacacaccaaatcggcacataggatgtttcttggttctgtccaaacatccgtagttggtctgtcccatcggtttcatataccatctgatgctggttctaaactgaaagccctgtctgtacttcttagtaaatgccatgtgaacatgcatggaactacagaagtgatcttgaagaggaatacaaatatacctgcagatgctaatgctgtgagtgtcctagttgctgatctggataaatttaccgaggaagattcagtccatcttggtttcctgcctagagaggttgcaaagtgggtatctcccctcagtgacttggggttcttcacattttctggatttatctaccccagagaagccctggaagctgcatatggagcaactaacacaaaagtgcagttgcttctctatgtatcaaagggtccagagttttctcaaatttcaagactgatccaggatgaacattttcctcttctgtgctcattagtagcatccttaaagcggtcccttggactttggcgattagaagaggtgttgtcacatttcaaatggcctgaaacacttgagactgattttttctacagtgcttcatccattgggacttcaattaatccacaattcattgcaagctttgcttcagcagctggtaaacgatgtaatcaggatttggactccgaagagtctgatccagagtggggttgctggacagcaaaccatgagctaaagaagccatctatcaatttgttgtttccaacaattgacagagtgaaaaatggggcttgtggaattcagttatccaggcatttgctttctcttcctgagagaacatggcaaagactgagatctactggcatatttcgtgacgcaatcccacatccatacgagaggatagggcatcctatgcatgtcaaggttgcccagagacgcttcgagtctcgtctaggcagacactcattcggctggacttactgtgggtctcacaatttcagtccagcagcctggggacaacaacttcctccaccaaaagcaaatcctactgaagccagagccgtttcttctggtccgaggctacacatttgcaactatgagctcggcatcatcctcattattccaccatctgccatgtcaaagcagatcagtggaaggaggcacgagatcaatgacattgtcctgccattcgtcgtccctccaccgcaatataagctgggcgataggcctgcgacatcgttagccatgcgagaggccatggctgaagctagaattctgcagagtaacgatttagtactggacttgtcacaggatacagacgaggatatacctgatgaagatgatgagcatgtgattgagctgtctgattgctcccctgaagagaaggaagaggagaagatctacgcagagacgctgtgggagcaagtagactcttcacaaagaccaggctggccagtgaagttgaagtccagatgtttcggatgacaagttcctgtcatcgcatctgatttcaagtgcaggcagccgcacgagatctgacgattctttcttactgaagatatttgattcgattgtgatttgttagaattgtattttacaatgtgtagtatgcattcgttgtcaatctttcttgtaagtatctcaatacatctatacttgaacttcacagcgtatatagttgaagtttatttcaaaaacttttattgagctctaatctgaaattctgaatcagtctgctagtgctagggggtacatgttttacaccacagaagaatcacaaccgtccaaacagttctggacggtgtggatgcttcgcctggaacttgtgttcaccaccccaaaaaaataaaaataaaatccaccgtgtcaatccccacgccacaccagaggccacacgccacagccacaggaaacacacaagcaggcgacgtggcagccagagaggggctaagcctccaaccccacactcacagccgcgcgccgcaggaaaaaggtggaaaaccaccgcccacgcgggacgcgccgccgccgccgctcgccgccgcaccctcacgcgcagaggaggagcccccccgccggagcacctccacctgtttactctgagtgacatgtccccctcgccgctgctcgcccggccgccggcgccgtcgagcccgagcacgtacccgtccctcccgcctcgccggtgcgccccggctgtagcttccgcggcgctccgcgtggctccagccaccgcctcccgagccccattctccaggctggtgaccaagcggaatttcgctgcgtctgatattagagaagactactccactccgattgacgtcgttgccgatgtgaaaaccgagaagattgtggtgttgggagggagtggattcgttggctctgctatctgcaaagctgctgtctctaagggtattgaggttgtgagcctcagcaggtcagggagaccatcttactctgatccttgggttgatcaagttacttggctagcaggagatgttttctatgcaagatgggatgaagtgttagttggtgccactgctgttgtgtctacccttggaggattcggtaatgaagaacagatgaaaaggataaacggtgaggcaaatgtaacagcagtagatgctgcaaaagaatttggaatccccaaattcattttaatttctgttcatgattacaatcttccatcctttcttcttaactcgggttacttcactggtaagagaaaggctgaatctgaagtcctctccaaatacccaacctcaggtgttgtactgaggcctggtttcatttatggtaaaaggaaagtagatggttttgagataccactcgatgttgtaggacaaccattagaaaagctactttcctctgttgaaaatttcacaaaaccgctgagttcattgccagcttctgacttactccttgcacccccagtgagtgtggatgatgttgcctatgctgtgatcaatggagttatagatgacagcttctttggtgtcttcacgattgagcaaatcaaggaagccgcggcgaaagtaagagtgtaaactgggagtctttattgccaagatggaagattcaaacatgcggctccttattaagagatatccctgttctgtcttgcactcttgcagtcttagatcatacattcaatggttaaagttaaattcaaaactttgtacagtgtatgaatgtggtgcttgttccctccaagcagagaggaagaatgggctttgatggcaaaggccaatgcgcttcatttcttacgagatgcattgccaaatgaatgttcttctggagtacttgtttaaggtggaagtaatcactgattctctgaacctaaccccgtattcaggttgacaccatatccatatgctcatatgcttaacatggacagtaaaaaaaaatttagataggttttgtgttacgagtgcccctagatatggtgttctatgatttttttagataggttttgtgttaagtgtgagtgaacttgttaacttatcactcgactgtgccgagtgctcttctgagcaacaagcacaactaaatatacacatgtaattaaatgaaaaatactcaaacaagcaccatgtaacaaatgctgttgattttttttggtcatttcaatgatacaccaatgttacatgttcatgtgatagatcaatttggtcctaaaatgtaaaccgttggaatttgtcctgtgcagcagtcaaggctgcgtaagtagatccactgaattttcaccataaaatccatctttattcacttgcactgttgcacatgtaacatagacataggctagtacggcttgaggcagtcaaagagacggtgacccaccgtctcggcagcttccgccgccgtcgcgctcgccgtcggtgacccgactgtggtcgacggcccgccggtcagtgtcaggcactgcgccggcactctcgggctctcccggggctccggcgccggcggagacacgccggcgagcgcctgctccatctgcagctgcttcctcctctgctccctcctcacctcgttgcgcttgttcacgtagtcctcgtggatgaatacctccatcctctcccagaactctaccaaaactaactactacaaagtacaaactaacctcgaaaccgaaagaaacttcacattagatcgacagtacttgacacaaactcagatgaagaagtgagagttacactgaagaaaactgcatgtttatatgggtgtcaaagagaggaggaggtcgccatcatcggtcgctttaacctttaaccatttttacaaagcgcagcctgctattagtctatgccaacgctgcaaaaaaaaaaaaagcctgtattattatggcatggccgaattgcttcatgcttggtggagaaatggttaaaagagaggacttcacaatgccaattcctatggccattccttggtcttttgtgttatagaatgcttgctgtcctttgtctgttgctcctgtgatggtgtggttttaggtttaattaagacatcgttgtcatgagtgatgtgttaaaactcagggattcgtggtgtacatgggtaggtgaataggacaaacggtgtgttccaggttggaccaacctatagctctcccggtcactatccctgcaaaagaaaacaggtagctgcttgcttgcggcgacatggaattggtggatcaggattcaggaatcacaaaattgataccagagatctgtgaaatttgttatgtgtgatgtgaccaagattcatcatccaccacatgatatcttcttcagattgccacatggccttcttcagatttggtatgctacttgattggtagtacttgcaactttgcaagtcctccatttgttctgggagtggcctttccatggatcatctccacatatctataatatcttcagattaataacaagagaaaacaggcaatcccacaccatggctcatacttggattgctaacagtttttttttttttaaaaaaaacaaggaacaattataacaacatgagctaatgaaagcttcagactattccattctgctcttctgattgtaatgccacagaagagcatcagtgtttaagtcatgtgcaaaattatgacaaacaaatttgccgtccaccttttgatctaacaaaagggctggtcactcccaaaactccagatggatatatacacatcatttcgtttattaactatcacacgagattcctaaaacacattcatatgcgaacatccgcaaaactttttaccagttgataagcttgttgcatgaattctgcatcttcagagtgaagttgacgctgtcattgtcctttgagcatttccaaggatgataacaatgatggtaacatcatcgtggtactttctcctgctcccaacaggtatcctcatcaattcttcagctgttaaagctggcacaacataggaagaacaaaaggtgaagagttagttaagtccctgatatcaacataactccaaaaatggagcaatgatgctaattatgcaaaatataaaaatcatcaaaggtgtaatttctttcaaaagagattattaactgtccctgcatctacaagatactatagagcttaattaattaagtctaagggtgtaataatatggaatatgcatttcagcgcaaaagaatcttaatgctaactatttcatattttaatactaaaattataaaactgataatatatttcggatgatacctgcttccttcgctgctttaagtaaaagttgctcaatgagatactttgcaggatcaccaattggattatcatgcataaattgataaaccaactgaacaacttcgtcattgctgaagaaatcaaataagccatcactaccaagcacaacaaacaaatcatcctctgtgactttatgactaactgtgtgaggatttgtgtacacataaggcgggctgcacaaattacgaactcggagaattcccatgagtgcatcgttcaacttcttctgcaaattgacatgtaaagcatgtgtattagtaaaatcataagaacagagatgcattaatgctctttcttcccaaacaaaattatagtacgttacctgttttagatagccaactccaaaagcacgagtaaccttcagcttcccctttattttgttacccatcacaactgatggctcattaggatgatcagctaaaagtttttggtactccaatggattttcaagtgagtggatctcagtcaattgaacagccttcaatttatccattcctgaagacggcactgaagcaagcacagctctactatccccaagatttaagatgcacaaatctgttccatgtagaagcacaaccagaacacaagacccaactgatactaaatctggtctatcgtccatctcttgttcaaccatgcataaaaagtcattttcagcttgctcaacagcagtagtgaggcacttaagcacaccagctcgaaatgtttcagaaaatttcacatcttcattttctgcaaatctcatggccagtgttaactcacttttaacaccattaagagagccctctggtgaaccatatagaccattttcttgtttaatccggcactctaacaaatataggtaatatactatattatcatataaagttactgccaaaaagtcagctgcatctcgtccattaaatccatcatatattccacaaatcaaccatccattcttctcagagcacacagcttggactctatcctctccagcagctccaccagccatttttatctctgtacttgtcagaaaattggatgagacagtagttggggcactggacctccagatatttttactgatttcaaatatagagctctcagtcgatacagggctgccttgtgaggtggataacaagtccaatcttgacattgatggggatgaaacaatttttctgaaagaattaggagagtctagttctggtaaaatttcttccccgataagacccttgcaaatgtttgtattggccagcgtgaaattggcactaatcgcagcaccagacaaacaagtgaaggatccattttgtgatgtcatcatggtattagtttcaagcctcttgttgggagagatgtcatactcatcagtgtctagagaaaaacactgataagaattacaatggtatccaaagctgacgttgagattgctataactcctgacaagcatgtcttcttcctcagaactgatgctgtgatcattggagctcttatcaaacagttcctcatccaccatctttttcaacagaagtataacaccgattgtagtgtatattgctgtcaaactatgctttgaaggtttaaatgctacttaaagcccatgccaaatacaggtccttttatacttaaatggaaacgcaaaccagacctgcaattttaacacaaagcattatttatataagtacggtctgagcatggttgaactgtagagaataaagacggcaaagcgttgccaaacaaagaaatatttcatcaaaatttatagtttctttagagtaccctataatggatatgagccatccattacttttgatctaatggatcagattcaattatacaggggtaaagttagaattggtcgaatgacttcctccataatgtattctagctttctagtccaacgtgatagagttgtgtacaggaggtgtaattgataggtatgtgaacaagattgcttctcgaatctttgatgaataacatggtttccgtcaactgcccctgagcataatactattagtccttagtttgactatccttccatccaaaatataagcagggaaggaatcgatgagacgccccagtagtttgacatttgcaactggtaatattatcccctaaatttttacatgactgcaacaacaattttagattaattatacaagactgtaccttgttaaatatagacggcatcattttatacatatcagaattttattttcataagctaccaaacatggcaggcacagtttgcaaagttcttgaaaaatgaggacacaacccacataacataaatttcaatgagatctactcttaaaattttcttgtctcccaccaccaaatcaatcaagaacttcatcaggaaacagaaactaaggaaccacatacggcaacagaactcgagcggagggattagagacagattaggccggtagcaacaacctgaagtaagaaggggttgcttctgttcaaggagtgatcccgcatacgacagggccaggcaggtcgatgaacttcaccacagcggctatgaccagtgttcccacagaaactaatcttcttggcgttcacctacacacaacaccccccgaacaacacagataagagaagaaagaagaaacagatagaagagaatcaacaagaaggaacatgcgcacagcgcagacgatacgattactcacagatgcatccatcaagttcagagcgatgggaatcgggccagttgacgcagcccctcctttccccccatccctgaaaaccccaaccccaaccagcgaaggaaaaaaaaacaagactaaatttttacccaaaaagctcccttctttctttagccgcccgccgacctgcgcagcgcacaacacggatcaacaagaagcagcacgcgaaatagggaagatcactagaacaggtcgcgcaccccctgcaacagaacgcaaaaaccagacgaaacctgagcgcgattcgcttacctaaaaaaaaacccggttcgttttttttctcttctcggttgcaaactgcagatatcagctcgcgggccaaagaacaaggaagagcagaagctgagaggcggaggaggaggaggaagtggcgggtagatgcagacgggacgggtgtggagtggagaatgggagaaattgagaggaaggtgtgggcttgcggggaatatatcgaggaggtggtggctcagctcagctggtctggtggaaaagagagagagagaagcaacagattcattctccctttccctcctcttttttctattttcgcggaccggataggcttagaatctaaccgcgtcgctcgctctccacatcggagtggtagttaaccatcgcagcgacacaggaggattgggg

SEQ ID NO: 1024 - DNA, 1512 bp, Zea mays
cacacgaaaacaactgagcgacgtggcagcggctagcgggacgcctcactccagtcgtccggttctgttccagcagccccacaccccacgccaccggaccggaaacgcgaagcagccccacactgcccacgcggacacgctctgcaccaccacctgccggccgttcccggctcgccgctgccgttgcgccctcgcgctcacacctccgccagcccaggtccatcgagcggagaaacccatggccccctcgccgatcctcgtccggccgccggcgctggcgaattcaccccttccgcctccccgatgcgtggccgcggtagcagcggcgccggcggttcggacggctccagcggccccattctctaggctccgtaccaagtgtaggttcgccgcatcggatgtgagagaagactactcttccactccgatagatattgtcgctgatgttaagacggagaagattgtggtgttaggaggaagtggattcgttggttctgcgatttgcagagctgctgtatccaaaggcattgaggttgtgagcttcagcaggtcaggaagaccatcttactctgatccctgggttgatcaagtcaattggctgccaggagatgttttctatgcaagatgggatgaagtattggttggggctactgctgttgtgtctacccttggagggtttggcaatgaagaacaaatgaaaaggataaatggtgaggcaaatgtcatagcagtaaatgctgcaaaagaaaatggagtcccaaaattcattttaatctccgtccatgactacaaccttccatcctttcttcttacatcgggttacttcactggcaagagaaaggcagaatctgaagtcctttccaaatacccagcctcgggtgtcgtgttgaggccaggcttcatttacggtaaaaggaaagtaaatggcttcgaggtaccactcgacgctgtcggacaaccattggagaagttgctctcctctgtcgaaaacttcaccaagccgttgagctcgctgcctgcctctgacctaatccttgcaccccctgtgagcgtggatgatgttgcctatgctgtaatcaacggagtcatagacgacagcttctttggggtgttcacgattgaacagatcaaggaagccgcgtccaaggtacgagtgtgaacccggggtcttgttccacaatctctgaacgtgtgttgtaggtggaaagttcataaacttagcagtaactcattgatccttgtgttctttatttctcgctgaattttgaccatagtcaaccgttcaaaagtcagtgcagcattcttttttctgctggaatctcttgagaaaatatagtttccaaactagcccttaatgacttaaagagctagcaaaatatgtagtactgtgtgggtcaccgaactgttatgttggttcacaatctcgctggaggtgagcggcatgagctcacaaccgaaatgtttttgaagtataaatcatgtgtatcgttgattagaattgagatcaaactc

SEQ ID NO: 1025 - DNA, 930 bp, Oryza sativa
gacatgtccccctcgccgctgctcgcccggccgccggcgccgtcgagcccgagcacgtacccgtccctcccgcctcgccggtgcgccccggctgtagcttccgcggcgctccgcgtggctccagccaccgcctcccgagccccattctccaggctggtgaccaagcggaatttcgctgcgtctgatattagagaagactactccactccgattgacgtcgttgccgatattgtggtgttgggagggagtggattcgttggctctgctatctgcaaagctgctgtctctaagggtattgaggttgtgagcctcagcaggtcagggagaccatcttactctgatccttgggttgatcaagttacttggctagcaggagatgttttctatgcaagatgggatgaagtgttagttggtgccactgctgttgtgtctacccttggaggattcggtaatgaagaacagatgaaaaggataaacggtgaggcaaatgtaacagcagtagatgctgcaaaagaatttggaatccccaaattcattttaatttctgttcatgattacaatcttccatcctttcttcttaactcgggttacttcactggtaagagaaaggctgaatctgaagtcctctccaaatacccaacctcaggtgttgtactgaggcctggtttcatttatggtaaaaggaaagtagatggttttgagataccactcgatgttgtaggacaaccattagaaaagctactttcctctgttgaaaatttcacaaaaccgctgagttcattgccagcttctgacttactccttgcacccccagtgagtgtggatgatgttgcctatgctgtgatcaatggagttatagatgacagcttctttggtgtcttcacgattgagcaaatcaaggaagccgcggcgaaagtaagagtgtaaact

SEQ ID NO: 1026 - DNA, 1524 bp, Sorghum bicolor
cagccgtccaaccggatgtggaccagacgtcatatttttcccgtggttcgtcgtttccgggtttccgagcagaaaatccgcaggaaagcaagcgagcgacgtggcagcggctagcgccagcgggacgccccactccagtacggagtagtccagtccagttccaccagctcacagccaccggaagcagcagccccacactgcccacgcacgcggacgcggccacgcgctctgcgccaccaccagccggccgttcccggctcgccgccgccgttgcgccctcgcgctcacacctccgccagctcaggtccatcgagcggaggaacccatggcgccctccccgctgctcgtccggccgccggcgatggcgaattcaccccttccgcctccccgatgcgcggccgcggtggcagcggcgccggcggtacggacggctcccgcggccccactctctaggctccgtaccaagtgtaggttcgccgcatcggatgtgagagaagactactcttccaccccgatagatattgtcgctgatgtgaagacggagaagattgtggtgttgggaggaagtggattcgttggctctgcgatctgcaaagctgctgtcgcgacaggcattgaggttgtgagcttcagcaggtcaggaagaccagcttactctgatccctgggttgatcaagtcaattggctagcaggagatgttttctatgcaagatgggatgaagtattggttgggtctaccgctgttgtgtctacccttggaggatttggcaatgaagaacaaatgaaaaggataaatggtgaggcaaatgtcatagcagtaaacgctgcaaaagaatatggagtgccgaaattcattttaatctctgttcatgattacaatcttccatcctttcttcttacatcgggttacttcactggtaagagaaaggcggaatctgaagtcctttccaaatacccagcctcaggtgttgtgttgaggccaggcttcatttacggtaaaaggaaagtaaatggctttgaggtaccgctggacgctgttggacagccattggagaggctgctctcctctgttgaaaatttcaccaaaccattgaactcactgcctgcctctgacctaatccttgcaccccctgtgagcgtggacgatgttgcctatgcagtaatcaacggagtcgtagatgacagcttctttggggtgttcaccattgaacaaatcaaggaagccgcagccaaggtaagagtgtgagccttagggtcttgttccccagtgtatgaaggtattataggtgggaagttcataaacccagcagtaactaaaggtcctttgttcttcctttctccctgaatcttttaccatagtcaatagttcaaaaagtgcagcattttttttctgctggaattttctaacatttatgacttaagagctaacaaaatatgtagtaccgtgggccacagaattgttacgttggttcacatggaggttagcggcatgagctcacaatcttgtgaatgtgacattagacc

SEQ ID NO: 1027 - DNA, 1518 bp, Panicum virgatum
cggaacatccgagccgtccaatcggatctggacagtacgtcacgcttttcccgtttcgtttcgccgtttgctgagcacacaaaaaaaatccactggaaaaataagcaagcgacgtggcagtgggacgcctcactccaactccagcaggcagcagccccacagccaccggtaacgaggcaggcgcagcccaccgccccccacgcggccgtgccctgcgccaccaccttcccggcgtcgcgtactcgcgtacgtcgtacccatccccaggtccatagagcggcggagcccatggccccctcgccgctgctcttccggccgctggcgctggccagctcgccgctttcccctcgtcggtgcccgcccgcggtgaccgcggcggcgtcggtccgcgcggctcccgcccccactgccgcgtccccattctctaggctccgtaacaagtgcaggttcgccgcgtcggatgtcagggaggactactcctccaccccgatcgatattgttgctgatgtgaagaccgagaagattgtggtgttgggcggaagtggattcgttggctccgcgatttgcaaagctgctgtctctaaaggcattgaggttgtgagcttgagcaggtcaggaagaccatcttactctgattcctgggttgatcaagttaattggcaggcaggagatgttttctatgcaagatgggatgaagtattggttggagctactgctgttgtgtccacccttggaggatttggcaatgaagaacaaatgaaaaggataaatggtgaggcaaatatcatagcagtaaatgctgcaaaagaatatggagtcccaaagttcattttaatctctgttcatgactacaatcttccatcctttcttcttacctcgggctacttcacgggtaagagaaaggctgagtctgaagtcctcgcaaaatacccgggctcaggtgttgtgttgaggccaggcttcatttacggtaaaaggaaagtaaatggctttgagataccgctcgacgctgtcggacaaccattagagaaactgctttcctcggttgaaaacttcaccaaaccattgagctcactgcctgcttctgacctagtcctcgcacccccagtgagcgtggatgatgtcgcctacgctgcaatcaatgcagtcgtagatgacagcttctttggggtgttcacgatcgagcaaatcaaggaagccgctgccaaagtaagagtgtgaacctggggccttgttccgctgtctctgaaggtgtcatagatggaaagtttctaaattcagcagcaactcaaatgatccctgtggattgtcttcccctgaatctttgaccatagtggatagtaaaaaatcagtgcaacatagttcttttgtttatgctggaatttcgaaccccttgggagctaacggaacgaattgtactgtgggtcgtagaatttgtcatgtcggtccaacaggttactgaagtttcaaactggtggccacgtaggtgagaaattccggaacaggtttattttgatg

SEQ ID NO: 1028 - DNA, 1359 bp, Panicum virgatum
ccacagccaccggtaacgaggcaggcgcagcccaccgccccccacgcggccgtgccctgcgccaccaccttcccggcgtcgcgtactcgcgtacgtcgtacccatccccaggtccatagagcggcggagcccatggccccctcgccgctgctcttccggccgctggcgctggccagctcgccgctttcccctcgtcggtgcccgcccgcggtgaccgcggcggcgtcggtccgcgcggctcccgcccccactgccgcgtccccattctctaggctccgtaacaagtgcaggttcgccgcgtcggatgtcagggaggactactcctccaccccgatcgatattgttgctgatgtgaagaccgagaagattgtggtgttgggcggaagtggattcgttggctccgcgatttgcaaagctgctgtctctaaaggcattgaggttgtgagcttgagcaggtcaggaagaccatcttactctgattcctgggttgatcaagttaattggcaggcaggagatgttttctatgcaagatgggatgaagtattggttggagctactgctgttgtgtccacccttggaggatttggcaatgaagaacaaatgaaaaggataaatggtgaggcaaatatcatagcagtaaatgctgcaaaagaatatggagtcccaaagttcattttaatctctgttcatgactacaatcttccatcctttcttcttacctcgggctacttcacgggtaagagaaaggctgagtctgaagtcctcgcaaaatacccgggctcaggtgttgtgttgaggccaggcttcatttacggtaaaaggaaagtaaatggctttgagataccgctcgacgctgtcggacaaccattagagaaactgctttcctcggttgaaaacttcaccaaaccgttgagctcactgcctgcttctgacctagtcctcgcacccccagtgagcgtggatgatgtcgcctacgctgcaatcaacgcagtcgtagatgacagcttctttggggtgttcacgatcgagcaaatcaaggaagccgctgccaaagtaagagtgtgaacctggggccttgttccgctgtctctgaaggtgtcatagatggaaagtttctaaattcagcagcaactcaaatgatccctgtggattgtcttcccctgaatctttgaccgtagtggatagtaaaaaatcagtgcaacatagttcttttgtttatgctggaatttcgaaccccttgggagctaacggaacgaattgtactgtgggtcgtagaatttgtcatgtcggtccaacaggttactgaaagtttcaaactggtggtcatgtaggtgagaaattccgaacaggtttattttg

SEQ ID NO: 1029 - DNA, 1088 bp, Festuca arundinacea
  misc_feature (293)..(293): n is a, c, g, or t
  misc_feature (544)..(544): n is a, c, g, or t
  misc_feature (553)..(553): n is a, c, g, or t
  misc_feature (592)..(592): n is a, c, g, or t
  misc_feature (610)..(610): n is a, c, g, or t
  misc_feature (616)..(616): n is a, c, g, or t
  misc_feature (634)..(634): n is a, c, g, or t
  misc_feature (643)..(644): n is a, c, g, or t
  misc_feature (646)..(646): n is a, c, g, or t
  misc_feature (661)..(661): n is a, c, g, or t
  misc_feature (664)..(664): n is a, c, g, or t
  misc_feature (667)..(667): n is a, c, g, or t
  misc_feature (673)..(673): n is a, c, g, or t
  misc_feature (682)..(682): n is a, c, g, or t
ggcacgaggccacacggccgttcgcccactccccgctgccccgccgttcccttcgccgacgcgggaaagtgtcagaggcggaaggagagcgcgctccctccaccccgcccgggacccgcccatgtccccctcgacactgcttgtccggccgccggcgccggcgccggcgagcccgtcccttccgcctcgccggtacgcgcccgcatcagcggcggcagcgccagcgacgctccgcacgtctcctgcagtctcctccgtggcccagttctctaggctgcgcaccaagtgcaggnttgccgcccccggtgtcagggaagactactcttctacgccaatcgatgtcgtcgccgacgtgaaaacagagaagattgtagttttgggaggaagtggatttgttggttcctctatatgcaaagctgctgtggctaaaggcattgaggttgtgagcctgagcaggtcaggaagaccatcttactccgatccctgggctgatgaagttacttggctagcaggagatgttttctatgcaagatgggaggacgtnttagtaggngctactgctgttgtgtctacccttggaggatttggtaangaagaacagatgaaaagnataaanggtgaagcaaatgctatngcagtaganncngcgaaagaatttggnatnccnaaattnattttgatntctgttcatgattacaaccttccatcgtttcttcttacctcgggctatttcactggcaagagaaaggctgaatctgaagtcctctccaaatacccttccacgggtgttgtattgaggccaggctttatttacggtaaaaggaaagtagacggctttgagataccgctcgacttggtagggcaaccattagagaagctgctttcctccgtcgaaaatttcaccagaccattgagcgcattgcctggttcagacctggtcctcgcaccccccgtgagcgtggacgatgttgcctatgcggtgatcaacgctgtcatagatgacagcttcttcggcgtgttcacaattgagcaaatcaaggaagctgcggccaatgtcagagtgtaaagttttccacacctagctggaa

SEQ ID NO: 1030 - DNA, 1755 bp, Secale cereale
tctcgaacaatctcctccgaggctccgagctcacccgccgccgccgccgccgccgccatgggcgactacgggaacgcgatgatgcggaaccaggatgcgggcgtgcaatcccgcgtcaaggcgcagaggcgtgccaacctcctccagctcaagctcatcgggcagagtcatccgacggggctgacgacgaacctgctgaagctgttcgagccacggcccccgctcgagcacaagccgccgctcgagaagcgcaagttgccggcttactctgggatgtcgcagtttgtatcgcggttcgcagagcctggtgaccctgagtatgctccgcctgtccccacgtgcgagactagggctgaaaagaaggatagaatccgccaacttaagcttgaggaaggtgcagctaaggttgctgaagagctccagaagtatgacccacaaaatgaccccaatgtcactggagatccatacaaaacactctttgttgcgcggcttggttacgagacatctgagcagaaggttaaaagggactttgaagcttatgggcctattaaaagggtacggctcataactgacaaggtaacaaataagcctagaggatatgcatttgtagagtatgcgcacactcgggacatgaaaagtgcttataagcaagctgatgggcgaaaagtggataacaaaagggtgcttgttgacgtagagcgtggtagaactgttccaaattggcgtcctaggagattgggtggtggacttggatcaagcaggattggtggtgaagatgctgcccagaagcattctgctagagagcaacagaatgctgctgggcgacccagatcagaagagcctaggagggatgatcgtcctgcagatcgggatcgtgagaaatctcgtgatagggtacgggaaagagatcgtgacgagaaaactcgtgaacgatcgcatgacaggactcgtgatcgtgatccgagggaggataggcaccaccatagagatcgtgagagaactcgtgatagggaccgagaacgggaccaggatagagaccgtgggcgtgaccgccgtgatagggataggcacaaggatcatggccgggatagagaccaggatagagacaggaaacgcgagcgctctcatggcaggggcagagaccgtgacagagattacgagcgtgcaagtcatgaacaggaccctggcagggaccgagattacaagcgtgcgcgccatgaacatgatcgtggtcacttgcaggagagtgatgctgattatggtaatggtgagcttggctataaccagcatgagcaccacagaagtcacgaacagtatggttatggcctagatggacatgagcgctcaaagcgacatgagcattaccgggatgattcacacagtaaaatggcaaccaaccatcaggggcaacctgaaaatgcagaacctgcagtccccgaggaaggggaggcatatgaagaaggggactaccagcatatccaagcgggtgaatacaggaactaaaacttgatagctgtggtaaggctttgttaacgtagtaatatttgcatcatttcagctgttcccagtggttctcttgcctttttcttgctggcactttcagtcttaccctatttattttgggtgtgtttgtttgttgtatgctatttttaataatttggtggataatgctcgtggtttgtgttcactacttgttagtgatgttctatgtaattttgaagccaatggccaatcaatatgaacttgttactcgcc

SEQ ID NO: 1031 - DNA, 1845 bp, Brachypodium distachyon
ggaaaatataaaacaagcaaagcgttctccccaccatcgctggtacaatctctctcccccgagctcgcaaatcactccaagccgtcgccgccatgggcgactacggcaacgcgatgatgcggaaccaggacgccggtgtgcagtcccgcacgaaggcgcagagccgtgccaacctcctccagctcaagctcatcggtcagagccatccgacggggctcacgaccaacctgctgaagctgttcgagccacggccgccgctcgagcacaagccacccgtcgagaagcgcaaattgccagcttatacggggatggcgcagtttgtgtcacggtttgcggagccaggtgacaccgagtatgctccacctgtccccacatgcgagactagggctgaaaagaaggatagaattcgccaacttaagcttgagcaaggtgcagctaaggttgctgaagagcttcagaagtatgacccgcaaaatgaccccaatgtcactggagatccgtacaaaacactctttgttgcaagacttaactacgaaacatccgagcagaaggttaaaagggactttgaagcttatggacctattaaaagggttcggcttgtaactgacaaggtaacaaataaacctagaggatatgcattcgtagagtatgtgcacactcgggacatgaaaagtgcttacaagcaagctgatgggcgaaaagtggacaacaagagggtgctggttgacgtggaacgtggtagaactgttccaaattggcgtcccaggagattgggtggtggacttggatcaagcaggattggtggtgaagatgcctcccagaagcattctgctagagagcagcagaatgctgctgggcgccctagatcagaagagcctaggagggatgatcgtcctgcagatcgggatcgtgagaaatcgcgtgaaagagtgcgggaaagagatcgtgatgagagaacccgtgaacgctcccatgacaggactcgtgatcgtgatccaagggaagagaagcaccaccatagagatcgtgagaggactcgggacagggatcgagaacgggaccaggagagagaccgcgggcgtgaccgccgtgatagagataggcacaaggatcatggtcgggaccgagaccaggatagggacaggaaacgtgagcgttctcatggcaggggcagggatcgtgacagagattacgagcatgtgagccatgagcaggaccctgccagggaccgagaccgagattacaagcgtgcacgccatgaacatgaccgtggtcactttcaggagagtgatgctgattatggcaatggtgaccccagctataaccagcacagaagccatgagcagtatggttatagccaaggacatgggcatgagactgagcgctcaaagcgtgataattcgcacagtaagatggcaaacaattatctgggacagcctaacgatgcagaacctgaagtccctgaggaaggcgaggcatatgaggaaggtgactaccagcataaccggccagatgaatacaggaactgaaactgtcatgacagctgcagtaaggcttttctactttgaaatctcgttatgtcaggtgttgggtgcttgtgttgctgccgagaggcagaagctctttgttgttggctagttcaaaatcagcccaattgttttgggcatgtttgtgtttgtaataagaactttttagaagatgtatgtaatttttgagccgatgggcaatcaatgtgaactgatccgtgtgatttatgtaagtgatttatgtaatttttgttggcaatcaatgtgaactctctatacaccattttttaatggtttctcgaaatttattaggtgcaaa

SEQ ID NO: 1032 - DNA, 1270 bp, Triticum aestivum
aagcatcctaatcctcaccagtatctatgtatgtgcctgtcaccatcgtctgacccttatcccagaaattttgctgcattttccaaccagtggatatgcatgctatttagctttgcacatatccatcactctcctgcaccctcagccctcattgcacatccataaaacccacctagagacaaacccagaagaagggcagggaatattacatccatggctgggctgcagaggtcttcactgacattcaggaggtcaggatcatcaggcatggtctggggcgagaggctcatgtcggatgaacatagccagtggacctcaggggaaccagagttcagggagctacggcactcccgcagcgttgggtccgtcggggcgcagcgcaggcgcaacgatggcaccgagcgaggcagccaggcgttccggacacggcgcgtagccccggccatggatccaccgtcgcccaaggttcctggctgcatcttctgtgggattttcaggaagacagcaccttcacagccatctaaggccagaaggtaccactagagtgatctgtgtattcatcgaccatatgtgtgactgggttacctggttctggagcttgtgaagttcaggtccatcgagtatatacatgctactccctccgttccatattaagtgtcactgatttagtacaacacttgattcttcagctgcccacctctgtgcttgtatctgtagctggtatccccagttttattttctgctttttagttgtaatttcctggctggttgatggctttgttaattcaaagccgggctctgtctcgagccttcgttctaaaaaaagtacaacacttgatatggaattgagggagtagtactcagtgatacgctcgtatagttgcatgcagtttggataagtttgagcatatctgtttattaaggtgttatgcatatttttgctgatttctctaccacttgatagtttgctgatgcaactgctttcttgagtgaccgcctcgtctagctttgtgcgcatgatagaaattgtgcatgtcggctgcagcacatatcttgtataagccactgtacatgaacatgatgttttcatttggttctgtatctggatcgtctaaaggtgactatatttgtaaatgttgtccgtgtatttgtcttgtttggaggtcactatatccgtatggtgcacatccatgagccaatgtatgaatcgacctacatttgcgatgtgaggaggtattccatgaatttgattggttcttattatgtctct

SEQ ID NO: 1033 - DNA, 722 bp, Secale cereale
cacagccataaaaaccacctagagacaaacccagaagaagggcaaggaagttccatggccgggctgcagaggtcttcactgacattcaggaggtcaggatcatcagggctggtttgggatgagatgctcatgtcggatgagcatagccagtggacctcaggggagccggagttcagggagctacggcactcacgcagtgtcgggtctgtcagtgcgcagcgcaggcgcaacgacagcgccgagcgcggcggccaggctttccggacacggcgtgtagccccggcgatggatccaccgtcgcccaaggttcctggctgcatcttctgtgggattttcaggaaggcaggaccttcacagacatctaaagctagaaggtaccgctagagtgatctgtgtgttcgtcgaccatatctgtgacagggttatcaggttcttgagcttgtgaagttcaggtccatcaagtataggtagatggtagtagtccatgatatgctcatatagttgcatgcggtttgcataagtttgagcatatctgtttgttaaggtgctatgcatatctatccttttctctatcttttgatagtttgttgatgtggctgtattcttgaatgaccgcctcgtctcgcttggggtgcatgattaaatttgtgcatctctgaagcacacatattgtatactaccctgtacgcgaacatgatgctttcatatatttgtgtcgtttc

SEQ ID NO: 1034 - DNA, 579 bp, Leymus cinereus x Leymus triticoides
  misc_feature (236)..(236): n is a, c, g, or t
  misc_feature (245)..(245): n is a, c, g, or t
  misc_feature (257)..(257): n is a, c, g, or t
  misc_feature (305)..(305): n is a, c, g, or t
  misc_feature (309)..(309): n is a, c, g, or t
  misc_feature (343)..(343): n is a, c, g, or t
  misc_feature (361)..(361): n is a, c, g, or t
  misc_feature (426)..(426): n is a, c, g, or t
gcacgagggggaagttccatggccgggctgcagaggtcctcactgacattcaggaggtcaggatcatcaggcctggtctggggcgagaggctcatgtcggatgagcatagccagtggacctccggggagccggagttcagggagctacggcactcacgcagcgtcgggtccgtgggtcgcaacgatggcgtcgagcgcggcagccaggcgttccgcacacggcgtgtagccccggnatggatccnccttcgcccaangttcctggctgcatcttctgtgggattttcaggaaggcaggaccttcncagncatctaagaccagaaggtaccactagagtgatcngtgtgttcttcgaccttntgtgtgacagggttaccaggttcttgagcttgtgaagttcaggtccatcaagtatagatagatgntagtagtcgatgatatgctcgtatagttgcatgcggtttggataagtttgagcatatctgtttgttaaggtgctatgcatatttttccgtttctcttttgatagtttgttgatgtggctgtattcttgaatgaccgcctcgtctggcttgggg

SEQ ID NO: 1035 - DNA, 1034 bp, Hordeum vulgare
ttccaagcatcctaatcctcaccagtatctatgtatgtgcctgtcaccatcgtctgacccttatcccagcaattttgctccattttccagccagtggatatgcatgctatttagctttgcgcatatccatcactctcctgcactcattgcacagccataaaaaccacctagagacaaaccaaaaagaagggcagggaagttccatggccgggctgcagaggtcctcactgacattcaggaggtcaggatcatcaggcatggtctggggcgagaggctcatgtcggatgaacatagccagtggacctcaggggagccagaattcagggagctacggcactcccgcagcgtagggtccgtcggtgcgcagcgcaggcgcaacgacggcaccgagcatggcggccaggcattccggacacggcgggtagcccctgccatagatccaccatcgcccaaggttcctggctgcatcttctgtgggattttcaggaaggcaggaccttcgcagccatctaaggccagaaggagatacattggagagttggagagagaccaatttatgaatcggcatatgtttacgttgtgagggggtatttcatgaatttgatttgacgtccattattgagggacaagactggtgtttgcactaataaagcttatccatgagtggtatccgggtgggcaagttgacctgatgcacttcacatttggctggagtgatgtggctggttacgtgtactaatctgcttttagcacgaagctgcatggtcatctccgggttcaggtctctagtagtactgaaacttgagataacactagaattatgacatccttttggtaatgatgaggtcatagatttgaaaagaaaaggagaggagattctcactgttttggtcttgtgttctaagagcaactctaaccgtgcaaactaaaagggcacacggtttgttcgcattttgttcgtttgggtcggtctggcggacatccatgtttgcttttataattgtgtcgacgcttgcgtccaacgcggtcatga

SEQ ID NO: 1036 - DNA, 1209 bp, Triticum aestivum
acaacggacacggagatgagcttagcgcttctagggggctactcctccgccgaggacgacgaccccgccgccggcgccggcgtcgagctgagcgactccggcgactcatcagccgaagaggccggatctgacggagacgagaagtccgctccatcgaagccggctgcgaagccccgcccccgcgtaaaccctagccccggagatggggactcctcgctgccctcggcgctagatgtcttcgccgagatctccgggcccccggctttcctcaaccgcagagtggcccagcccgaggaggtcggggaggcgctcggcgtgctcgatcgccgctccaactccaagaggagaaagccgccacctcccggtgcggttgtggcggcgaagccacagatggttgccatccgtgaacgagttagcagtgacgtgaagaatggtgccaatcctccagttgcggttgtgtcggcgaaaccacagttggttgctggtcacgaacgagttagcagtgacatgaagaatggtgccaaccctccaggttctgttgaaggaaagaggaaaataggcgctgcaaatcctggtccagaagatgctgccgagcttctaagaatgtgcctccagtgtggtataccaaagacctattcacatgcgcaaggaatggtatgccctgtttgcaacgacagaccggtgcaggctaaagagccagagaagaagaagggttctgctgtcaaagacaaggagaaagtgaagaggatgagagggcaatcgtcacatgcatcttggaagagcgaaactgagatggccctgcgccaacaattcgactgattggtgtcaccaggagtgctggtgcactcagtctgtacactaggtagaatcgaatctctttgcttgttccattgcgtcgcgtggcttccagattgccatcgttttgtttcttgtatttgcagctctctgacatgcacggattaagtttcgcaagctgtatacgttaaaatgttttccagcccagccatgtttcgagtaagttactcagggcccctttgcttcagggacattttcctgtgcccatcagtaactggatgacctatgagattcccatgagatttttgcgtatcatagaagaatccctgaatactgaactggttgtgcttcctgctgttatttgcattggtgacatggaaatcttagcccatggtccgaaattcgctttgcatt

SEQ ID NO: 1037 - DNA, 1120 bp, Leymus cinereus x Leymus triticoides
ttagcgcttctagggggctactcctccgccgaggacgacgatcccgccgccggcgccggcgcggagctgagcgactcaggcgactcatcagcagaagaggccggatctgacggagacgagaagtccgctccaccgaagccggttgcgaagccccgcccccgcgtaaaccctagccccggagatggggactcctcgctgccctcggcattagatgtcttcgccgagatctccgggcccccggctttcctcaaccgcagagtggcccagcccgaggaggtcggggaggcgctcggcgtgctcgatcgccgctccaactccaaggagaggagaaagccgccacctcccggtgcggttgtggcggcgaagtcacagatggttgccatccgtgaacgagttagcagtgacgtgaagaatggtgccaatcctccagttgcggttgtgacggcgaaaccgcagttggttgctggtcacgaacgagttagcagtgacatgaagaatggtgccaaccctccaggttctgttgaaggaaagaggaaaataggcgccgcaaatcctggtccagaagatgctgccgagcttctaagaatgtgcctccaatgtggtataccaaagacctattcacatgcgcaaggaatggtatgccctgtttgcaacgacagaccggtgcaggcaaaagagccggagaagaagaagggttctgctgtcaaagacaaggagaaagtgaagaggatgagagggcaatcgtcacatgcatcgtggaagagcgaaactgagatggctctgcggcaacaattcgactgattggtatcacctggagtgctggtgcactcagtctgtaactgtacactaggtagaatccattatcgttgtctgagtaagcttgaaccgccgcatggtggtcggttcaagatttgttttttgtatttgcagttccctgtgacactcggattggttcgataagctgtattcgttaaaatgtttccagcgaagtatggtttaagtaaattactcgggccatcttttgcttcgcgggacattttcctgaatctacctgtaactgaactgtgtcttgtgtgaaacttgcgaagaagccctaaatactgaactggttgtgcttcaa

SEQ ID NO: 1038 - DNA, 1275 bp, Secale cereale
cgcgccgtagagagtttgctactccgtagtccaggaaagcccaagaacaacaacggacacgatgagcttagcgcttctagggggctactcctccgccgaggacgacgaccccgccgccggcgccggcgccgagctgagcgactccggcgactcatcagccgaagaggccggatccgccagcgacgaggagtccgctccacggaagccggcggcgaagccccgcccccgcgtaaaccctagccccggagatggggactcctcgctgccctcggcgctagatgtcttcgccgagatctccgggcccccggctttcctcaaccgcagagtagcccagcccgaggaggtcggggaggcgctcggcgtgctcgatcgccgctccaactccagggagaggagaaagccgccgcctccaggtgcggttgtcgcggcgaaaccacagatggttgccatcagagaacgagttagcagtgacgtgaagaatggtgccaatccgccagttgcggttgtgtctgcgaaaccacaattggttgctggtcatgaacgagttagcagtgacatgaagaatggtgccaatcctccagattcagttgatggaaagagaaaaataggggctgcaaatcctggtccggaagatgctgccgagcttctaagaatgtgccttcagtgtggtataccaaagacctattcacacgcgcaaggaatggtatgccctgtttgcaacgacagaccggtgcaggcaaaagagccggagaagaagaagggttctgctgtcaaagataaggagaaagtcaagaggatgcgagggcaatcctcacatgcatcgtggaagagcgaaactgagatggctctgcggcaacaattcgactgattggtgtcgccaggagtgctggtgcgctcggtctgtaactgtacactaggtagaatccaatctctttgcttgcaccattgctccgctgtggcttccagattaccatcgtgttgtttcttgcatttgcagctctctgacatgcacggattaagttttgtaagctgtatccgcttaaatttgctgtggcttcgagtaaattactcatgacccctttgcttcaggggacagtttcctgtatccatcagcaactagatgacctgtgagattccgttgaggttcccatgagactttcgtgtgttatagaagaagctctgaatactgtgctggttgtgcttcatgctgtaattagggggacatggaagtcttagctcatatatagtccaaaaatgctcattggaattattaag

SEQ ID NO: 1039 - DNA, 933 bp, Festuca arundinacea
  misc_feature (519)..(519): n is a, c, g, or t
  misc_feature (537)..(537): n is a, c, g, or t
  misc_feature (540)..(540): n is a, c, g, or t
  misc_feature (568)..(568): n is a, c, g, or t
  misc_feature (571)..(571): n is a, c, g, or t
ggcacgaggggaaggcccacgaacaacgaccacggagatgagcttggcgcttctaggaggctactcctccgccgaggacgacgaccccgccgccgccgacctgagcgactccggcggctcatcggccgaagaagctggatccgacgtcgacgaggcgcccgctcccccgaagccggccgccaggcctagccgtcgcgtaaaccctagccccggcgatggggactcctcgctgccctccgcgctggatgtcttcgccgagatctcgggtcccccggacttcctcaaccgcagggtcgctcagcccgaggaggtgcgggaggcgctcggcgtgctcgatcgccgctccaagcaggggagaaagccaccgccacccggtgcggttgtggcggcaaaaccgcagttggttgccattcgtgagcgagttagcagtgacatgaagaatggtgccaatcctcaaggtgcggttgtgtcagcgaaaccacagttgattgctgatcatgaacgagttaacagtgacangaagactggtgccaatcntcnaggttctgtcgaaggaaagagaaaaatnggngctgcaaatcctggtccagaagatgctgccgagcttctaagaatgtgtctccagtgcggtataccaaagacatattcacacgcgcaaggtatggtatgccctgtttgcaacgataaaccgatgcagacaaaggagcccgagaagaagaagacttctgctgtcaaagacaaggagaaggtcaagaggatgagagggcaatcttcacacgcttcatggaagagcgaaactgagatggctctgcggcaacagttcgactgattacatctaattagttcacaccggggatgttgtaaggaagatggctctgtagcctgtgcactggggagaatttttgcagttctctttgctttgtaagcttgtac

SEQ ID NO: 1040 - DNA, 1144 bp, Brachypodium distachyon
atgaagcagccgaccaggaaagcccaagaagaagctgcgacttacgcctcgagacagacagacacggagatgagcttggcgcttctgggaggctactcctccgccgaggacgacgaccccgccgccggcgccggcgccgagctgagcgactccggcgggtcatcactagaggaggccggatccgacggcgaagaggattccgctcccccgaagccggctgcgaagccccgccgcggagcaaaccctagcactggcgccgatggaggcggcggggactcctcgctgccgtccgcgttggatgtctttgcggagatctctgggcccccggatttcctcaaccgaagagtcgccgagcccgaggaggcgcgtgaggcgctcggcgtgctagatcgccgttccaaggaggggagaaagctgccaccccctggtgcagttgtggcggcaaaaccacagatggttgccattcgtgaacgagtgagcagtgacatgaagaatggtgccaatcctccaggcacggttgtgaaggcgaaaccacaattggttgccactcatgaaagagtgagcagtgacacgaacagtggtgctgatcctccaggttccattgaagggaagagaaaattaggcgctacaaatcctggtccagaagatgctgccgatcttctaagaatgtgtctccaatgtggtataccaaagacctattcacacgcacaaggtatggtatgccctgtttgcaatgatagaccggcgcagacaaaagagccggaaaagaagaagggttccggtatcaaagacaaggagaaagtcaagaggatgagaggtcaatcgtcgcatgcatcatggaaaagcgaaactgagatggctctgcggcaacagtttgactgattgcttagtagtggcaccaggaatgttgtaacgagatttagtaggttgtaaaacagtggagaacttttgcagcaatcctttccttgtaagcaagcttgtaccactggctcacggtgggttccagattatcatcgtttgttttcttgttatctgcgcgtgttgttttgataaggtgtctccattaatgtttcccagtgagcactgtgaggtcctgcttgaagactgagactcttacactcaatgagattctttttagcaaacc

SEQ ID NO: 1041 - DNA, 1175 bp, Triticum aestivum
ggcgcctaccttcccttcccaagagagcaagcagatgagaggggccgtctatataagtccgcccgccctttcctccccccaatctagcccgcacacgccacgccacacccacacgtgagctaagcaaaagcaagaccaccatcaaagatcggccatgggtcggtcgccgtgctgcgagaaggcgcacaccaacaagggcgcgtggacgagggaggaggacgagcggctggtggcccacgtccgggcgcacggggagggctgctggcgctcgctgcccggcgccgccggcctgctgcgctgcggcaagagctgccgcctcaggtggatcaactacctccgccccgacctcaagcgcggcaacttcacccgcgacgaggacgacctcatcgtcaagctccacagcctgctcggcaacaagtggtcgctcatcgccgcgcgcctccccgggaggacggacaacgagatcaagaactactggaacacgcacatccggaggaagctgctgggcagggggatcgaccccgtcacgcaccgccccctcacccacgccgccagcgccaccaccgtctccttcctccatcctgcggagccgcccaagacgcagccggcgacggagttgagtaagccgcccaggtgcccggacctcaacctggacctctgcatcagcctgcccttccaacaggaggaggaacggccgccggcgagagcgtgcgccaagccggtgaagatggagcagctgcagcagggcggcggcggcctctgcttccgctgcagcatcctgagagtgagaggggcggcgacggagtgcagctgcggcagcaacttcctgggcctcagggccggcatgctcgacttcagaggcctccggatgaaatagatgaaacttaggaataattattccatcaaactttctgcctgctgtaaattgttgctcccttctactaccaagtttttatttagcttttaggaaaagaaatactactactacagtagatggtgaggaggagactagtattattaggtgaggatttgtagccagatcctccctgccctcctcggtctgctcagtttcatgtaaattattactactgctccaccgatgaaatggaatggaacggaatgaaataatagatactaaattcagtgcgtttcccaaaaaaaaaaaaaaaaaaaaa

SEQ ID NO: 1042 - DNA, 1161 bp, Triticum aestivum
tgacccgcgcttccgatctcgcgcgcgcctaccttcccttcccaagagagcaagcagatgagaggggccgtctatataagtccgcccgccctttcctccccccaatctagcccgcacacgctacgccacgccacaccaacacgtgagctaagaagcaaaagcaaggcggatatacgtttacaccaccatcaaagagcttagcggccatgggtaggtcgccgtgctgcgagaaggcgcacaccaacaagggcgcgtggacgagggaggaggacgagcggctggtggcccacgtccgggcgcacggggagggctgctggcgctcgctgcccagcgccgccggcctgctgcgctgcggcaagagctgccgcctcaggtggatcaactacctccgccccgatctcaagcgcggcaacttcagccgcgacgaggacgagctcatcgtcaagctccatagcctcctcggcaacaagtggtcgctcatcgccgcgcgcctgcccgggaggacggacaacgagatcaagaactactggaacacgcacatccggaggaagctgctgggcagggggatcgacccggtcacgcaccgccccctcaccgacgccgccaccgtctccttcgtccatcctgcagaggcgaccaagcaacaggcgacggaggagaggaagccgcccagatgcccggacctcaacctggacctctgcatcagcctgccgttccaacaggaggaggaacggccgccggcgagagcgtgcgccaagccggtgaagatggagcagctgcagcagggcggcatctgcttccgctgcagcatcctcagagtgagaggagcggcgacggagtgcagctgcggcagcaacttcctgggcctcagggccggcatgctcgacttcagaggcctcgagatgaaatagaaatttgggaataattattcgatcaaactttctgctgtaaattgttgctccctcctaccaagtttttatttagctcttaggaaaagaaatactcctacagtactagtagatggtgaggaggagactggtatggtattattaggtgaggatttgtagcgatatcctccctgccctcctcgatctgctcagtttcttgtaaattattactgctccactgatgaaatggaacggaatgaaataatacactaga

SEQ ID NO: 1043 - DNA, 899 bp, Secale cereale
ggctggtggcccacgtccgggcgcacggggagggctgctggcgctcgctgcccagcgccgccggcctgctgcgctgcggcaagagctgccgcctcaggtggatcaactacctccgccccgacctcaagcgcggcaacttcagccgcgacgaggacgagctcatcgtcaagctccacagcctcctcggcaacaagtggtcgctcatcgccgcgcgcctccccgggaggacggacaacgagatcaagaactactggaacacgcacatccggaggaagctgctcggcagggggatcgaccccgtcacgcaccgcccgctcagcgacgcccccggcaccaccaccaccgtctccttcgtccatcctgcagagccgcccaagcaaccggcgacggaggagaggaagccgcccaggtgcccggacctcaacctggacctctgcatcagcctgccgttccaacaggaggaggaacggccgtcggcgagagcatgcgccaagccggtgaagatggagcagctgctgcagggcggcggcggcggcctctgcttccgctgcagcatcctcagagtgagaggagcggcgatggagtgcagctgcagcagcaacttcctgggcctcagggccggcatgctcgacttcagaggcctcgagatgaaatagaaatttgggaataattatgttattcgatcaaactttctgctttctgtaaatctacggccctaccaaatttttctttagcttttatataggaaacaaatactagatgaggagggggaggagactggtattattaggtgaggatttgtagcgagatccttcctgccctccttggtctgctcagtttcatgtaaattattacggctccactgatgaaatggaaatggaatgaaataatacagtatg

SEQ ID NO: 1044 - DNA, 2996 bp, Triticum aestivum
aacaaatcccagagattattagattagcgaagtcggaagccgtaaacggcactgggagagaggcgctccagctcccgctccgcacttctctctccgcccgcgactgagcccctgtcgactctccccgctcgctcaaccatctgccgatccgagaacggcgcgcgccatggcggacaacaggtcggcggcagcggcggcggtggggccgctgctgctgccgcggaagaagtcgtcgtcggcggcgcagtacacccgcagcgcgtcgcacgcgggggacgagctgcgcagcttccgggcctgcctccgctggatgtgcatcgaccacaccgacgggccgcgctccgcgggctcctgggcggtcttcttcctcctcgccgtcgccgcgccggccgcggtcaccctggccctcccggcctcggccccgccgcggccgctggacgggcaggtgcaggtctcgctcaccctggccgccacgctcgccttcctctccctctgctcgctgctccgggtcggcctccgccgcctgctctgcatcgaccgcctccgccacgactcggacgaggtgcgcgccgggtacaccgcgcagctcaaccgctccttccgcgtcctcgcctgcttcctcgcgccatgctccctcgccgacgccgcctacaaggtctactggtactgggccgccgcgcccttccgctcgccctggtggaacgccgccgcatgcgcgctcgaggccgcctcatgggtctaccgcaccgccgtcttcttcatgatctgcgtgctcttccgggtcatctgctacctgcaggtgctgcgcatggtcggcttcgcgcgcgagttcggcaggttcgccgacgtcgccgtcgtgctggagcaccaccgccggatcagggaccagctccgccggatcagccaccggtaccgccggttcataatcttctgcctcgtgctcgtcaccgccagccagttctccgccctgctcgccaccaccaggccacatgcgcggatcaatatcgccaccgccggcgagctcgcgctctgctcagtgagcctcgtggcggggctgctggtctgcctccacagcgcggccaagatcacgcacaagacgcaggccatcacgagcgtggcggcggcgtggcacgcggacgccaccatccacgccttcgacaacgacctggaggaccccgaccccgccctgcccgccgccaccggctacctggcgccggccaacgcctaccgggtggcccccggcgagaagtccgacggctacggcgacgacgacgatgacgacgacaacatgagcgagggctccatcgacgactccaagctcgtgcccttccaggtcaacaacatgtgcttccagaagaggcaggcactggtgaactacctggagaacaaccgggcgggcatcacggtgtacggcttcgtggtcgaccggacatggctgcacgcgctcttcatgatcgagttctcgctcgtcatgtggctgctggggaagacggtcggcatatcttgaaggccctttgatgctgtcgccgattctcccgacgtctgatgcaggggctcacctcggatgtacaaattgagcgcacatagttcactacttcagtatttcgccacgcataaaacacacacatcgttcttttttgtcctcctaagtattagttgtgcagtgtttttttattttttgagtaattcgatcgatgtttgactatattttgcagctttctgtacaacccgtcttcaaaaaaggaaaatattaaaagttacagtcattagctatgtacatattcacatcgtacttctttatgtttgctagagcttctatttccttggcaaaggtcactatgtacacccccatcaggctctgttatattgtgttctttttgtttgcccggaacatgagaaggcgatctctgtattgagcagcatctttatagcgctcctcgacagcagcaataagcatgccgcggaccaaatcgaattcctgggcttcaaagcaaggctggtcaccaggcttgtccagtcttgtgtactggatttggtcagagttcacgtaactcccagttggctttggttgtataactttcagaccgttgttgtatgcaatgcgcttattgacttgtataggaaccttgcaccggaaagcaatgttgatggcatctgatggcttgagatcaaaactaatagtctcttcttcatttccaatcttcgcaagatacaatctagaatagtaagcatcatgcaccatttctgtaatccgcaccaaacgtaccgtatatcccatcatttcggtcatctcctttaccacattataaattgttggccttggaattcgaatgttccgaagggcggccagtagcataatacttggtgtctccatgacaataatggggagcagaagatcgcttccatcttccatcttgagcacgatagcatggtgaggcgtagaatcgcgcagtcttagcacgcggggattattctggacacatctaaggtttcttccgtcgcgcattcttatcacaaaaccatctgacacgcatctgagctcaacagcctccatgacgctggagtcgacgaactcctcgccgctggcgtcgaaattcgccggcggggcgccgtccccgtcagatgacgagccgtagctgcagcgaacaggccaggcgcttgtgctgtgcatgtgctgctgggtcggggcaccgaagaacctgcgcgacacgccgtcgtagccgtcacctggcgagacaccaccgcaagccctcctccgcatgcgcacgcgcctcagcagctggccgccgatccgagagcgggaggtgagagcaggcgcagcgcagcgcggcagaatcggcccgcggatgacctccatccccttggattttcaagagtgacgctgaaacaacgttgggattcaccaccgagatcagaatatccgatcaccgcgaaatgatgaacggaagaagaggggtcgatcagctgagcttaccggcgctagctgccggatggag

SEQ ID NO: 1045 - DNA, 3564 bp, Brachypodium distachyon
gctcgggggtactactacttgtcttctgtctctgtgtccagtccactccacgcgcacagcctcattcatctctgccagtcctgccgcgctccccctccctgcctgtgcctgatcccaatcaccacgcccgcataatccgatccgggaacgtgcctgtccatggcggacacctcgtcggcgccgctgctgccgcggaagaagtcgccatcatcggcggcgcagtacacgcggtgcgcgtcgcacgcgggggacgagctccgcagcttccgcgcctgcctccgctggatgtgcgtggaccacacggacgggctccgctccgcggggtcgtgggcggtcttcttcctcctggccgtcgcggcgccctccgccgtcaccctcgctctcccggcctcggcgccgcagcggcccttcgacgggcaggtccaggcctccctcaccctggccgccgcgctcgcctacttctccctctcctccttcctccgcgtggggctccgccgcctcctctgcatcgaccgcctccgccacgactcggacgaggtgcgcgccggatacacggcccagctcaaccgctccttccggatcctcgcctgcttcctcgtgccttgctccctcgccgaggccgcctacgaggcctactggtactgggccgccgcgcccttccgctcgccatggtggaacgccgccgtctgcgcgctcgacgtcgcgtcctgggtctaccgcaccgccatcttcttcatgatctgcgtgctcttccgggtcatctgctacctgcaggtgctaaggatggtgggcttcgccagggagttcggcaggttcgcggaagttgccgtcgtgctcgagcaccaccgccggatcagggagcagctccgccggatcagccacaggtaccgcaggttcatcatcctctgcctcgtgctcgtcaccgccagccagtttgccgcgctgctcgccaccaccaggccacatgccaccatcaatctcgccaccgccggcgagctcgcgctctgctcggtgagcctggtggtcgggttgctggtctgcctccacagcgccgccaagatcacccacaagacgcagtcgatcacgagcgtggcggctgcctggcacgcggacgccaccatccacgccttcgacaacgacctggaggaccccgacccggccctgcccgcctccacgggctacatggcgcccgccaacgcctaccggctggcctccggcgaggagtccgatgacgacgacgacgacgatgccaggagcgaggactctctcgacgactccaagctcgtccccttccaggtcaacaacatgtgcttccagaagaggcaggcccttgtgacgtacctggagaacaaccgggcggggatcacggtgtacggcttcgtcgtcgaccggacatggctgcacgcgctcttcatgatcgagttctcgctcgtcatgtggctgctggggaagacggttgggatatcttgaaggtcccggctctctctttgctggcttgctgctgttggcgctggccgatctcttgtcaagtctgatgcagagggttacgctagggcggatgtataaaggaagatgaaacacaaatgatgatatggagggctattacttgtgtaggttcatctgatgaatgttatgagaatattactccccccttctaaattcttgtcgtggttttagaacaaatttgaactaaatccgcaacaacaatttaggataggagatagtactagttaccaaaggttggttcaatttaataatgagagtagtaccggttttgaaagttaatcagatgagcactgactgtgcttgttgatcttgtcaagtgtgctaaatcgttgtgttgagtagaaaatcttgaactgaacaagtcatgtgtcttgaacagatgataatgaagttcttgaagcatcaatgttacacagaacatcttttacatgagaatagagtgaaataacttaacaaattaaatggtaggttgaagctttcagaccacatccgagttaacctgagatcaagagagtaacagattgagatttgcgcacgacaagtggtcgaaatagcaaatccctacaccaaaacatcacaaatgaaacatgcaatcgacaacattacattgataagacataaatagcagtcgctgaatataacaagtccacagttcacttcgatcgagaaagcaaagcaaagcaaagaaagggtcagggcattcacatcaaaatccatgcaaggcagcacaggaaataaaagcactgctttggcgcaaagatgtatgcaaatcatatcatgcaggcacgggcatcgccgaacagagatctcagtccaacctgtatcctctgtttgctctcaggaatgaaacaaaacggaaggaacggcctgatgatgaaccttggagccatcacaacgcattatttttgcctcccacacacatggatagattgaagaaaccccaccatgatttcatctttcagctgccacttgttgacgttacatttgtcaccgtagtatggagccgccgatgagctctccctacagtccgaacagcagcaacttgctgtcccctttgagtattagctgaatcttgctgaatttcagaagcaccaactgaattagtcgagtaattacgcctaggcctttccctgtgccttctgtaagccctgctgtgtgaatctccgctggcaattcgtctgccacggctaaataaggatgccaggaagtcaatgctctcatccaaactaccatcagatgactcagagaactcaatcctctcactcagagtgcgatctaaggacgtgaagaagttgagtctctcctcgaagtcaaattcatctccatcagtgaacaaattgttgttactgccaccattcaactcaagcacataatcccccataatgacagctcctgggttcgtggccctgatagtgctgattgcatcctggcgctctctctcacattcaaactttttccactcacttgcaagtgcaggatcaacttcacgaggttttgctgaagggtgtttggagctcacatgcttgcaaagttctttatatgaaccaacaaattggcatccatcatgcatgcaggctctcttcttgcggttgagataatgacgagccggttcaaccacagtccaccctttaacctccccacggcacagagggcatgcaagttccattgcacacagttgtttgcttggtggtggtgtgtctgaaaggctacgggcagactcagtagaaacaccaagggccaatttctcctttgcgtaagcttctttgaagtgttcaagacagttagagtgatggtagttggtgccacacatatatggtcggcaacccttgtggtgagaagtacagaggaggaggacggcatcatgtggatgctccaagcaaactgggcaagtggcgcctttccattctcttttctcacaggccaatggcaaatcatttggttcgtctgttccttttgtcttccaaaagcaggaacgagcgtcagacaaggatgacatgcttcgatgagctgggacgtttcgggctcttggagatctcgtcataactttaaaacctgaga

SEQ ID NO: 1046 - DNA, 1299 bp, Triticum aestivum
aacatacttgttccttaactctgaaacctctgccttcacttagggatcgtcacaacaccaaggccaagcctcaaggcaaacaccttctccactctccacggccatggacgccgacgccgacacggtggtgttcgaggcaccggcgcacttccgcttctacaagagcggcaggatagagcgccttcaccggccacccatcctgcctgccggcgacgacgaggccaccggcgtcacctccaaggacgtcgtcctcgacgcggacaccggcctctccgtgcgcctctaccttcccaagctccaggaaccctccacgaagctcccggtcctcgtctacttccacggcggctccttcctcatcgagtcggccgactcctccacgtaccacaactacgtgaacgccctcgccgcggcggccggcgtcctcgcggtgtccgtcgactaccgcctggccccggagcacccgctccccgcggcctacgacgactcctgggcggcgctccagtgggcggcgttggcgcaggacgagtggatccgcgagcacggcgacacggcccgcctgttcctcgccggcgacagcgcgggggccaacatcgtccacgacatgctcatgagggtggcctccaacgacggcagcccgagggtcgagggcgcgatactgctgcacccgtggttcggcgggagcaagccggtggagggggagcacccggccgcgcccatggtcaccgggatgctctggtcctacgcgtgcccgggcgcggtgggcggcgcggacgacccgaggatgaacccgctggcgccgggcgcgccggcgctggagaggctcgggtgcgtgaggatgctcgtgaccgcggggctggcggacgggctcgccgcgcgcgaccgcgcgtaccacgacgccgtagctggcagcgcgtggggcggcaccgcggcctggcacgggtccgatggggagggtcacgtgttcttcctggagaagcccgggtgcgacaacgccaagcagctcatggaccgcgtcgtcgcgttcatagccggcgcctgatgatagagttgatctgcagatcatctacattgtgttggagaggaacttgctctgcatgactgcttgttcgtttactggtttaataaataggtgatggcgcctacctggagttttaagttttcttggagtatcgatttatcagagtctcaaattttgcgctccgagattatcagtaacatcattttgtgtcacgtaatcagaccaacttctagaagtagactggtaggcggtagctatcgactgctgcagcagcaacttca

SEQ ID NO: 1047 - DNA, 1078 bp, Pseudoroegneria spicata
  misc_feature (5)..(8): n is a, c, g, or t
ggccnnnnctcaaggcaaacaccttctccactctccacggccatggacgccaacgccgacacggtggtgttcgaggcaccggcgcacttccgcttctacaagagcggcaggatagagcgccttaaccggcctcccatcctccccgccggcgtcgacgaggccaccggcgtcacctccaaggacgtcgtcctcgacgcggacaccggcctctccgtgcgcctctaccttcccgagctccaggacccctccgcgaagctcccggtcctcgtctacttccacggcggctccttcctcatcgagtcggccgactcctccacgtaccacaactacgtcaacgccctcgccgcggcggccggcgtcctcgcggtgtccgtcgactaccgcctggccccggagcacccgctccccgcggcctacgacgactcctgggccgcgctccagtgggcggcgtcggcggaggacgactggctccgcgagcacggcgacacggcccgcctgttcctcgccggcgacagcgcgggggccaacatcgtccacgacatgctcatgagggcggcctccaacgacggcagcccgagagtggagggcgcgatactgctgcacccgtggttcggcgggagcaagccggtcgagggggagcacccggccgcgcccatgatcaccgggatgatctggtcctacgcgtgcccgggcgcggtgggcggcgcggacgacccgaggatgaacccgctggcgccgggcgcgccggcgctggagaggcttgggtgcgtgaggatgctcgtaaccgcggggctggcggacgggctcgccgcgcgcgaccgcgcgtaccacgacgccgtggccggcagcgcgtggggcggcaccgcggcctggcacgggtccgacggggagggccacgtgttcttcctcgagaagcccgggtgcgacaacgccaagcagctcatggaccgcgtcgtcgcgttcatagccggtgcctgacagagttggtctgcagatcatctccattgtgttcgagaggaacttgctctacatgactgcttgttcgtttactgggtgaataaataggtgatggcgccta

SEQ ID NO: 1048 - DNA, 983 bp, Secale cereale
cgccttaaccggcctcccatcctccccgccggcgtcgacgaggccaccggcgtcacctccaaggacgtcgtcctcgacgcggacaccggcctctccgtgcgcctgtaccttcccaagctccaggacccctccacgaagctcccggtcctcgtctacttccacggcggctccttcctcatcgggtcggccgacgacgccacgtaccacagctacgtcaacgccctcgccgcggcggccggcgtcctcgcggtgtccgtcgactaccgcctggcaccggagcacccgctccccgcggcctacgacgactcctgggcggcgctccagtgggcggcgtcggcacaggacgagtggatccgcgagcacggcgacacggcccgcctgttcctcgccggcgacagcgcgggggccaacatcgtccaccacatgctcatgagggcggcctccaacgacggcaggccgagggtcgagggcgcgatactgctgcacccgtggttcggcgggagcaagccggtcgagggggagcacccggccgcgcccatggtcaccgggatgctctggtcctacgcgtgcccaggcgcggtgggcggcgcggacgacccgaggatgaacccgctggcgccgggcgcgccggcgctggagaagctcgggtgcgtgaggatgctcgtgaccgcggggctggcggacgggctcgccgcgcgcgaccgcgcgtaccacgacgccgtggccggcagcgcgtggggcggcaccgcggcgtggcacgggtccgatggggagggtcacgtgttcttcctcgagaagcccgggtgcgacaacgccaagcagctcatggaccgcgtcgtcgcgttcatcgccggtgcctgacagagttggtccgcagatcatctccattgtgttcgagaggaaattgctctcgcatgactgcttgttggtttactgggtgaataaataggtgatggcacctagttggagttttaagttttctt

SEQ ID NO: 1049 - DNA, 613 bp, Triticum aestivum
gcgataagcagcctgcaccgcactccccacctctctgattgacagaccaccttagcagccaagccaagccagcctcgccgtctcacatccctgcagcaatggcgtctcgcgcagccgtggtggtcgtggccgtgaccgcgctgctgttcgcggcggcgtccgcgcaggagatggacgcgagcatgccgccggcgccggccccggtcacgggcgcggccgctggagccgccgcgtcggtgctggccgtggcctgctccgccgtgctgtccctgctcgtcgcacagtaggcggtgagctgctgctggtggtggtgcgtcgccgctcgtccggcctccggcgacggcgatgctcacttcttgagtttagggggagcagtagtaccgagtagtgatgggttgtgttgtgttcgtcttgagtggagcgtgactttctccgttgcttattcttttgtatcatacattgctgcgtgtattatttccgtctcgtgtgtcgtcggttcttctatgactatgaataaatattggatggtggttctatctctacatctacggtgccgaatcgttctctcgtgtgctgttctgttcatcttctcttcaatgtttgcattcgagtt

SEQ ID NO: 1050 - DNA, 544 bp, Pseudoroegneria spicata
gcggaggagagcggcggcggcggcggcaagggaggagaagcgatggcgaggggcgatagctgcttggcgcgcatcggcgccggagtcgccatcggcggcgcggtcggcggagccgtcggtgctgtctatgggacttatgccgctatcagattgagggtccctgggttgctgaagatcagacacatcggacaagccaccgttggcagcgctgcggtattcgggcttttcctgggagctgggagcttgatacactgcggaaaaaattactagttcacgtcaagttacctctggttttactaggttttaaaggattatcttatcttaggtaaaacatttgtttgatcttgaaggaacagtggagttctgctactatttactcggtcctggttttcgatatgtttgccctactgttgatgtggaaataaaatctttcatcatctgtatgagaattaagtggtgaaagcaggattcatgagaaaaaaacgtattgttgtattaaagtcacttcgtcgttcttagtaaaagaaataaactattctctcca

SEQ ID NO: 1051 - DNA, 583 bp, Secale cereale
gcagacgctgcgtcgagtcagattataccaagcaagaaatagaaggggccgtggggaacggaggagagcggcggcggcggcggcaagggaggagaagccatggcgaggggcgatagctgcttggcgcgcatcggcgccggagtcgccatcggcggcgcggtcggcggagcagtcggtgctgtctatgggacttatgccgctatcagattgagggtccctggattgctgaagatcagacacatcggacaagccaccgttggtagcgctgcagtattcgggcttttcctgggagctgggagcttgatacactgcggaaagaattactagttggcgtcaagttacctctggttttattaggttttaaaggattgtctgattaaaacatttgtttgatctttaaggaacagtggagttctgctactatttacttggtcctggcttttgatatgtttgccttgctgtggaaataaaatctttcatcatctgtatgagaagtaggtggtgaacacaggattcatgagaaaaaaaacattttagttgtgatatgtttgccttgctgtggaaataaaatctttcatcatct

SEQ ID NO: 1052 - DNA, 582 bp, Secale cereale
cagcccataagcagacgctgcgtcgtgtcagattataccaagcaagaaatagaaggggccgtggggaacggaggagagcggcggcggcggcaagggaggagaagccatggcgaggggcgatagctgcttggcgcgcatcggcgccggagtcgccatcggcggcgcggtcggcggagcagtcggtgctgtctatgggacttatgccgctatcagattgagggtccctggattgctgaagatcagacacatcggacaagccaccgttggtagcgctgcagtattcgggcttttcctgggagctgggagcttgatacactgcggaaagaattactagttggcgtcaagttacctctggttttattaggttttaaaggattgtctgattaaaacatttgtttgatctttaaggaacagtggagttctgctactatttacttggtcctggcttttgatatgtttgccttgctgtggaaataaaatctttcatcatctgtacgagaagtaggtggtgaacacaggattcatgagaaaaaaacattttgttgtattgaagccactatgtccttttcagtaaaaataaaa

SEQ ID NO: 1053 - DNA, 1106 bp, Triticum aestivum
gacgcgcaaggcaagcagcccataagcagacgctgcgtcgagtcagattaaccaagcaagaaacagaaggggccgtggggaacggaggagagcggcggcggcggcaagggaggagaagcgatggcgaggagggatagctgcttggcgcgcatcggcgccggagtcgccatcggcggcgcggtcggcggagccgtcggtgctgtgtatgggacttatgccgctatcagattgagggtccctgggctgctgaagatcagacacatcggacaggccactgttggcagcgctgcggtattcgggcttttcctgggagctgggagcttgatacactgtgggaaaaattactagatcacgtcaagttacctctggttttactaggttttaaaggattgtcttgtcttaggtaaaacatttgtttgatcttgaaggaacagtggagttctgctactatttactcggtcctggtttttgatatgtttgccctactgttgatgtgaaaataaaatctttcatcatctgtatgagaattaagtggtgaaagcaggattcatgagaaaaaaacttattgttgtattaaagtcactttgtcgttcttagtaaaagaaataaaccattttctgctgacattgaacggggtgaggggcagctgacgttttgttgatgttgtgtatatcagctactccctctatttacaaatattcctaagatgttctggactacatgcattccaaaaaaccccaaaacatgtctatatggagggagtactaaatccagacaacagttgcgtcttgttctagaggtcttgttctttttaacttggtcgtttacttataattaaacaaattgtctgttacgtactccctctgtcccataatataagaacgtttttcaagcgacaatcaagctcatgtgtgactccatttacttccgggacacaatgcttgattgtcgccttgccgaacaggctcaagctgctggcactcgtcggtaaccacagctcctgtcgcacagtaacctgaggggttcaagattgtttgcacgatgtctgttgaatcacattcgatcacaagagagaaatacagattattcgcaagctcgagccctga

SEQ ID NO: 1054 - DNA, 753 bp, Brachypodium distachyon
cgagggactgacgcaaagcagcccagtcccatatggccatataggcaaaggcaggtgcggaagattaccaagcaagaaagattccatcgggaaggcagcagcagaggagcgcggcggcggcaagctacgagaggagaggggatggcgagaggcgacagctgcttggtgcgcgtcggcgccggagtcgcaattggcggcgcggtcggaggagccgtcggtgctgtctatgggacttacgaagctgtcagacttagggtccctgggttgctgaagatcagacacattggacaaactacaattggcagcgctgcaatattcgggcttttcttgggagctgggagcttgatacactgtggaaaaaattattagttcacattctaagttttagacactagatctggtttttcgtgctcaagggatcttctgagtaaaaatctatttgatgtttaaagaacagacgtctactggtactatttactcaagtctagaatctttggtgtgcttgccatacttctggcatggaaataaaatatatgttcatctgtatgaaaatgtaggtggtgaaagcagcaccgtgaaaaactagttttttgtaagctttactcctttaagttgtatcaagacaacattttttttgtgacatcaaatagaaagagggccagctaatgctttcttgatgacgtaattagtgttgtgtatatttgctctaacgcttcaagataacaattctataggaagatcaaattaaatgta

SEQ ID NO: 1055 - DNA, 628 bp, Brachypodium distachyon
gaagagaggggatggcgagaggcgacagttgcttggtgcgcgtcggcgccggagtcgcaatcggcggcgcggtcggcggtgccgtcggtgctgtctatgggacttacgaagctgtcagacttagggttcctgggttgctgaagatcagacacattggacaaactacaattggcagcgctgcaatattcggggttttcttgggagctgggagcttgatacactgtggaaaaaattattagttcacattctaagttttagacactagatctggtttttcgtactcaagggatcttctgaagtaaaaatctgtttgatgtttaaagaacagatgtctactggtactatttactcaagtctagaatctttggtgtgcttgccatacttctggcatggaaataaaatatatgctcatctgtatgaaaatgtaggtggtgaaagcagcaccgtgaaaaactagtctgttgtaagctttactcctttaagttgtatcaagacaacctttttttgtgacatcaaatagaaagagggccagctgatgctttcttgatgaggtaattagtgttgtgtatatttgctctaacgcttcaagataacaattctataggaagatcaaattaaatgtgtagat

SEQ ID NO: 1056 - DNA, 514 bp, Musa acuminata
gggaaaaggaaatgcataagaaagaggtttgctatcgcgactaatcgtgttggcggaaaccagaaagagcgatggggatggcgagagacagctgcttggctcgcgtcactgccggcgtagcgattggcggcgccgttggcggagcggtcggtgccgtttatgggacatacgaggctatcagatataaggtgccgggattactgaagataagatatatcgggcaaaccactctgggaagtgcagctgtttttggactctttttgggtgctggcagtttgatacattgcgggaagtcttattgattgctgttggagtcttttgagcatgctgggtgtgccgagttctgaatcgttttgggattttagtttgtcttgaactaatcatatttgtctattacatcaaatattgtaatgagcaggtaccggaaaagcaaattaagttaatttgtttcgacccaaaggttatgttaaaaacttaaaatcaagtaatgggtgtcacaaccgcctgagggagt

SEQ ID NO: 1057 - DNA, 630 bp, Cirsium arvense
ggttatttttgttatttaaggggcagctcttaaaagaggacttttatctgattcggtcggcttctcctcctccctataaatcgatctcttctctaatcgattacatccttcacaaaaagccaccttcgatctccaacaattcgatctcaactaggttcgattgcaccaagttcgatcttcttggccgtcgatttgcaacagctgactcgctggggatatactagcatcatttcggcatttcatcgcaagaggatccttaaagcttcacaaaccaatcgagagagcgcgatggcaagggatagctgtctagccagagtaaccgctggagtcgccgtaggtggtgccgttggaggggctgttggtgctgtatatgggacctatgatgctattagaaataaggtccctggacttttaaagatcagatatattggacaagcaacggtgggaagtgctgccatttttggtcttttcttgggtgctgggagcttgatacattgtgggaagtcatactgagggagaaacttaattgtttcgatattacaaacaataaaacgttagtcgaatttgataaaatagttgcacaattctctgttagctttgaaatttaagttggttttcctatatttaaga

SEQ ID NO: 1058 - DNA, 575 bp, Cynara scolymus
  misc_feature (339)..(339): n is a, c, g, or t
gcggggttagaaattaacctaaagcttcttcctagtcttcacagcttcacaaattaatcgagagagagggagagagagagatggcaagagatagctgtctggccagagtaaccgccggagtcgccgtaggtggtgccgttggaggggctgttggtgctgtatacgggacttatgatgctattagaaataaggtccctggacttatgaagatcagatatattggacaagcaactgtgggcagtgctgccgtttttggtcttttcctgggcgctgggagcttgatacattgtgggaagtcatactgagggagggacttgttccgttttgctgggttgaggnttggaacactttggctgtgagacatcactattttggtcgttcagtattggtgacggtgacggtgatagtgatactacgacagatttttataaatgcatgatcttatgattgatttaagaaaaagtactacggggctgttcggttcgttttctattaagacctgtatggataaagatgtatgtattgataaagttgtctatatgataacttataaattgttgttcggttgtcatgcc

SEQ ID NO: 1059 - DNA, 468 bp, Allium cepa
tagtatcagcaaaagaacaaagtaggtaatacaaacgcagagttacggggggtaggtcaatatttcgtctgtttcgcagatattcaatctcaaatagcagttctcaaagatatctatggcgagagacagctgcttgactcgaattgctgccggagctgctatcggtggcgctgttggtggcgctgttggtgctgtttatggaacttatgaagctatcagatacaaggttcctgggttattaaagattagacacattgggcaaactaccattggaagtgcagcagtttttggactctttttaggcgcaggaagtttgatacactgcggaaaatcttattgaacaggcatcaaaattgttttctccttctgtaagagtgtttttaatcgcagaataatcatcatcgtttagcttcttactttcttagtgttttttaatacattatcatatggtggtgtctgtaatttttt

SEQ ID NO: 1060 - DNA, 550 bp, Salvia sclarea
ctactagaccttggctgtcactcaggaaggctcaagttttattgaagagcaaaaattgtcatctgcgacaaattgtagagagagtgaaagatagaaagagagaagcgaagcgatggcaagagatagctgtctgacgcgaattacggcgggcgtcgccataggaggagctgtcggcggcgctgtaggtgctgtttatggaacttatgatgctataagatccaaggttccaggtcttctaaaagtacggtacattgggcagacgacagttggtagtgctgctgtatttggtcttttccttggagctggaagcttaatacactgcgggaaatcttattaggcttgttggttccggtttcaaaataagcaagcagtgggtttgaagaactgtgagattggatcatatgacgtttattatagatgatacttccttttagcttagctttcttcgtgtttttcttttgatgaattcatttcgtttctgctagactctggggcattctagaaactaacgcgttcctagtctttcctttcattttagtatgaatactgc

SEQ ID NO: 1061 - DNA, 423 bp, Zostera marina
accgaagaaaatcgactacaatgggaaataataggaaagatagttgccttgctcgcatcggcgccggagttgctatcggcggtgctgttggaggcgcggttggtgctgtatatgggacttatgaggctttcagatttaaggttccaggattattgaaaatcagacacattgggcaaaccactatcggaagtgccgcaatttttggactttttcttggagcgggaagcttgatacactgtggaaagtcttattgacgagttgggaatagtagtagcaacttgggaagtgcatgagcagcagcagaaggcttagcagcagagagggttggaacttggaatgtccaaatgtgttaattttttaatcttctaaatttgattgtaacaaacttatttaaaaatgttgatgacaaaccttaagagttaa

SEQ ID NO: 1062 - DNA, 404 bp, Centaurea maculosa
tagagagagagagagatggcaagggatagctgtctagccagaataaccgccggagtagccgttggtggtgccgttggaggcgctgttggtgctgtatatgggacttatgaggctgttagacataaggtccctggactaatgaagatcagatatattggacaagcaacggtgggcagtgctgctatttttggtcttttcctgggtgctgggagcttgatacattgtgggaagtcgtactgagatcgatcgatattacgaaccaataaaaccgtagtcaactttgataacttccttgaacaattctcttattaacttgggaatttaagtcgttttcgtgtattcaagttttgctgggttgaggtttcgaacactttggctgtgagcacgtcgttgttttggtggtt

SEQ ID NO: 1063 - DNA, 394 bp, Centaurea maculosa
tagagagagagagagatggcaagggatagctgtctagcaagaataaccgccggagtcgccgtaggtggtgctgttggaggcgctgttggtgctgtatatgggacttatgaggctgttagacataaggtccctggactcatgaagatcagatatattggacaagcaacggtgggcagtgctgctatttttggtcttttccttggtgctgggagcttgatacattgtgggaagtcgtactgagatcgatcgatcgatattaagaacaataaaaccgtagtcaactttgataacttccttgcacgattctcttattaagtcgttttcgtgtactcaagttttgctgggttgaggtttggaacactttggctgtgagcacatcgttgttttggtggtt

SEQ ID NO: 1064 - DNA, 483 bp, Manihot esculenta
aaaacctagagagttagatatcaatcaacaagtacagattttcatattatcggaatggcgagggatagttgcctggctcgagtgaccgccggcgtggccgttggaggtgctgttggtggcgctgtcggggctgtatatgggacatatgaggcaatcaggtataaggtgccaggacttttgaagatcaggcatattggacaaacaacactaggcagtgctgccatttttggtcttttcttgggtgctgggagcttgatacactgcgggaagtcatattgagcgatatttggtgcttcagccaaataaattctttgttttggaggatctgcttcgcttgccttgaacagcacagatacaacttgccataactagtttgttcaaaagcaaaaatttcacttttgttggtgatctcagaaacagttgaaagacaattagccttcttgcttctgatatttattgataatgtggctttgacaattctct

SEQ ID NO: 1065 - DNA, 530 bp, Centaurea maculosa
aattaacctaaagcttcttcattcctctgtcttgttcacaaagaaatcgaggtagagagagagaaagatggcaagggatagctgtctagccagaataactgccggagtagccgttggtggtgccgttggaggcgctgttggtgctgtatatgggacttatgaggctgttagacataaggtccctggactaatgaagatcagatatattggacaagcaacggtgggcagtgctgctatttttggtcttttcctgggtgctgggagcttgatacattgtgggaagtcgtactgagatcgatcgatattacgaaccaataaaaccgtagtcaactttgataacttccttgaacgattctcttattaacttgggaatttaagtcgttttcgtgtattcaagttttgctgggttgaggtttcgaacactttggctgtgagcacgtcgttgttttggtgtttttttatctgtgatgccgtaacgttgttattatgacagattcttttaaaatgcatgataatatgattgatttaag

SEQ ID NO: 1066 - DNA, 496 bp, Cirsium arvense
aagagagagagagagatggcaagggatagctgtctagcaagaataaccgccggagtcgccgtaggtggtgctgttggaggcgctgttggtgctgtatatgggacttatgaggctgttagacataaggttcctggactcatgaagatcagatatattggacaagcaacggtgggcagtgctgctatttttggtcttttccttggtgctgggagcttgatacattgtgggaagtcgtactgagttcgatcgatattacgaacaataaaaccgtagtcaactttgataacttccttgcacgattctcttattaacttgggaatttaagtcgtttttcgtgtactcaagttttgctgggttgaggtttggaacactttggctgtgagcacatcgttgttttggtggttctttatctgtgatgccgtaacgttgttattatgacagattcttttaatatgcatgataatatgattgatttaagaaaaaagaaaaaagtacc

SEQ ID NO: 1067 - DNA, 544 bp, Vitis vinifera
ttagagttcaggtgaagatggaagaattaggatgagcagaaagtctatataacaaaaaccacgtcacagactcacatacaaaccctcgcaatacagactgccaggatatagagtaatggcgagggacagttgtctggctcgcgtcaccgccggtgttgccgttggcggcgccgttggaggggctgttggtgctgtatatgggacttatgaggctattaggtataaggtacctggacttctgaagatcaggtacattggacaaactactctggggagtgctgctgtttttggtctattcctgggtgctgggagcctgatacactgtgggaagtcttattaagctttattcagttgaccaaataaataaattttgttttccttacaagaaccaattagttaaagaaatacatgtttttagactctgaatgaaatggctttgatatgatcagatattttttctgatgtgaatcctttcttttctctttatgcatcttttgaaatgattttatgatggctagcattctcttgaagaagttttccctta

SEQ ID NO: 1068 - DNA, 609 bp, Avena sativa
accaggcgcagcccacaaacggaaccaggcgccgatttcccaagcaagaaagagagattccctagcaacgggggcggacgcggcggcggcaagcgaggagcggagagccgatggcgagaggcgatagctgcttggcgcgcgtcgcggtcggagtcggcgtcggcggcgcggtcggtggagcagtcggtgctgtctatgggacctatggcgctatcagatacaggatccccgggttgctgaagatcagacacattggacaatccactattggcagcgctgcactattcggacttttcttgggagctggaagcttgatacactgtgggaagaactattagcttgcgttctaagatttggacaatacctctggttctctaggcttcaaatggctgtctgagtaaaaaattatttgtgatgtttaaagaacaatcaagttctgctattattttactcattctcgactcctcatatgtttgtcctactattggagtggaaataaaatctttgttcagtctttatgagaatctagctggtgaaagcagcactggtcaaaaacaagtttgttgtaaatcccgctccttcaagtttatgcttatcagttacttcctt

SEQ ID NO: 1069 - DNA, 525 bp, Allium cepa
aaataaaataaaaccttcatggcgagagatagctgcttgactcgtatcgttgctggagctgctgttggcggcgctgttggtggcgcagttggagctgtttatggaacttatgaagctattcgatacaaggttcctggactattgaagatcagacacattggccagactacagtagggagtgctgcaattttcggactgtttttaggagcaggaagcttgatacattgcggaaaatcttattaaaccaagcagcaaattgcacaatagtcaatcttgctgttcaagctctttatctgcccattattttctaatacatagtgtcatagcattttattttttctataatgaattttaaactaatttgtctgttttcagctttagcctgggtgggcataagaaatttattcggtatttattaaataaatgcgactttaatatattcagagaaaaaataacattggataatgtcatttgtgaatatggaaaatatgtcgcgttttaagagccggcatgctttgaaaacct

SEQ ID NO: 1070 - DNA, 546 bp, Populus trichocarpa
gagcccaaactatttaacaaggcaaaacaacaacaactaaacccccaagccatcaccatcaccgccggctccaacactctctcatcaataacgattacaaatggccagggacagctgcttggctagagtcaccgctggcgttgccgttggaggtgctgttggcggcgcagtcggtgctgtttatgggacttatgaagctattaggaacagggttcctggacttttgaaagtaaggtatattgggcaaaccacagttggaagtgctgcaatttttggtctcttcctgggtgctgggagcttgattcattgcggaaagtcttactgacttaccatccattttgtaaccataagattgattctcaactagagagattttgtatttaaagcgaaatatttttttggtatcaaatctcaaaccatataagatcaagcctctattatgtctgtttatgtttgtggttgggacttctaccatccaaaactgcattgcgaactattataggcctcaaggctggctttatattacaaagtactgatctatttcat

SEQ ID NO: 1071 - DNA, 637 bp, Populus trichocarpa
ctttaatctttgagcccaaactatttaacaaggcaaaacaacaacaactaaacccccaagccatcaccatcaccgccggctccaacactctctcatcaataacgattacaaatggccagggacagctgcttggctagagtcaccgctggcgttgccgttggaggtgctgttggcggcgcagtcggtgctgtttatgggacttatgaagctattaggaacagggttcctggacttttgaaagtaaggtatattgggcaaaccacagttggaagtgctgcaatttttggtctcttcctgggtgctgggagcttgattcattgcggaaagtcttactgacttaccatccattttgtaaccataagattgattctcaactagagagattttgtatttaaagcgaaatatttttttggtagcaaatctcaaaccatataagatcaagcctctattatgtctgtttatgtttgtggttgggacttctaccatccaaaactgcattgcgaactgttataggcctcaaggctggctttatattacaaagtactgatcaatttcatgaatctgtacttgacgtaatacatcattaatctcaagtctgctttctagacaaatttaatcgctgctaatttgttgttaa

SEQ ID NO: 1072 - DNA, 532 bp, Salvia sclarea
gcatgaggcttgttctcatctgcgataaatgtagagagagaaagatagagatataagagaagacatggcaagggatagctgcctcacacgaattacggcgggcttcgccatcggaggcgctgtcggcggcgctgtgggtgctgtttatggaacttatgatgctattagatccaaggtcccaggtcttctaaaagtacggtacattgggcagacgacggtgggtagtgctgctgtttttggtcttttccttggagctggaagcttaatacattgtggcaaatcttattaggctcgtttgttctagtttcaaaataagtaagcaccgtggatttgaagaatcgtgggaacatcacgttgttatagatgatcatgttagctttagtttttttggccattttatgcctaagttgtgttttccttttatgaatccgttttggtagactatggagctttcgagaaactaacgtgctcccaagtcttttctttaattttagtatgaatactgcaagtgcatatatctattcttcgtatt

SEQ ID NO: 1073 - DNA, 414 bp, Senecio madagascariensis
  misc_feature (292)..(292): n is a, c, g, or t
tggtatcaacgcagagtacgcgggggagagagaaagagtaagagagagagagatggcaaaagatagttgtttagctagaataacagccggtgtcgctgtcggaggtgctgtcggaggagctgtcggtgctgtatatggaacatatgaggctattaggtacaaggtccctggacttttgaaggtcagacacattggacaaacaacggttggcagtgccgctattttcggtcttttccttggtgctgggagcttgatacattgtgggaagtcctactgagtgtctttttttaanattataaacaataaatccttagtcgactatgataactttctaatgccgatgtgcacatttctcttgttaatttcaatcacaaatgaagcactttttgttatccttgttctggtttctctaag

SEQ ID NO: 1074 - DNA, 574 bp, Nicotiana benthamiana
aattggacctatttatcgaaactctcaaaaatcctcagagaagtagaaccaaagtcagtgtgtgtgtgagagagagagagagagatggcaaaagatagttgtctagcgagaataactgctggggttgctgtaggcggtgcagttggtggcgctgttggtgctgtttatgggacttatgaggctattagatacagggtgcctggccttatgaaaatcagatacattggacaaacgactttgggcagtgcagccatttttggtctcttcttgggtgctggaagcttgatacactgtggaaagtcttactaagcatatatttgctagctgaagttaaacttcttgattatccgagtcgttatgagactagtgtgcctgcgcaattccaatattttttttctgtctttcagttaagttatgatgcttaaattggtgattcaacattgagcttttctctaacatttcagctgcagtttatggctcagttggtaggttatggtgttacctcgttcccccttttccatcatgtaacaataaacatcaaaaagacaacaaggaaagagaagggaaaaaattt

SEQ ID NO: 1075 - DNA, 721 bp, Ricinus communis
atggatttctgccttgccttttccttctaataagtcgcaactatttctatttccatttcaattctatgcatacatacgtcaacctgcaaaaaccctagtgatagtaattacaaaatccaaatggctagggatagttgcctgactcgtgtcaccgccggcgtcgctattggaggtgctgtgggtggcgctgtaggtgctgtgtatgggacatatgaagcaatcaggtataaggtgccaggacttttgaagatcaggtatattggacaaacaacattaggcagtgctgccatatttggtcttttcttgggtgctgggagcttgatacattgtgggaaatcatattaagcaacatttggcatcagccaaattaattctctctttacagggttcttctgtgcttcacttggccctgaacagcttggatagaccttgtcatccatgcctagtcgtttcttggaaagctaaatttcatattttcttagttttatgatcatcgaaacagctgaatgacaattagccttcttgcttgttcattctactgctattctcgttctgactgctatccaggaccttgatttgatcataagctcaattttctacttggaacaatctttctatgttgtattttactatttacttttaaagggtcaaccgagcaaattcaatatcacatgcatcaaattggattataataattaagctgaagatcagtattattcat

SEQ ID NO: 1076 - DNA, 738 bp, Ricinus communis
atggatttctgccttgccttttccttctaataagtcgcaactatttctatttccatttcaattctatgcatacatacgtcaacctgcaaaaaccctagtgatagtaattacaaaatccaaatggctagggatagttgcctgactcgtgtcaccgccggcgtcgctattggaggtgctgtgggtggcgctgtaggtgctgtgtatgggacatatgaagcaatcaggtataaggtgccaggacttttgaagatcaggtatattggacaaacaacattaggcagtgctgccatatttggtcttttcttgggtgctgggagcttgatacattgtgggaaatcatattaagcaacatttggcatcagccaaattaattctctctttacagggttcttctgtgcttcacttggccctgaacagcttggatagaccttgtcatccatgcctagtcgtttcttggaaagctaaatttcatattttcttagttttatgatcatcgaaacagctgaatgacaattagccttcttgcttgttcattctactgctattctcgttctgactgctatccaggaccttgatttgatcataagctcaattttctacttggaacaatctttctatgttgtattttactatttacttttaaagggtcaaccgagcaaattcaatatcacatgcatcaaattggattataataattaagctgaagatcagtattattcatgcctaaatggaaatttt

SEQ ID NO: 1077 - DNA, 306 bp, Cicer arietinum
aaattgcaatggccagagacagttgcctcgctcgtgtcacagccggcgctgccgttggtggcgctgtgggcggtgccgttggtgctgtgtacggaacatatgaggctattagatataaggtacctggacttttgaaaattaggcatattggacaaactacacttggcagtgctgctatttttggtcttttcttgggtgctggaagtttgatacattgtggaaagtcatactaagcatcaagattttatcttcctacttgcagagtcttgcttgctgcccttgtaatgtatgagtagagcaggaatt

SEQ ID NO: 1078 - DNA, 708 bp, Cicer arietinum
caaataaaaaactagttcagtttcagagtttctcctaacgaacgacacacaaaattgcaatggccagagacagttgcctcgctcgtgtcacagccggcgctgccgttggtggcgctgtgggcggtgccgttggtgctgtgtacggaacatatgaggctattagatataaggtacctggacttttgaaaattaggcatattggacaaactacacttggcagtgctgctatttttggtcttttcttgggtgctggaagtttgatacattgtggaaagtcatactaagcatcaagattttatcttcctacttgcagagtcttgcttgctgcccttgtaatgtatgagtagagcaggaatttactttttctttttttggttttctcaattttggaaaaggtttgatgatggtagctgttggactacttttttatgaaatttctcatttatttctcctggacagtactgatgaaatatctttgcaagggcttctctttcgcttttgattcctcacttttcatgctattactgagacagtgaattgcataaaaatcatgcacgtgtgtgtctttgtttgtgtgcacgtatttgcatttgtatgtgtatgtgcatgccttaccggtactgtcaaatatctgcaccgtggcggattgcagtggtggatttcttgacaactgccatggccaatttgtgaaggatggcaacaacatga

SEQ ID NO: 1079 - DNA, 384 bp, Cirsium arvense
tggcaagggatagctgtctagcaagaataaccgccggagtcgccgtaggtggtgctgttggaggcgctgttggtgctgtatatgggacttatgaggccgttagacataaggtccctggactcatgaagatcagatatattggacaagcaacggtgggcagtgctgctatttttggtcttttccttggtgctgggagtttgatacattgtgggaagtcgtactgagatcgatcgatcgatattaagaacaataaaaccgtagtcaactttgataacttccttgcacgattctcttattaagtcgttttcgtgtactaaagttttgctgggttgaggtttggaacactttggctgtgagcacatcgttgttttggtggttctttat

SEQ ID NO: 1080 - DNA, 556 bp, Gossypium hirsutum
ttcgacaatctgagcatctaagcctaaccgaactcgcagaaaacctaaacaaacaaaacaaacggaaacaagggaagacgttatactgagccgacatggcaagggacagctgcttggctcgcgtcaccgctggggtcgccgtcggaggcgctgttggcggcgccgttggtgctgtttatgggacttatgaggcaattaggtacaaggttccaggactgctgaagattcgatatattgggcaaaccacattgggcagtgcagcaatattcggacttttcttgggtgcagggagcctaatccattgtgggaagtcctactaaaccaattcattgtttgtcttgaagaccttgagaatgtatttctcagaatggtgcttagctttagatttaaaaagaaatggtgtttaacgtttgcaagcctcggttttgttctttgagcttcctctattgcctttctgtgggagaatgcatacttgggaatacatttgacttcaatcaatgttgcataaatgtttctcctttgttatttcaatttttatccccataaaaacgcattt

SEQ ID NO: 1081 - DNA, 560 bp, Cucurbita pepo
ctgtgagatcggagaattcaactttcaaaaagaatcgtgttgaaaagattgttgagatacatttcgaagcttaattgctcgaggaacaaattttctccgtctcttgttcgaggagaataatattaaggtctctgagaatggcgagagatagctgcttggctcgagttactgcgggagttgccgttggtggtgctgtaggtggagccgtcggtgctgtttatgggacttatgaggccattaggtttaaggtgccagggcttctgaagatcaggtatattggacaaacaacacttggaagtgctgccatatttggccttttcttaggggcagggagtttgatacattgtggaaagtcatactgaatctcacaagttcctgaatttggatgagataatattgtttgcttttagtttccttgcttttcaacatgaagttattgcagacggtcatttgtttagttaaagggttccgtttgttttagtttaaggaacaaaatggtcaattgatgatgccttcagccctacttggatgtgaagttttcaagttttgttgcctcatga

SEQ ID NO: 1082 - DNA, 563 bp, Euonymus alatus
cggccgggggaagcggtcgtgcttgcagactcgaaagctgttcagtgtgtacgccgcatagaggagtttgagactaaaacggagaggatcgacatggcaagagatagttgcttggctaggatcaccgccggcgttgccgtgggcggcgcagttggtggcgctgtcggtgcggtttatgggacttatgaggctatccgatataaggttcctggactgctaaaagttaggtatattggacaaactacattgggtagtgcagctatttttggccttttcttgggtgctggaagcttgatacattgtgggaaatcttactgaatgctctttcgatagtactttttggttcataaggttgtattttacataattatgagagaagatataagttttcttctgctcataaaataattatgttcaagatgaatttgcatgattcataagatacttttttgtgtccttttttgaatgctggagccagtcagagagattacttaactattatatgagggaaaatacttgatcatctacttggtttatagctgattccacacaaaaaagccata

SEQ ID NO: 1083 - DNA, 468 bp, Euphorbia peplus
acgcaagacttcaattataataatcctcgaatggctagggacagttgccttgctcgtgtcaccgccggtgtcgcagtcggtggtgcagtcggcggcgctgttggtgccgtgtatgggacatatgaagcaatcaggtataaggtgccaggacttctgaagatcaggtatattggacagacaacactaggcagtgctgcaattttcggtcttttcttgggtgctggaagcttgatacattgtgggaagtcatattgactgacagtttggtgaattttccaatttagttttctgctttagaagcatttgcctttgcaatttgacgagcatatatacaggtttcgattgctagtttctgcggaaggaaaaactttcatctgtttgccagtttttatgacctcataaccagctgattgagataattagctttgtagcctttgttaaattttactagtatggttggttttccgc

SEQ ID NO: 1084 - DNA, 423 bp, Euphorbia peplus
atccaaaacacttcaattcaattttttccttcagtattaatcggaatggcgagggatagttgccttgctcgtgtaaccgccggtgtcgcagttggtggtgcagtcggcggcgctgttggtgccgtgtatggaacatatgaagcaatcaggtataaggtacctggacttctgaagattaggtatattggacaaacaacactaggtagtgctgcaattttcggtcttttcttgggtgctgggagcttgatacattgtggaaagtcatattgagtattttccaggttttgattgccggtttcgtatgtttgtcagtgttttattggcctcaaaaaacatctgaatgatataattagatttttaccctttgttaaattttgctgttatgtttgaattgctacaattatatgattttttagtgatgtg

SEQ ID NO: 1085 - DNA, 614 bp, Gossypium raimondii
tggtacaaaaacataaaaaagttgaagcatccgacaatctaagcatctaagcctaaccgaactcgcagaaaacctaaataaacaaaacaaacggaaaacaagggaagacgttatactgagccgacatggcaagggacagctgcttggctcgcgtcaccgctggggtcgccgtcggaggcgctgttggcggcgccgttggtgctgtttatgggacttatgaggcaattaggtacaaggttccaggactgctgaagattcgatatattgggcaaaccacattgggcagtgcagcaatattcggacttttcttgggtgcagggagcctaatccattgtgggaagtcctactaaaccaattcattgtttgtcttgaagaccttgagaatgtatttctcagaatggtgcttagctttagatttaaaaagaaatggtgtttaacgtttgcaagcctcggttttgttctttgagcttcctctattgcctttctgtgggagaatgcatacttgggaatacatttgacttcaatcaatgttgcataaatgtttctcctttgttatttcaatttttatccccataaaaacgcatttaaatcaaaataaatcattattttgtcaa

SEQ ID NO: 1086 - DNA, 633 bp, Zea mays
atacctgtatgcattcccttcacgaaaacctggtgaggaatctaccaattgcttttcgtctcctgtccatcccttgtgcgctaccgctcctctcccttggcaacgacgactggcgccgccgctgccagacttcgctgggcatctcgccggcgacgagctcccaccaggattagagaaggtgatggcgaggagtgacagctgcctggcgcgcgtgggtgccggagttgcgatcggtggcgcggtcggcggagccgtcggtgcttgttatggaacttttgaggcattcagatacaagatccctggattgctaaagatcagacatatcgggcaaactactgttggcagcgctgcaatttttgggcttttcttgggggctgggagcttgattcactgcggaaaatcctactagtttgtttccctcctttttctgaacacgactttgtcgatgtgcttcagaggaggattctagattttgagcgctaccctgagtggcttcagtgaaaactattcaacgcctgtacaatttaacagctaatacctcagggttggaaagagcaatcaagttatgtcctggtttggtgtggatggaaatactccctccatttcaaattaaaataaaattcgttttaaata

SEQ ID NO: 1087 - DNA, 625 bp, Cucumis melo
tcctgaaaggattcggtgatagttgatattcaattcgaagcttaattgctcgaagaacaaattttttctttgtgtgttttcttcgaggagaataatatcaaggtcgctgagtatggcgagagacagctgtttggctcgagttactgccggagttgccgttggtggcgccgtaggaggagccgtcggtgctgtttatgggacttatgaggccattagatttaaggtcccaggactattgaaaattaggtatattggacaaacaacacttggaagtgctgccatatttggccttttcttaggggcagggagtttgatacattgtggaaagtcatattaaatcacaaggttttgtaattggatcagataatattgtttctttttttttttaatcttcttttagattccttgcttttcaacatgaagtttgagttagtgcagttggtcatttgtttatttaaaggcttccatttgtggttgttggttaaaagaacaaagtggtcaattgatggtgatatggtttcaccctatttagatgtcatgaaatattgattctcgtttcaagattttaattttagggatatatcgagttatcttttaaattaaaagattcatcaaagttgtttct

SEQ ID NO: 1088 - DNA, 514 bp, Momordica charantia
gctccgaaatctttctcaggagatggtagatatctaattcgaagctttaacttctcgaggaatagaatctttctgcgtttcttcaaacgactatggcgagagatagctgcttggctcgagttactgccggagttgccgtcggcggcgctgttggcggagccgtcggtgctgtttatgggacttatgaggctatcagatttaaggtgccaggacttctgaaaatcaggtatattggacaaacaacacttggaagtgccgccatatttggtcttttcttgggtgcagggagtttgatacattgtggaaagtcatactaaatctcctgtgttttctgtatttggattggatcaaaataattattggttgtttttagatttctttctttttcaatatgaaggcaccgcaccatcatcgaatacaaatagtccagccgctcatttgtttgtttaaaagcttttcattgtcttattataacggtcaaaatgatcaattgatacattgatatggcttcaac

SEQ ID NO: 1089 - DNA, 320 bp, Phalaenopsis aphrodite
tcgtcaaccgtaaatggcgagagatagctgtatggcgcgcatcgccgccggcgctgcagtcggcggcgccgtcggcggagctgtcggtgctgtgtatggaacgtacgaggctattagatataaggtgccaggattgttgaagatcaggcatatcggccggacaactctgggaagcgcagcagttttcgggctcttcttaggggctgggagcttaatccactgtggaaagtcctattgatttcctgttacagttttggcttccaagttgcagagtatggcattctatcaaatcaaattcatgctcctgagtttgtatttgc

SEQ ID NO: 1090 - DNA, 707 bp, Cajanus cajan
cgcaggacagctagggataaaacgaaggaggaacacgttagtttggttttcactttcacagttctctcccgaaaacaaaactagtcacagcgtcttacacgactcccaatggcaagggacagttgcctcgctcgtgtcaccgccggcgccgctatgggcggcgctgtcggcggcgccgtcggtgctgtgtatggaacatatgaggctattaggtacaaggtacctggacttttgaaaattaggcatattggacaaactacacttggaagtgctgctatttttggtcttttcttgggtgctggaagcttgatacattgtgggaaatcatactaaggataaagatttgttctcccccctacttacagagctttggttgctgcccttgtaaagtatgagtaaagcagggatttactgttttttttggttttctggatcatggaaaaggtttcatggcactactcctgtgaaatttcttatttatttctccctggatagtactgttgaaatttctttgctggggttttctttctactttttgattccccactttcatctgagagtctgagacagtgaattgctcttgcaataaaaaagcagtgcagatgcgtgtgttgacagtgttgtgtttatgttacttgatgtctttaagcactcccctcctttcactaaaattactcgctcaaacctaattccatactcagttatta

SEQ ID NO: 1091 - DNA, 521 bp, Plantago ovata
gggggcacttgaaacaaaacaaagaaataaagtgaacaaggaagaaaagcgagaattaggcagagtgatagctagctggtagtggagaagagacgaagaagaagaagatatggccagggatagctgtctatctcgcgtcggggccggttgcgccatcggtggcgctctcggcggtgcggttggtgctgtttacggaacttacgaggcgataaggttcaaggttccaggttttttgaaaatacgacatattggacaaactacacttggaagtgctgctgtttttggtctgtttcttggagctggaagcttaattcattgtggaaaatcttattaaggacagactgttccaatttgccatcaagatgtatgggaagaagagttgaacaagatgacatgcctgtggatatgttcatcaggttatttgttttagccgtttttggctttttctgctaaatgttattcctgttgtgattcttggaaatgcattggtatctatgatctggtatctattacactttcct

SEQ ID NO: 1092 - DNA, 446 bp, Solanum tuberosum
cacaaaatatcgacaaaagcccacttaggaagtaattgagaattgtcttccaaggcaataaggttttacatatatttgttgcggcactgcaaaacgcctcatttgagaagagagaaaaatatggcaagagatagttgtctagcgagagtaactgctggtgttgctataggcggtgcagttggtggtgctgttggtgctgtatatggaacttatgaggctgttaggttcaaggtgcctggacttctgaaaatcagatacattggacaaactactttgggaagtgcagccatttttggactcttcttgggtgctgggagcttgatacactgtggaaagtcttactgagcatatatttgctagctgtgtggaattgaattgttgttatcagaataatgtgcttctgcaatttcaataaatttgagtttagtgatgataattggtgattc

SEQ ID NO: 1093 - DNA, 462 bp, Solanum phureja
ttttttttcaaatttcacaaaatatcgacaaaagcccacttaggaagtaattgagaattgtcttccaaggcaataaggttttacatatatttgttgcggcactgcaaaacgcctcatttgagaagagagaaaaatatggcaagagatagttgtctagcgagagtaactgctggtgttgctataggcggtgcagttggtggcgctgttggtgctgtatatggaacttatgaggctgttaggttcaaggtgcctggacttctgaaaatcagatacattggacaaactactttgggaagtgcagccatttttggactcttcttgggtgctgggagcttgatacactgtggaaagtcttactgagcatatatttgctacctgtgtggaattgaattgttgttatcagaataatgtgcttctgcaatttcaatatatttgagtttagtgatgataattggtgattca

SEQ ID NO: 1094 - DNA, 790 bp, Sorghum bicolor
gcccctttcactaaaaccaggtgaggaatctactaactgcctttcttctcccgtccacccctagtgcgctcgtctctctcggcgacgactgggctaccgccgccgccgccaaacttcgtcgggctcgccggcgacgagctcccaccaggatcagaggaggtggtgatggcgagaggtgacagctgcctggcgcgcgtgggtgccggagttgccatcggtggcgcggtcggcggagccgtcggtgcttgctatggaacttttgaggcattcagatacaagatccctggattgctaaagatcagatacattggacaaaccactgttggcagcgctgcaatttttggtcttttcttgggtgctgggagcttgattcactgtggaaaatcctactagtttgtttccctcctttttctgaacacgactttgtcgatgggcttcagaggaggattcttgattttgagtgctaccctgggtggcttcagtcaaaactattcaatgtctgtacaatttaacagctaatagctcagggttggaaagaacaatcaagttatgccccagtgttggtgtggatggaaatataatccatgttcatctgtacgagaatcgtcaatttcacatatagcgtcttatgttctaatatgattttgtttgaaaaatgtaaggatttcttatggtcatcaataatacttttcttgctagatggatgtaatatcgctcaaaacgtaatggcagctatatgctattgttgaaatgcaaagggcagccggccagggccaaggttgacgcagca

SEQ ID NO: 1095 - DNA, 576 bp, Glycine max
actcagactatttctcccaacaacaaaacacgccactcactcagtgtgcctctcacgccgacttcctatggcaagggacagttgcctcgctcgtgtcaccgccggcgccgctatgggcggcgctgtcggcggcgccgtcggtgctgtgtatggaacatatgaagctattaggtataaggtgcctggactattgaaaattaggcatattggacaaactacacttggaagtgctgctatttttggtcttttcttgggtgctggaagcttgatacattgtgggaaatcatactgaggataaatatcctcccccccccccccccccttacttacagtgatttggtttgctgcccttgtaaagtatgagtagagcagggatttactgttttttcagttttctggatcatggaaaatgtttcatggcactactactatgaaatttctcatttttttccctagacagtactgttgaaatttctttgctggggctttcctacttttgattcctcattttcatctgagacagtgaattgctcttgcaataaaaagggagtgcagatgtgtgtgtgtgtgttgtgt

SEQ ID NO: 1096 - DNA, 1146 bp, Glycine max
gcaactccctaaaacaaagaaggaacacattagttcggtttccactcagactatttctcccaacaacaaaacacgccactcactcagtgtgcctctcacgccgacttcctatggcaagggacagttgcctcgctcgtgtcaccgccggcgccgctatgggcggcgctgtcggcggcgccgtcggtgctgtgtatggaacatatgaagctattaggtataaggtgcctggactattgaaaattaggcatattggacaaactacacttggaagtgctgctatttttggtcttttcttgggtgctggaagcttgatacattgtgggaaatcatactgaggataaatatcctcccccccccccccccccttacttacagtgatttggtttgctgcccttgtaaagtatgagtagagcagggatttactgttttttcagttttctggatcatggaaaatgtttcatggcactactactatgaaatttctcatttttttccctagacagtactgttgaaatttctttgctggggctttcctacttttgattcctcattttcatctgagacagtgaattgctcttgcaataaaaagggagtgcagatgtgtgtgtgtgtgttgtgtttatgtctgtctttaagcactaccctcccacaaaaattactcacacaaacctagttgcagacaaaattattaaaatgctcattgggtaatttatccaaccccatcactatttctggctagaaagtagtataccagtaactattgtgaggtaaaattacatgtaatttacctgctccactttacacatgtactgtaaaggtgtacttacgaaagtataattcatttaaaagatgggatttggattagtttttttttttttttttttttttgaagtcagggatttggattagttggtgcaggagaatgagagaaaaaaaatgaattcattagatctaatttgtgaaactcatttttaattttgattttcgttcttccatcacagtggtagctgcagaattgagccacatagaatcacatgaaagctgcaatcccattctccgtcacttgttttgaaaagtcacataaaagcttcatactgatatgacatgtagaattctattgagttttttttgtactgataatagata

SEQ ID NO: 1097 - DNA, 450 bp, Euphorbia esula
cttcgaattcaaaatccaaaacacttcaattcaattttttccttcagtattaatcggaatggcgagggatagttgccttgctcgtgtaaccgccggtgtcgcagttggtggtgcagtcggcggcgctgttggtgccgtgtatggaacatatgaagcaatcaggtataaggtacctggacttctgaagattaggtatattggacaaacaacactaggtagtgctgcaattttcggtcttttcttgggtgctgggagcttgatacattgtggaaagtcatattgagtattttccaggttttgattgccggtttcgtatgtttgtcagtgttttattggcctcaaaaaacatctgaatgatataattagatttttaccctttgttaaattttgctgttatgtttgaattgctacaattatatgattttttagtgatgtgtttttctttcattt

SEQ ID NO: 1098 - DNA, 557 bp, Tamarix hispida
  misc_feature (15)..(15): n is a, c, g, or t
  misc_feature (20)..(20): n is a, c, g, or t
  misc_feature (31)..(31): n is a, c, g, or t
  misc_feature (81)..(81): n is a, c, g, or t
  misc_feature (83)..(83): n is a, c, g, or t
  misc_feature (95)..(95): n is a, c, g, or t
  misc_feature (291)..(291): n is a, c, g, or t
  misc_feature (368)..(368): n is a, c, g, or t
  misc_feature (376)..(376): n is a, c, g, or t
  misc_feature (389)..(389): n is a, c, g, or t
  misc_feature (394)..(394): n is a, c, g, or t
ggggaaaagactcgngaaanaaaacacgcancaagatagaaagaaagggggaaatagtagtaaagcgatccaaaaacgaantnctctggtggtantccgagacctcctcgtctatagtagaacggaaaactgacatcttcggagatgcagagagatagttgtttggcacgagtgaccgccggcgtagcaatcggtgccggtgtcggcggcgcagtcggtgctgtttatggtacttatgaggccataaggtacaaggttcctgggctcctaaagattaggcacattgggcanactaccgtcggcagtgctgcaatatttggcctctttcttggtgctggaagcttgattcattgtggcaaatcctattnatgttcanttttgactgtaanaacgnctccgggtttttcggtccgaaaacattatgtgccgaaaacagttcgaccatagttattggagcaagattataatcccctctggtctgtgcatggctcattgttcttattggtgtcacaaagcgtagattaatcttgacaaagattccatggtgagtagtgact

SEQ ID NO: 1099 - DNA, 728 bp, Eutrema halophilum
tgttgaacgatggctaaagatagttgtttggccagaatcactgccggagttgccgtcggcggcgcagtaggcggtgctgtaggtgctgtctatggaacttacgaggcgattagattcaaggttcctgggcttatgaagattagattcatagggcaaacaaccttgggcagcgcagcagttttcggtctttttctaggtgcgggcagtttgatacactgtggaaaatcttactgattcccatacattggtttagctctagaagctttaagtttattgccctgcagagtttcctggtgagagatttgtttctttttttaaaaagacattgagctttttgttcaataagtatttgagtaatcgtctcatatgtttctgtccgctttgtgaatcacaatctcttgggttttgatcagtaacagcttcttcttttttttttttttgcctaagatgatctttttaatgaaaagaccatgttacaaggagttctgtttcaaaataaagctgtattaaatagagcatatttttttgtctcaaaaccatatatgcaaaaaaaaagagctttaagtagtggaagtggattgattattgcacatacactcaggaacaggatactttgtaacatctcttccagctttgctaatccttaattctggctgtcctagagattgtctgtgtaatttctttatcatcttcttaaactctgtttcagtcattgatgtgttcaaaaa

SEQ ID NO: 1100 - DNA, 234 bp, Eutrema halophilum
atggcaaaagatagttgtttagccagaatcactgccggagttgctgtcggcggcgcagtaggcggtgctgtaggtgctgtctatggaacttacgaggcgattagattcaaggtccctgggcttatgaagattagattcatagggcaaacaactatcggcagtgcagcagttttcgggctttttctaggtgccggcagtttgatccactgtggaaaatcttattgattcccatac

SEQ ID NO: 1101 - DNA, 393 bp, Nicotiana tabacum
ggagagagagagagagagagagagatggcaaaagatagttgtctagcgagaataactgctggggttgctgtgggcggtgcagttggtggcgctgttggtgctgtttatgggacttatgaggctattagatacagggtgcctggtcttatgaaaatcagatacattggacaaacaactttgggcagtgcagccatttttggtctcttcttgggtgctgggagcttgatacactgtggaaagtcttactaagcatatctttgctagctgcagttaaactttttgattacccgagtcgttatcagactagtgtgcctgtgtaattcctatatttttttgtgtatttcagttaagttatgatgcttgaattggtgattcaaaattgagcttttctct

SEQ ID NO: 1102 - DNA, 585 bp, Triphysaria pusilla
ccgaggtcgagaaagtaaataaaagttttggtttgtatattttggacgagtaacagtcaagagataagatatggcgagagatagctgtctggcacgagttacggcgggagttgccgttggcggcgcagtcggtggcgctgttggggctgtttatgggacttatgaggctataagatacaaggttccagggcttttaaaagtgcgatatattggacagacgacgctaggcagcgccgctgtgtttggacttttcctgggagctggaagcttgatacattgtgggaaatcttactagaaaagcctattttgttccagtttgccgtcgagtaaaattttcaactgggtttgattgaaaaattagttcaacagagtcacagactcacattgctatagatgttattcgttttgcttttctggcccttttttgcatgacttctatgttttgcttttgtgaatccaaaactgctctttcagatggagtgttatgtaaaactattgggttttccgtttcccatttttcatctgattatatctattgtaatttgaatgataccaatgggataataaataattgaaaatccttct

SEQ ID NO: 1103 - DNA, 409 bp, Tripterygium wilfordii
tagaacatttgcatctgaataagaagtattccgacatggcaagagatagttgcttggctcggatcaccgccggcgttgccgtgggcggcgcagttggtggcgctgtcggtgctgtttatgggacttatgaggctatccggtataaggttcctggactgctaaaagtcaggtatattggacaaactacattgggtagtgcagctatttttggtcttttcttgggtgctggaagcttgatacattgtggaaaatcttactgaatgttctttcgatagtactttctggttcataaggttgtattttacataactatgagagaggacaagttttcttctgttcataatcaaaccaagtattttctttttcaattaatttgttgaggtcttactttgaatactttgctaaatta

SEQ ID NO: 1104 - DNA, 621 bp, Citrullus lanatus
gtggtatttttgagatcagaggattcggtgattgttgttgatattcaattcgaagcttaattgctcgaggaataaattttctgtgttttcttcgaggagaatcgctgagtatggcgagagatagctgtttggctcgagttactgccggagttgccgttggtggcgctgtaggcggagccgtcggtgctgtttatgggacctatgaggcaattagatttaaggtgccaggacttttgaaaattaggtatattggacaaacaacacttggaagtgctgccatatttggccttttcttaggtgcagggagtttgatacattgtggaaagtcatattaaagcataagctcctgtatttgggtcagataatattgtttgttttttagatttcttgcttttgaacatgaagttagtgcagcaggtcatttgtttatttaaaaagcttccatttgtggttgttggttaaaaggaacaaagtggtcaattgatggtgatatggcttcaccctactcggatatggattttcaagttttcatgacataaaatatttatgttgatttcgacattttcgatcaaatatttctatcggcggatattttgtaaataaaaaattctagaagttatt

SEQ ID NO: 1105 - DNA, 450 bp, Zostera marina
caccgaagaaaatcgactacaatgggaaataataggaaagatagttgccttgctcgcatcggcgccggagttgctatcggcggtgctgttggaggcgcggttggtgctgtatatgggacttatgaggctttcagatttaaggttccaggattattgaaaatcagacacattgggcaaaccactatcggaagtgccgcaatttttggactttttcttggagcgggaagcttgatacactgtggaaagtcttattgacgagttgggaatagtagtagcaacttgggaagtgcatgagcagcagcagaaggcttagcagcagagagggttggaacttggaatgtccaaatgtgttaattttttaatcttctaaatttgattgtaacaaacttatttaaaaatgttgatgacaaaccttaagagttaataatttttgcttatgccgttaatcgt

SEQ ID NO: 1106 - DNA, 961 bp, Mimulus guttatus
ctatctgatcagtagattttagaaagagaaacagtagagagagagagagatggcgagggatagctgcctgacacgaattgcagcgggcgtcgccgtaggcggcgctgttggcggcgctgtgggtgctgtttatggaacttacgaggccataagatacaaggttccaggtcttatgaaagtacgatatatcggacagacaacgttaggcagtgctgctgtttttggacttttcctgggagctggaagcttaatacattgtggaaaatcttactagtctcttctattttatgaagtaaaacttgcatcgggtttgaacaaatagttgaactgaatcacattgcggtagatgtcactcatattaatctccatacccttttctgcccaagtttttatttttgttatttacgcaacgatctatgagaattattcgagccgggtaataaatattatttggaaatccttcatggatttatactgctaccaatattgaatttgttttttcttgattgagaaaattttgtagcaagtagcatatcttagtacatgtcctttaccatgagaactcgaacaaaacgagatggtaataggttttctaggttacagagcaactagttccttgcagaccaattcagtgttagaattgtttgcatcaagtttcaggacattaaaaatctcagggcatcaattttccagcttctggaaattgaatacaaatgaaatggtctaacataagttcgaaattgatgtcgtgcaattatcaagaatcttggatcgtctgacatcatcatcatcatggcaatcttccttgaggattaagtcaactgtaacaaggtcccatgcaaatggagaggttggttgagaatccaggcttattggtgaagagggaggagactcgaaccaatcggaaaactctgacatggacaactcttccagttccatataagagctgctcgtgctacta

SEQ ID NO: 1107 - DNA, 403 bp, Olea europaea
gtgtgagatagacagagggggagagagatggcaagggatagttgtctagcacgagtgacggcgggggttgcagtcggtggtggtattggtggcgcagttggtgctgtttatggaacttatgaagctattagatacaaggttccaggccttctgaaaataagatatattgggcaaacgacacttggaagtgcagctgtatttggtctcttcttgggagctggaagcttgatacactgtggaaaatcttattgaatctataatttgttttcagtttattaattagttaactttgtgctgcatttaagaaatatttgatgcaaactatatgtatagatgttatgcagacaattttgttatggttttgagcatgcattgtggaaattaaccagatctattgaacacc

SEQ ID NO: 1108 - DNA, 832 bp, Arabidopsis lyrata
aaaaccaatccatcgtgcaagcaaaaacttcgaggttaaaaaccttaaaagcggcgagggcaaccgtaaaaaccattctccgacacaagaaacgaattgtctcaatattaagaagatggcgagagatagctgtttggccaaaatcactgccggagttgccgttggcggcgcacttggcggcgcagtaggtgctgtctatggaacttacgaggcgattagatacagggttcctgggcttatgaaggttagatacattgggcaaactaccctcggcagcgcagcagttttcgggctttttctaggtgcaggcagtttgatacattgtggcaaaggctactgattcccttacattggtttacctctagaagcttttagtttgtatctctcatagtctcttggtgaaagattggattctctttttgaaagatattgacctttttgttgaaataagtattggatgaatcgtttttatatgtttctgcccctctctgtgtgaattttcatctcttatgtttggattctttttgcctaagataatcttgtcaatgaaaagatcatgttacaaggagttttagtttcaagataaaaagcatagaaagtggagcatattatactttcattacagttaatctttgtcttaaaaccatatgttcaaaaaaaagaagctctaaatagtggtgttggattgattgcacatacactcaggaacaggatactttgtaacatctcttccagctttgctaatccttagttctggctgtcctagagattgtctgtgtaatttctttatcatcttctcaaactctgttttagtcattgatgagttcacaaa

SEQ ID NO: 1109 - DNA, 424 bp, Arnica chamissonis
  misc_feature (400)..(400): n is a, c, g, or t
aaaacctcaaaatcccaattcgagacagacatggcaagagatagctgtctagccagaataaccgccggagtcgccgtcggtggtgctgtcggaggcgctgtcggtgctgtatatggaacttatgaggctgttaggtacaaggtccctggacttatgaagatcagatatattggacaaacaacacttggcagtgctgcaatttttggtctttttcttggtgctgggagcttgatacactgtgggaagtcctactgagagagagagagttgtttggatattggaaacaataaaaaccttaggtgaatttggttactctttaagatttggtatgtgctgctcttttttacctgttccttaattatttgaattcctttgatgcatgagtttgaacaagggggtnacatattatttgatgagattggta

SEQ ID NO: 1110 - DNA, 427 bp, Vaccinium corymbosum
aaaatggcaagggatggttgtctggctcgagtgaccgcaggcgtagcagtcggtggtgctgttggaggcgctgtcggtgctgtgtacgggacctatgaggctattaggtacaaggttcctggactgctgaaaatcaggtacatcgggcaaaccactcttggcagtgctgccatttttggtcttttcttgggtgctggcagcttgatacattgtgggaagtcttactaagcttcgcgtttgaattttcatttaagctggttctgttttgtttacaagaatcggttgaaatgagtgattatatgcctgcaaacattctgcacagaaatgcttttttggcaactagccattttcaagatttcgtgatatgctttgtgtctctggctgtacacaggctaggagtgattctttggtgcttctaaacataatt

SEQ ID NO: 1111 - DNA, 443 bp, Bruguiera gymnorhiza
gctctctccaggttcctcccacgacagcacagcagttgcagacacccaaaccaaacgattaaaagaaaaaaaagagagagagagagagcctaaagcctaaacaatggcgcgggatagctgcctgacccgcgtgaccgccggcgttgctgtcggaggtgctgttggcggcgccgttggtgctgtgtatgggacatatgaggcaatcaggtataaggtgccaggacttttgaagatcagatacattggacaaaccacgcttggaagtgctgctatttttggtcttttcttgggtgctggtagtttgatacattgtgggaagtcatattaagtgttatattatgccttagccaaagtaactttgtcctgcttacaaggatttggttgtcagttacttttttgtttatgaacggtatgaatagagcttctgatggccattttggtga

SEQ ID NO: 1112 - DNA, 492 bp, Castanea mollissima
tacaaaagaaaagagaaagttttcattaagctctgtcaatggcaagagatagctgcttggctcgtgtcaccgccggcgttgctgtcggcggcgctgttggcggcgccgttggtgcggtgtatgggacatatgaggctattaggtttaaggtgccaggactaatgaagatcaggtacattggacaaactacactaggcagtgctgctatttttggccttttcttgggtgctggaagtctgatacattgtgggaagtcttattaaacactttttggtaaactaattgtcagtttactaagttcttctttgaacttagatgtcacatgccctgggacagttgaaaagagtgcataatcatgattacttgtttcttctatggcaaaattcttttgtggagttttaagttatttgtctgacaatggttgcacaccatggtataatcagttgaattttctagggtggccttttctttcaatgcagagctcctttcact

SEQ ID NO: 1113 - DNA, 422 bp, Cleome gynandra
caatatctagaaaatctagaaagagaatctctgtattgtccgagtgaaacacgaactgatctgtagatggcgagagatagctgtttggctcgtgtgaccgctggggttgccgtcggcggcgctgtcggcggagctgtcggtgctgtttatggaacatacgaagcaattagatacaaggtcccaggacttctgaaagtgagatacatagggcaaacaacgctcggcagtgctgctattttcgggctcttcctcggtgctggtagcctgatacactgtggaaagtcttactgattgcactctttccctttgtctcataaagcgttagatttttgtgttccatataatctgtggtaccttgcgaaagatatctttgtttctatatgcttttcactttgtctataaatattcttgaatagataaaa

SEQ ID NO: 1114 - DNA, 305 bp, Cleome spinosa
gtccagacaatcgttttgttgccctaagaactcgatttgatctcaacatggcaagagatagctgtttggctcgtgtcaccgcaggtgttgccgtcggcggcgctgtcggaggcgctgtcggtgctgtttatggaacctacgaggcaattagatacaaggtcccaggacttatgaaaataagatatatagggcaaacgacgctgggcagtgcagccattttcgggctctttctcggtgccggcagcttgatacactgtggaaaatcttattgatttccttcttttgctttgtctcacagagtgttg

SEQ ID NO: 1115 - DNA, 378 bp, Taraxacum officinale
ttacagttgtagacgagagatagaaagagagatggcaagggatagctgtctagccagaataaccgccggagtcgccgtgggtggtgctgttggaggcgctgtcggtgctgtatatggaacttatgaggctgttaggtacaaggtcccgggacttatgaagatcagatatattggacaaacaacacttgggagtgctgccatttttggtctttttctgggtgcgggaagcttgatacattgtgggaagtcgtattgagaagatgttcttttgagatttataaacaataaaatgttagttgactttgataacatcttattgttggtgtgcatgattctcttattaactttgaaatcacaagtcaagcacttttatcgtcc

SEQ ID NO: 1116 - DNA, 420 bp, Solanum melongena
cctaatatttcacaacaaaagaatctaaccaaaaggcaggaagtgaatttgagtattgtcttccaagcaataaggtttacaatttgagaagaaagtcagagagaaatggcaagagatagctgtctagccagagtaaccgccggtgttgctgtaggcggcgcagttggtggcgctgttggtgctgtgtatgggacttatgaggctgttaggtacaaggtgcctggacttttgaaaatcagatacattggacaaactacgttgggaagtgcagccatttttggtctcttcttgggtgctggaagcttgatacactgcggaaagtcctactaaacatatctttgaattgaactcatgttatcagaataatgtgcttgtgcaattccaatatatttgagtttagtaatgatagttactgatccg

SEQ ID NO: 1117 - DNA, 439 bp, Euonymus alatus
acgccgcatagaggaatttgagactaaaaataaacggagaggatcgacatggcaagagatagctgcttggctcggatcaccgccggcgttgccttgggaggcgcagttggaggcgctgtaggtgctgtttatgggacttatgaggctatcaggtataaggttcctgggatgctaaaagttaggtatattgggcaaacgacaatgggcagcgcagctatttttggtcttttcttgggtgctgggagcttaatacattgtggaaaatcttactgaatgctcttttgaattttgatagcacttcttggttcgtaaggttgtattttacattactaactatgagagaagacaagttttcttctgctcataaccaaaccgagtattgtttttttcttttcgattttgtttttaaacttgcgacggtcttgctttgattgcattg

SEQ ID NO: 1118 - DNA, 435 bp, Fagopyrum esculentum
gaggggagagaacaaaggctcgtgaagaaatggcaagagacagctgcttggcaagagtgggtgccggcgttgccctcggtggcgctcttggcggcgccgtcggtgctgtgtatgggacttatgaagcagtgaggtttaaggttccaggacttctgaagatcaggtacatcggccagacaacgctaggcagtgctgcagtatttggtgtctttctcggcgcggggagcttaatacattgtggaaaatcctactgattaatctgaaccctgttccatttttgcaatggttttctgttatccttcacttttttctgtaataatattttgttgataccttgatttatctttagaagaatgataattttgatttgatagcccaatcataaaaatatgttcagatggactcttatgttcttgtctctccgtatgcattaat

SEQ ID NO: 1119 - DNA, 385 bp, Fagopyrum esculentum
ttgtgagaaatggcaagggacagctgcttggcaagagtgggtgccggcgttgctctcggtggcgctcttggcggcgccgtcggtgctgtgtatgggacttatgaagcagtgaggtttaaggttccaggacttctgaagattaggtacatcggccagacaacgttaggaagtgctgcggtgtttggtgtctttctcggtgccgggagcttgatacattgtggaaaatcctactgattaatcttcaccctcttccatttttgcaatgattttctattatccttcacttttctgtaataatattttgttaaaaccttgatttacctttacaagaatggtagttttgataggccaatcataaaatatgttcagatggactctttatgtt

SEQ ID NO: 1120 - DNA, 352 bp, Linum usitatissimum
taaaaatggcaagggatggttgtctggctcgagtgaccgcaggcgtagcagtcggtggtgctgttggaggcgctgtcggtgctgtgtacgggacctatgaggctattaggtacaaggttcctggactgctgaaaatcaggtacatcgggcaaaccactcttggcagtgctgccatttttggtcttttcttgggtgctggcagcttgatacattgtgggaagtcttactaagcttcgcgtttgaattttcatttaagctggttctgttttgtttacaagaatcggttgaaatgagtgattatatgcctgcaaacattctgcacagaaatgcttttttggcaactagccatttt

SEQ ID NO: 1121 - DNA, 534 bp, Fraxinus spp
ggaacaaccgcctaattcggctcagaaactttttgtccgccctaacttaagccctcattcttactcctctgttgaacaaattactccagcacccagattttgtgtgagatatacagaggggagagagatggcaagggatagttgtctagcacgagtgacggcgggggttgccctcggcggtggtatcggcggcgctgtcggtgctgtttacggaacttatgaagctattagatacaaggttccaggccttctgaaaattagatatattgggcaaacgacccttggaagtgctgccgtatttggtcttttcttgggagcaggaagcttgatacactgtggaaaatcttattaaatccataatttgttttcagtttattaattagttgactttgttctgcattttaaaaaaatttgatgcaaacgatgtgtatagatgttgagcagatggtattgagcatgcagtgtgggagttaaccagatatattgaaaaccacttctttgtgcttgaactgtggtctggttgatagctggaca

SEQ ID NO: 1122 - DNA, 1161 bp, Gossypium raimondii
actcttcatttttttctttatcattgtcacctcaaattagattccattaggtcaatccgaccggaagcaaataatacgtggtagatactgacatggcaagagacagctgtttggctcgcgtcactgccggcgttgccgtcggaggagctgttggcggcgccgttggtgctgtttacggtacttatgaggctattagatacaaggtcccgggacttctcaagattagatatattgggcaaacaactctcggtagtgctgcgattttcggtctttttttgggtgctggaagcttgatacattgtgggaaatcacactgactattctttgtttgccttataaccttgagattatattctttggatgatgctagcatagtttttagatggaaggtgtaaaatgcttttgcgtaacctttggttttgttttttttcagtttccatgaatcttgccctagagtgggtgaaaatttgaaaatcaattacttcaatgtcacaaattttcgcttttgggtttcgttttttccccttaaagaaaacccccactcattgttaaaaaagaactcactcatagcagagatgagtgcattttattgacctttacttttgtcactgtcatccacattgaaatttagaaaccacgtctcgatttgctccgatgtccacgttgagctttaggagaccatgtctcggtttgctaagacgtgcagggctattatcagtgccaaaactcatccgcaggagatgtctcttctggaaaaatgtttggccttgatcaatttctatcaaagagagcatgagtttgccattaagcgccacataaaagaaaagagctttccttttcaacatcgaactttcatccagatgttctctttgctatcattgtgggagcccaaagtagattggaatctatcttgggacatatgaacccttaaatttttccttctttaaggcttgatctttgccaaagaaaagagatgttttgtccacatttaccaaaacactatggtacaactcaagatatgattagtttttgtttatacgtgaaaatgatgcatttaaagaccctagtgactgatgacaggggtgacgctagcggcagatgtcatagtccactcgtgagcaggccatccaaaggtgtggagtaggtccctagtgcattaga

SEQ ID NO: 1123 - DNA, 501 bp, Carpinus betulus
aactgtcaatggcaagggatagctgcttagcccgtgtcggcgccggcgttgctatcggtggcgctattggtagcgccgtcggtgctgtgtatggcacatatgaagctattaggtttaaggtaccgggacttatgaagatcaggcatattggacgaactacactaggcagcgcggctctttttggtctcttcttgggtgctggaagcctgatacactgcgggaagtcttattaagcacttttttttggggaaattaattttgcctgtctattaagttctgctttgaactctgatgtcataagtgtgcaaagagtgcataatcatatgattacttgtttcaaaggctaaacttttctcgtgctgttgttttcattggtcgtaggaacatcttcatggcaattttgccttagcattatcatgaaattttctttgtaatttatctctctgacagtggttgcatagtatgatcattggaattttctttcaatgcgacttactttaa

SEQ ID NO: 1124 - DNA, 576 bp, Lactuca sativa
gaaaaaaaaaataggaacaaaaaaacaggttggtgtcaaccctcgtatataaaatctgtttctgaaagtctaaacctaaagcttctcttccttgtcttcacaccttcatttaccaatcgcacttctagacgagagagatagaaagagagatggcaagggacagctgcctagctagaataaccgccggagtcgccgtgggtggtgctgttggaggcgctgtcggtgctgtttatggaacttatgaagctgttaggtacaaggttccgggacttatgaagatcagatatattggacaaacaacactcgggagtgcagccatttttggtctttttcttggggctgggagcttgatacattgtgggaagtcgtattgagaagagttcttttgatatttgaaaataataaatattagttgcgactttgataaaatcttattgctcatgtgcacattctcttattaactttgaaattaaaagtcaagcacttttattgcttttttttttttatctgtatgaccaaagtttggatgagtttgaagagcattgcattgacatggagtttagtttgtttttgata

SEQ ID NO: 1125 - DNA, 528 bp, Lotus japonicus
gagagttcagtaccgaacaagacatacagtgccgcacacaaaatccaacttggaaattccaatggctagggacagttgcctcactcgtatcgccgccggtgccgccataggcggtgctgtcggcggcgccgtcggtgccgtgtatggaacatatgaggcaattaagtataaggtacctggatttttgaaaatcaggcatattggacaaactacgcttggaagtgctgctatttttggtcttttcttgggtgctggaagcttgatacattgtgggaaatcatactgagctcataaagatttgtcttcctccctccttgccgagatttgctcgctgcccttttaatgtatgagtagagcagggatttacttatttggttttctggatcttggaaaaggtttaatggcagtggcactgctcctttgttaagaaatttctcatttattttctccctggactgcactatgaaattagtttgcaagggttttccttttactttaattcatcattttgcgagttgctcttgcaat

SEQ ID NO: 1126 - DNA, 434 bp, Medicago truncatula
aagacacaaaatcgcaatggccagagacagttgcctcgctcgtgtcactgccggcgctgccgtgggcggcgctgtcggcggtgccgtcggtgctgtgtatggaacgtacgaggctattaggtataaggtacctggatttttgaaaattaggcatattggacaaacaacccttggaagtgctgctatttttggtcttttcttgggtgctggaagcttgatacattgtgggaaatcatactgaacccataaagattttatctacctacctgcagaggttttctttctgcccttgtaaagtatgagtatagcagaaattttgtatttattattgtgtttctgggtcttggaaaagtttaatgactatgttgctgctatttttgtatgaattttctcaattatttctccctcaacagtactgttaaaaaaaaaaaaaa

SEQ ID NO: 1127 - DNA, 586 bp, Mimulus guttatus
gccaaagcttttgctgtttatataagcgccccttcaagttttgctcaagagcaacagaataaacaaaaattactatctgatcagtagattttagaaagagaaacagtagagagagagagagatggcgagggatagctgcctgacacgaattgcagcgggcgtcgccgtaggcggcgctgttggcggcgctgtgggtgctgtttatggaacttacgaggccataagatacaaggttccaggtcttatgaaagtacgatatatcggacagacaacgttaggcagtgctgctgtttttggacttttcctgggagctggaagcttaatacattgtggaaaatcttactagtctcttctattttatgaagtaaaacttgcatcgggtttgaacaaatagttgaactgaatcacattgcggtagatgtcactcatattaatctccatacccttttctgcccaagtttttatttttgttatttacgcaacgatctatgagaattattcgagccgggtaataaatattatttggaaatccttcatggatttatactgctaccaatattgaatttgttttttcttgattgagaaa

SEQ ID NO: 1128 - DNA, 699 bp, Tropaeolum majus
cggccgggggtaattaaatcggatcattgacgattctattttttcaataaccgatagtaggtttcgtttgttccttgagaactaaagaccaagacatacacaacaatttagcacacacacgttgtgaaccgcagcctttaacgaaagagaatctgatatggccagagatagctgcttggctcgcatcactgccggcgtagctgttggaggagcagtcggcggcgctgttggtgctgtatatgggacttatgaagctatcagatataaggtaccaggatttcacaagattagatatatcggacagacaacgctgggtagtgcagctatttttggtctttttcttggtgctgggagcttgatacattgcgggaagtcgtactgaaagcaatttttgtattgttttatataaccgtaagaatcaagattaagtgtttactgcttctttagccagatattaattttgcatttagacttatagcagaatcggttccttgtttcttcggaatatacagtctttctcgcagtgtgtgtttgtttgaagcctatgctattgcagcatgtcttgaagtagtctctctttaggtcaggtatgagcccaacattgctgaaatgatgtaatcactgagttatttttggttataaatccatttcctcccatcccaagaaagataaagagatttaaatgtagatattggttag

SEQ ID NO: 1129 - DNA, 524 bp, Quercus alba
actaaaaataaaaaaacaccaaaccgaacaacaaaatacaaaagaaagagaaagttttcattaagccctgtcaatggcaagagatagctgcttggctcgtgtcacagccggcgttgctgtcggcggcgctgttggcggcgccgttggtgcggtgtatgggacatatgaggctattaggattaaggtgccaggactaatgaagatcaggtacattggacaaactacgcttggcagtgctgctatttttggccttttcttgggtgctggaagtctgatacattgtgggaagtcttattaaacactttttggtaaactaattgtctgtttactaagttcttctttgaacttagatgtcacatgccctgggacagttgaaaagagtgcataatcatgattacttgtttcttctatggcaaaattcttttgtggagttgtaagttatttgtctgacaatgggtgcacaccatggtataatcagttgaattttctagtgtggccttttctttcaatgcagagctcctttc

SEQ ID NO: 1130 - DNA, 607 bp, Orobanche aegyptiaca
aggaatagttttaatttgtagatactggacgagaaacagtacaaagagaaaagaagatatggcgagggatagctgtctcgcacgagttacggcagggttcgccgtcggcggtgcagtcggcggcgctgtgggtgctgtttatggaacgtacgaggctataagatacaaggttccaggacttctaaaagtacgatatattggacagacaacactaggtagtgccgctgtgtttggacttttcctgggagctggaagcttgatacattgtgggaaatcttattaggctctctttttattccaattctgtcattgagtaaaacttgcagttgggtttcagaaaagtagttgcactgaatcacattgctatagatgttatttattgtacttttcgtggccttctattcataagttcttaagtttaagtttattgcttttggaaatctttcttgcttttgtctgtcttttcttcatcttagtatgtcttgtaatttgcaagatgatttatgaaaatgatcctatcaggaaaaagaacaattggaaattctgagggcttgttaggactagaattcattggatctagaattatggtatgcaaaatcttgttatt

SEQ ID NO: 1131 - DNA, 661 bp, Carica papaya
gttgacacacaatatacagctttatattgtgtctgagctcttgtgcatatcttcaaatcacgatctcccaatcaatcatggcaagggacagttgccttgctcgtgtgacagccggcgttgccgtcggcggtgcagttggtggtgctgttggtgctgtctacgggacatatgaggccattaggtataaggtgccaggacttctgaaggtcaggtatattggacaaaccacactgggtagtgctgcaatttttggtcttttcttgggtgctggaagtttgatacattgtggaaaatcatattagcttcttgttcttgtattcattacattagtaattttatgtttgagctatatgagtagccttgtgtcaaggctggcaacgacacgtagtagctgagtgtcattgactcgcctaggtgtcaaaaacagaaactgaatggagatacttgttttgggatctatagttttgtttcttctgtatttgctactactataaatcttttgccatcagttatctgtatcgttcgttctgtttccttttgttatgcattaccgagtttattggttaagatgccatatgctgaggaaatttcaattgtgactggcctgtttatacttgaatgttggaattcaactagttgaataagcacctcagtttctcct

SEQ ID NO: 1132 - DNA, 592 bp, Plantago ovata
gtatttagtacactatttgaagtcaattaattctcagaattctgaaaattaaaaaaacaaaaaaattagtgcaaaaaggagtgaattcattcatcatcacacacaggcgcaaaaccaaaaccatcatctgatatggcaaaagacggctgtctagcgcgaatcaccgccggtgtcgctgtcggcggcgctgttggcggagcagtcggtgctgtttacggaacttatgaggctataagattcaaggttccgggtcttctcaaagtacgatatattggtcaaacaacattgggaagtgctgcggtttttggattatttctgggagctggaagcttgatacattgtggcaaatcttattgaagtttagttacacttggttgttgtttaaatgaccatcctgttctgcttcggaaatagtttagcggaggaatgtggcttcaccttaaaatcatgttacttttattatctttttcttggcacttgtccagttatggttattctgtttttcggagattcaattaagctttcagatacagaatctatgaaacgtgaataatgacgtcaaatttgtgcaatatttgtacattttctggag

SEQ ID NO: 1133 - DNA, 691 bp, Populus trichocarpa
gaagagaccgtaaaaaacaagtcactcaccactgcttacacaaaacttgacaaacgtcgattaggtttcaaacatcggtcaatcaaattcttgcataaactaaaacactcgcaatcccgaaatggcgagggatagttgtctggctcgtataactgccggcgttgctgttggaggtgctattggtggcgccgtgggtgctgtttatggaacatatgaggcagtaaggtataaggtacctggacttttgaagatcagatacattggacaaaccacacttggtagtgctgccatctttggtcttttcctgggtgctgggagcttgatacattgtgggaaatcatattgatttattctattcagagcatcaagatatcaactttgttctgctcacaaggatctgtgcttcaacttcacttgcctttgagctgaaggatagaacttgtggtagcgattagttgtttctttcaacataaaatttcctatgatgttatggctttcagaaacagcttagcagcaattagccttgcgaaatttcttggttattgtcactttcacagttctcgggctccttgatggttgcctctttttttttttttttgcctctctcatagtagtagtcttttctttagatgtaaaactttatctatgccatttccattgccaatccataatttgatttacatggccaaaa

SEQ ID NO: 1134 - DNA, 717 bp, Populus trichocarpa
gaagagaccgtaaaaaacaagtcactcaccactgcttacacaaaacttgacaaacgtcgataaggtttcaaacatctgtcaatcaaattcttgcataaactaaaacactcgcaatcccgaaatggcgagggatagttgtctggctcgtataactgccggcgttgctgttggaggtgctattgggggcgccgtgggtgctgtttatggaacatatgaggcagtaaggtataaggtacctggacttttgaagatcagatacattggacaaaccacacttggtagtgctgccatctttggtcttttcctgggtgctgggagcttgatacattgtgggaaatcatattgatttattctattcagagcatcaagatatcaactttgttctgctcacaaggatctgtgcttcaacttcacttgcctttgagctgaaggatagaacttgtggtagcgattagttgtttctttctacataaaatttcctatgatgttatggctttcagaaacagcttagcagcaattagccttgtgaaatttcttggttattgtcactttcacagttctcgggctccttgatggttgcctctttttttttttttttgcctctctcttagtagtagtctgttctttagatgtaaaactttatctatgccatttccattgccaatccataatttgatttacatggccaaaagctgtattagcactcgtctgtatagt

SEQ ID NO: 1135 - DNA, 505 bp, Sarracenia psittacina
agaaggacgaagtcggtagtcgaacgacgagagggcgggaggagagagagcgagcgaaagcgaagaggcaatggcaagggatagctgtactgctcgtgtcaccgcaggcgtagcagtcggcggtgccgttggtggtgctgtcggtgctgtgtatgggacttatgaggctattaggtacaaggttcctggacttctgaaaatcaggtacattggacaaacaacgcttgggagtgctgccatttttggtcttttcttgggtgctggcagcttgatacattgtgggaagtcttactaagctttttgcatttgaacaattgaacttaccaaataatatggtattgtgttttgtttacaagatttttttgacttgtcaaatgcctgtagacaattttcatataaatggttttatgatatcgggtaattttcttctatttcaaaatatattattagcatcacaaaattacaatagtaaggaaacaaatcttagcaaacgtgtataattcta

SEQ ID NO: 1136 - DNA, 320 bp, Scabiosa columbaria
aagtctctgggccgcataccgagtgctttatactttcgccattaaaacataacccaacctccatttttaagctatacagagagtgaaatagatagatatggcaagggatagctgcttggcaagaattaccgctggtgttgccgtcggtggtgccgttggaggcgccgttggtgctgtttatgggacatatgaggctgttaggtacaaggtgcccggtcttatgaaaataagatatattggacagaccacacttggaagtgctgcaatatttggactttttctgggtgcaggtagcttgatacactgtgggaagtcatatt

SEQ ID NO: 1137 - DNA, 747 bp, Silene vulgaris
gcagaagattgtacaaaaaggttttagaagataccaaaagaaccaaggaaaagcaagctaggaaagagactaaacactggtagccgaagaagtaagtaaacggacaaagaaattggcttttgcaacaagaaagtcggccccaaataacaagttagatagaagtggtggtatatatatttgccctaataatacaacattgcggtggcagttgaagaattgttgaatcatcaaagaaacaacaagcttgattaatggctagagacagttgccttgctcgagtcggcgccggtgttgctgtcggtggtgctgttggcggcgccgtcggtgctgtttatgggacttacgaagcagtgaggtccaagattccaggattactgaagatcaggtacattgggcaaacaactgttggaagtgcagcaatattcgggctctttcttgggtgtggtagcttaatccattgcggaaaatcttactgattacttgtgttgccctgcagttgcctttatatgagattttcctaaaaagactagtggtgacattggagatttccctagatatcatgtcaataattttgattctgtactagtactatcgtttctcaaattttaagttccttttagtttagttcattttctttcttttattttctctatgctgaagatggtttttcctaccctactttatttcggttattgcattgactgaatcgctcgtcacatggtttattgtgatacaaattttgatgtc

SEQ ID NO: 1138 - DNA, 646 bp, Glycine max
gaagcaacaaattggttcggttttcactttcagactctcttttttctcctaacaacaaaacacgtcactcgcagtgtgcctctcacgccgacttcctatggcaagggatagctgcctcactcgtgtcaccgccggcgccgctatgggcggcgctgtcggcggcgccgtcggtgctgtgtatggaacatatgaagctattaggtacaaggtgcctggactattgaaaattaggcatattggacaaactacacttggaagtgctgctatttttggtcttttcttgggtgctggaagcttgatacattgtgggaaatcatactgaggataaagatttgtcctcccccctacttacagtgctttggttgctacacttgtaaagtatgagtagagcagggattttctgcttttttggttttctggatcatggaaaaggttttatggcactactcctatgaaattttgcatttatttctcccaagacattattactgttgaaatttctttgctggggctttccttctacttttttgattcctcattttcttccgagacagtgaattgctcttgcaataaaaaggagtgcagatgtgtgtgtttacagtgttgtgtttatgtcactgtctttaagcactcccctcccacaaaa

SEQ ID NO: 1139 - DNA, 732 bp, Glycine max
cccaaaacaaactagagttaggctagggatagtaaaacgcagaagcaacaaattggttcggttttcactttcagactctcttttttctcctaacaacaaaacacgtcactcgcagtgtgcctctcacgccgacttcctatggcaagggatagctgcctcactcgtgtcaccgccggcgccgctatgggcggcgctgtcggcggcgccgtcggtgctgtgtatggaacatatgaagctattaggtacaaggtgcctggactattgaaaattaggcatattggacaaactacacttggaagtgctgctatttttggtcttttcttgggtgctggaagcttgatacattgtgggaaatcatactgaggataaagatttgtcctcccccctacttacagtgctttggttgctacacttgtaaagtatgagtagagcagggattttctgcttttttggttttctggatcatggaaaaggttttatggcactactcctatgaaattttgcatttatttctcccaagacattattactgttgaaatttctttgctggggctttccttctacttttttgattcctcattttcttccgagacagtgaattgctcttgcaataaaaaggagtgcagatgtgtgtgtttacagtgttgtgtttatgtcactgtctttaagcactcccctcccacaaaaattactgactcaaacctagttccagactcatttattaaaatgccc

SEQ ID NO: 1140 - DNA, 543 bp, Primula obconica
cagccgataattctccagagaattagggctttgacagagagagagagagagagagagaatgggaagggacagttgtttgactcgtgtgactgccggtgtcgccgtcggcggtgctgttggtggagctgttggtgctgtgtatgggacctatgaggctatcagatacaaggttcctggtttattgaaaatcaggcacatcggacaaactacgctgggtagcgcagcttattttcggtctcttcttgggtgctggtagcttgatacactgtgggaagtcttattaaagttatttgtacttgcgaatgttttgtttaataaaatctttgtgttccgttgaagacactcttcttttttcatatttgtcttttccttatcccttttctttcttatctctctctatggttgcggcttgagaaagtctgaaggttattgctgtttgttatggttataagacacaaattttgattcatttcgacttttgaaacctctctttttacctttatgtccagtttggacccttcttttacggagtactaggaagcg

SEQ ID NO: 1141 - DNA, 351 bp, Ambrosia trifida
ccgcaacacacacacacaccccttaattaattaattaatcaatcaatcaagagagatggcaagagacagctgtctagccagagttaccgccggagtcgccgtcggcggtgctgttggaggcgccgtcggtgctgtatatggaacttatgaggctgttaggttcaaggtccctggacttatgaagatcagatatattggacaaacaacacttggtagtgctgcaatttttggccttttttcttggcgctgggagcttgatacactgtgggaagtcctactgatagagttagagtttgcttggataatttaaaacaataaaagtaagcttaaggggaatctggtttcctttag

SEQ ID NO: 1142 - DNA, 354 bp, Gossypium hirsutum
cattaggtcaatccgaccggaagcaaataatacgtggtagatactgacatggcaagagacagctgtttggctcgcgtcactgccggcgttgccgtcggaggagctgttggcggcgccgttggtgctgtttacggtacttatgaggctattagatacaaggtcccgggacttctcaagattagatatattgggcaaacaactctcggtagtgctgcgattttcggccttttttgggtgctggaagcttgatacattgtgggaaatcacactgactattctttgtttgccttataaccttgagattatattctttggatgatgctagcatagtttttagatggaaggtgtaaaatg

SEQ ID NO: 1143 - DNA, 413 bp, Panax ginseng
taacaagagtaaccggaaaagcaatacactgctcagagatggcaagggatagttgtctcgcccgaataacccccggagttgcagttggcggcgctgtaggtggcgctgttggtgctgtatatgggacatatgaggtcgttagatacaaggtcccaggctcctgaaaattaggcacattggacaaacaacgcttggaagtgctgccctttttggtctttttctgggtgctgggagtttgatacactgtggaaagtcttattaggcattgttttattttaacaaaataaagctaatctgtgtgttcaagaatgggttgacctgacacatatatgcctactgatgaatggtatgagcatattttgttttgagtcttcgattgagcttatctttgttatcaagcaactcgattttct

SEQ ID NO: 1144 - DNA, 537 bp, Antirrhinum majus
  misc_feature (525)..(525): n is a, c, g, or t
aaaagctttactgtaaaataaaatcagagagcaaatcgcagagtgaaaaagagaagaagagatggcgagagacagctgtctggcacgtgtcgcggcgggctgcgcagtaggcggcgctcttggcggcgctgtgggtgctgtttatggaacttatgaggctgtaaggttcaaggttccaggtcttctaaagatacgatatattggacaaacgacacttggcagtgctgctgtttttggactattcctgggcgctggaagcttaatacattgtggaaagtcttattaggcatttccgtttcagtttgccattgacacctttgcgttgtggatagttgatctgaatgacgtgcttatagatatatattttcttgagttttctgcttaatttcttgtcttcctgtgaggctgtgaatccaaatccgctttgctcccagatggagcattgttaaaaaacttgctgtcctgtgggtgagcaatttttattaatattctgaacttaccagtatttcaatcagtttattaagntattttcgaatc

SEQ ID NO: 1145 - DNA, 588 bp, Beta vulgaris
acacaaactaaaacccttagaaccagttgaacctacgcatttgtgagagaagaagaccttagaccttgcagaataagagaaaaagagatggctagagatagctgcttggctagagttggcgccggtgttgctgtcggcggtgctgtcggaggtgccgtcggtgctgtttacgggacttatgaagctgtacgatgcaagattccaggactgctaaagctcaggtacattggccagacaactgtcggcagtgctgcaatatttggtctctttctgggttgtggaagcttgatacattgtggaaaatcgtattgattgtttgtgtctagttttcttcgagttaatcttcctggaactttcaagagacgtagtttatgactggtatcctgctccaagatagcgttttgtttgtttgtttgttttgggtgtcactattaacagtgggatattcgttgaatggctgaattaatgggaaatacaaaattgcgcaataaattttatacttctatcttgaatttatacattgtggaaaaagatcttgccaggttatttcatactatgtatcttccaagatagaagtataaaatttat

SEQ ID NO: 1146 - DNA, 922 bp, Theobroma cacao
atttatttatttaaattttaaatactttaaaattttatttaaatattatgtttttttgcttttacatatattttatggataaattttgtttttataaaggtttaaactgttaatttttaataaaattataaaatatctgtaaatataaaaattaaattaatttttaaaattaaaaatattttgataattttattgagtgaaattcataatgttatatgacaacaaatttatctgtcaaaaattattaatcgatctaatattagtaaaaaataaaaaataaataaacagaaaatataagtaaattttatccttaaattttatatatatctgtttaaaaaatgacgtttaagtttttttgagtacatataaatatttgaccttaaaaaaaaacccaaaactatttaaaaagtaaaagcacttgacaaaattcatacaaaacaaagcccaaccgaactcacaaaacctaagagaacttaacttaacgaagaacaaggaagacctgatactgacatggcaagagacagctgcttggctcgcgtcactgccggtgccgccgtcggaggtgctgttggcggtgccgtcggtgctgtttatgggacttatgaggctattagatataaggttccaggaatgctgaagattagatatattgggcagaccactctaggcagcgcagcaatttttggtcttttcttgggcgccgggagcttgattcattgtgggaagtcatattaacgattctttagttgtgtttaaaccctgagattgtattctcaggatggtgttagctttagaaaggtgtataacagtttataagcctcggttttttctttgagtttctgtctctctagccttggtgtgggtgaaaatttgaaaatatatgacttcaatttgagaatgtgacataaaattttttttcttt

SEQ ID NO: 1147 - DNA, 675 bp, Catharanthus roseus
ggagaacaaaactgtgggttcttcttcctaaattctaacctttgagagcacctcagtgttgttgaagtcgaagatatttatctcttcaaaaaaactcagcttgagaaagggaagatcagatacatggcgagggatagctgtttaaacagagttttggccggtgtcgcagtcggcggcgccgttggtggggctgttggtgctgtttatggaacttatgaggctgtgaggttcaaggttcctgggcttttgaaaattagatatattggacaaaccactctgggcagcgctgccatttttggtcttttcttgggcgctggaagcttgatacactgtgggaaatcatattgattttgctcgcatctagcttgaagtaaattttgttgtttcttagaatccttgatgttaaacgtgaaactaagaattaataagcatggaacatttgtattgttggtgaaagttgcattatgtttatttggtttttctaggcttattttctctgaagcctgatttttctttatatagagttagccttgttgtcgttgctggtggtgaatgttggtcagctgaaaaacaatatcaatatcgcggagttctagcttggcgtttggctatataaatataatccttatctgtgcttaagagaaatgactgtttaagaggtgaaacagtttgtgc

SEQ ID NO: 1148 - DNA, 469 bp, Chelidonium majus
gaaagagaaaaggcgtggaaagcaaaccagagaagagaaagatagtctctgaggagtaagaaaagaagacaaatatggcgagagatagctgccttgctcgtgtcacaacaggtgttgctgtcggaggtgctgttggtggcgctgtcggagctgtttatgggacttatgaggcggtcaggtacaaggtaccaggattattaaagattaggtacattgggcaaacgacactggggagtgctgctatttttggccttttcttgggagctgggagcttaatacactgtggcaagtcctactgagaacccattttgtttcatttttatgtcaaataagtttgtttgttgatgtgaacagtagtgtcagaaggatcggtttactcgctagacaaaaaacttccaatattgacattatagtgtttgagagtaatatttctattcctaggtttcatcatttacatgctttttgtgcg

SEQ ID NO: 1149 - DNA, 575 bp, Citrus clementina
attttgatttaaccggcgcaaaggggaaaacccaagcatttgctcttccaagtaaacaaagggacaagagtcagttttatggcgagagaaaccagttgtctggctcgtgtaaccaccggcgttgctgtcggcggcgccgttggtggtgctgttggtgctgtgtacggaacatacgaggcaattaggtataaggtaccgggacttctgaagattagatatatcggacaaaccacacttggcagtgctgctatttttggtcttttcttgggtgctgggagcttaatacactgtggaaagtcatattgagcagcttggtgtatcaagtaaaaaaaattttttctccccagcttagaattatttgcctttgactcagaagtcttgtttgtatgagtagaatatcatgaatattggtcttttgtggtcatcttggctttctggatgctttatacaatttcatagaaattaaccttcttatttggtgaaattctatgttgtgatgtttaactgtggtgattataactaggggttgtatccgcttgtcaacttgatgtgaaatgtaacttaagatgttctga

SEQ ID NO: 1150 - DNA, 559 bp, Vigna unguiculata
ggaagaggttattttctcccaaaaccctctctagtgtctacctcggacttcaaatggcaagggacagttgcctcactcgtgtcgtagctggcgccgctatgggtggtgctgtgggcggcgctgtcggtgctgtgtatggaacatatgaggctattaggtataaggtgcctggactaatgaaaattaggcatattggacaaactacacttggaagtgctgctatttttggtcttttcttgggtgctggaagcttgatacattgtggaaaatcatattgaggataaagatttgacctttcccctacatacatttctttggttgctgcccttataaagtatgagtagaccagggatttcctgtttttttgttactagtagtattattttctggatcatggaaaaggtttcatggcactactcccatgaaaattcccatttgtttatctctgagctgtactgttgaaatttctttactagggctctcctacttttgattcctcactttcatctgagacggtgaattgctcttgcaataaaaaaggagtgaagatgtgtgggtt

SEQ ID NO: 1151 - DNA, 435 bp, Curcuma longa
cgtagacgctgaagaaatggggagagacagctgcttggcgcgcgtcacggccggagtggcgataggcggatcgatcggcggcgcagtcggcgcagtttacggcacatatgaagctatcagatacaaggttccaggactgttgaagataagatatattgggcaaaccacccttggaagtgctgcagtttttggtctcttcatgggagctgggagcttgatacattgtggaaaatcatactgactggttgtttgagaagcttagcattcatagttctgttgcactcgaacaaatcgtttcctatgcaaatgtttctggtaaagcaaattgtcatattttaatttgactcaaatttgacatcagaatcatgtactcattcaataattgagtggaagtctcatttttttgtgcactcatcacattgcggtgagatgttt

SEQ ID NO: 1152 - DNA, 434 bp, Epimedium sagittatum
ttagaaagacgacgaaaagaagttaagattaacaagaagaaagaggtgttttgatatggcgagagatagctgtcttgctcgggtaaccacaggagttgctgttggtggagctgttggtggcgctgttggtgctgtgtatgggacttatgaggccattagatacaaggttccgggactactgaagattaggtatgtagggcagaccacccttggtagcgcagccatttttggtcttttcttgggagctgggagcttaatacattgtggaaagtcatattgagtgcttatttaagtgtttggtgggtagtcatattgaatgctttgattaggtgttttgtaacaaataaatgtttattcgtagtatagccaagtgaagagcatgccttttctctttgatactctacttgtattaactttttttggtgctcaaggag

SEQ ID NO: 1153 - DNA, 577 bp, Flaveria ramosissima
cctaacctaacctaagcttgttcgctgtctccacctcgaatcagaattgacgagagacatggcaagagatagctgtctagccagagtaaccgccggagtcgccgtcggtggtgctgtcggaggcgctgtcggagctgtatatggaacttatgaggctgttaggtacaaggttcctggacttatgaaaatcagatatattggacaaacaacacttggtagtgctgccatttttggtctttttcttggtgctgggagcttgatacattgtgggaagtcctactgaaagagagagagagagagttgtttaaataaaaccttaggtgaatttggttacttgttttttagtaatttctgttggggaagcaaaatgacatgcaattgtgcagtcatctcattttatatttggtatttgcttactctttaactcttctttattgtttaaaagtctcttatgcatgtgtttgggtctgtcacttatggccatcaccaacaagctgggtagatgctggttatgagattatctgatgaattcagtattggtattattttacatttgtaattattacttagaaaccta

SEQ ID NO: 1154 - DNA, 522 bp, Flaveria ramosissima
ccttgttcgttgtctccacaagtttcagacctcgctcgtgtcacaattgacgagagacatggcaagagatagctgtctagccagagtaaccgccggagtcgccgtcggtggtgctgtcggaggcgctgtcggagctgtatatggaacttatgaggctgttaggtacaaggtccctggacttatgaaaatcagatatattggacaaacaacacttggtagtgctgccatttttggtctttttcttggtgctgggagcttgatacattgtgggaagtcctattgaaagagagagagagttgtttaataaaaccttaggtgaatttggttacttgttttttagaatttctgttggggaagcaaaatgacatgcaattgtgcagtcatctcattttatatttggtatgtgctactctttaattcttcttttattgtttaaaagtctcttatgcatgtgtttgggtctgtcacttatggccatcaccaacaagcggggtagatgctggttatgagattatctgatga

SEQ ID NO: 1155 - DNA, 572 bp, Linum usitatissimum
ctctttacgccccatttgcagtacgggctgcactctcagtttgtgaacctcgactggatgcaggtattctggcctgaactctcttgccctaaagcggtgttgaagttgaattgatcggagcatcattggttgcgggagattgaagaagcatcgattttcttgaagatagctaggctgtatcctctcacggaatggcgagagatagttgcttgacgcgtgtggttgccggcgttgccatcggcggtggtgttggtggcgctgtaggtgctgtatatggaacttatgaggccattaggcataaggtgccgggactactgaaaataaggtacatagggcaaacaacagtttcgagcgcagcaatttttgggctcttcttgggagcaggaagcttgattcattgcgggaaatgaaactcaggggagaaggaggacttatgttcatctgtttttatgtagctataataataacctagtccagaatttgcagtgtggtgaataatattattaattttagtacgtttctcagttttgttaatactcattgaaacagtgcatctccgatccaattatttc

SEQ ID NO: 1156 - DNA, 591 bp, Linum usitatissimum
ggtgttagaagttgaattgatcggagcatcattggttgcgggagattgaagaagcatcgattttcttgaagataagacactaggctgtctcggctcacggaatggcgagagatagttgcttgacgcgtgtcgttgccggcgttgccatcggcggtggtgttggtggcgctgtaggtgctgtatatggaacttatgaggccattaggcataaggtgccgggactactgaaaataaggtacatagggcaaacaacagtgtcgagtgcagcaatttttgggctcttcttgggagcaggaagcttgattcattgcgggaaatgaaactcgggggagagaaggaggacttgtgttcatctgcttttatgtagctacaataataacggtagtccagaatttgcagtgtggtgaataatattattagttttagtacgtttctcagttttgttaaacagtgcatctccaatccgattatttcttttccagtgactgcagcttctctctcccagtccaacagcgaccaaaaatgttttactactgtcggttaatgcctcatggtttttgcttgaaattggtcactggtgttattcttctt

SEQ ID NO: 1157 - DNA, 799 bp, Humulus lupulus
tacggtgtatgcgataataattacccaaactcttgctctgaggatctgcctaactacatccatactcactctcaaacccataaacagctattcttctctacaatggcaagggacagttgtatgactcgtgtggccgctggagtcgcagtcggcggtgccgttggtggcgctgttggcgctgtatatgggacttatgaggctattaggtataaggttccgggattactgaagattaggtatattggacaaacgacacttggtagtgcagctatttttggtctctttttgggtgctgggagcttaatacactgcgggaagtcctattaagctcttctctttcctttcattttggtgtactaaaattatatcaaatgttctggtaaaaaaatttctggtttctacttcaatatcacatctcaagtatacagatgttgaaccagggtgatcatttgcttccatgtgatctgctgtttttattggcgtttgcttaatttcatagccatttatgttgcttatatttttctcttgttgctgagatatattactttcagacatgcattgtgaaattttggctgcatttgttcgtcaaattcttaaggctgtgttgaaaacactcaacatggcctggctggtgcattggcctcgctgttgtttacaccaatatgtgattgctcattggaagaataacgctcactttttcattcagatgtgtgcatgtaagattgacagattagcaaaaacacatgcatgtatcattatttctcgtactagtttgagcctcttttttcctactatacta

SEQ ID NO: 1158 - DNA, 384 bp, Ipomoea batatas
cccccctcgacctcgctcctgctatacccagaaagagatggctagggaaagcagctgtttggcacgcgtggccgccggggcggcagtcggcggcgccgttggtggcgctgtaggtgctgtatggggcactgtggaggctattagatacaaggtgcccggtcttttgaaaattaggcacattggacagacgactgttggcagtgcagcaatctttggtctttttctgggggcaggaagtttgatacactgtggaaagtcttattaatcatttctagaattgatcaataagtaatgttattttgatattttagtgggggagggaggtcttgaaatggaccatgtgcatggaacctccttgttctaatgttcaaaaaagtattctgc

SEQ ID NO: 1159 - DNA, 565 bp, Zea mays
tctaccaattgattttcttcacccgtccacctcgtcttgcgctcctctgtctcggcgacgactgtgctaccgccgccgccgccgcaagacttcgtcgggcactttgccggcgacgatttcccaccagcccaacaggatcagaggaggtgatggcgaggagtgacagctgcctggcgcgcgtgggtgccggaattgctatcggtggcgcggtcggcggagccgtcggtgcttgctatggaacttttgaggcgttcagatacaagatccctggattgctaaagatcagatacattgggcaaaccaccgttggcagcgctgcgatttttgggcttttcttgggggctgggagcttgattcactgtggaaaatcctactagtttgtttccctttttttttctgaagtctgaacacacctttgtcgatgggcttcagtgaaaactattcaatgcctgtttcatgtaacagctaatagctcagggttggaaaagaacaatcaagttatgtcctagttttggtgtggatggaaatagaatcaacgttcatctgcacgagaatcgtcaatttc

SEQ ID NO: 1160 - DNA, 626 bp, Elaeis guineensis
caaggatacaatttgtacggccggacggagagcggtccgctacaaggaatctctattttctgcgggggtcataaagtagatttggttatcagagccgcgggtagtgggtacaaccaagatggcacgggatagctgcttggctcgcgtcaccaccggagctgccctcggcggcgccatcggcggcgccgttggtgcggtttatgggacctacgaggctattagatacaaggttccaggattattgaaaatcagatacatcggacaaaccactctcggaagtgcagcagtttttgggctctttttgggggctgggagcttgatacactgtgggaaatcttactgacaacttttgaggttttgtgcgcttctttggggttgagagttcactgcggagtgattttacggagccacccccctgccttctttgtgacgtttcttctgggtgatgtattaaattaagatgctgtagttgtgctctaaattaagacagtgaaagcttggtgctggcaaaaagagcaactgttttctgaatttgttgaatatcacatataaataattagaggtactgagagaaatcgagaattctcatcatttctgaggaacatagatcaaattcaatttagttt

SEQ ID NO: 1161 - DNA, 447 bp, Elaeis guineensis
atagatttggtacgcgagcggaggctgggagaaaaaatggcacgggacagctgcttggctcgcgtcgccgctggagctgcggtcggcggtgccgtcggcggcgcggtcggtgcggtttatgggacctatgaagctattagatacaaggttccaggatttttgaaaatcagatacatcggacaaaccacgcttggaagtgccgcagtttttgggctctttttgggggctgggagcttgatacactgtgggagatcttactgactacctcttgaggttttctgcactcctttggggttgagagttcattgcataacgatcttgcaaagccccgattttctgtgtatgtgacattattttccatttgatgtattaaatttttgtgctgtggtttgagtttccaaaccaagtgaaagcttgatgaataaaaaaaaaaaaactaagagacta

SEQ ID NO: 1162 - DNA, 585 bp, Citrus sinensis
cgattttgatttaaccggcgcaaaggggaaaacccaagcatttgctcttccaagtaaacaaagggacaagagtcagttttatggcgagagaaaccagttgtctggctcgtgtaaccaccggcgttgctgtcggcggcgccgttggtggtgctgttggtgctgtgtacggaacatacgaggcaattaggtataaggtaccgggacttctgaagattagatatatcggacaaaccacacttggcagtgctgctatttttggtcttttcttgggtgctgggagcttaatacactgtggaaagtcatattgagcagcttggtgtatcaagtaaaaaaaatttttttctccccagcttagaattatttgcctttgactcagaagtcttgtttgtatgagtagaatatcatgaatattggtcttttgtggtcatcttggctttctggatgctttatacaatttcatagaaattaaccttctcatttggtgaaattctatgttgtgacgtttaactgtggtgattataattaggggttggttgtatttcgcttgtcagcttgatatgaaacgtaacttaagatgttctgact

SEQ ID NO: 1163 - DNA, 601 bp, Lippia dulcis
cagcaagtttcaattgaatacgagacagaacaaattcagtatccgatcagttgctattcggattgaaacatccgaggtcgagcgagaagaagattcatggcaagggatagttgtctggcgcgagttacggcgggctttgcagtcggcggtgctgtcggtggtgctgtaggtgctgtttatggaacttacgaggctgtaagattcaaggttccaggtcttctaaaagtacgatatatcggacagacaaccctaggcagtgccgctgtgttcgggcttttcctgggagccggaagcttaatacactgtggcaaatcttattaggcttcttaatccagtttggcataatgtaaaacttgtttctggtttgagagaccgaatcacattgctatcgattttatgcatccttaatcttgttcttgttcttatccgagtccaaaaccgctccctttatggaaactgaactactttcatgtcctcttcctttcatcttagcaatagtgggaatttctttttgaattttgtcaattgtcatgtaatcatcatgatgatgtgtaataagtaaaagaagaaagaaagatacatttgaaatataaacaaattc

SEQ ID NO: 1164 - DNA, 644 bp, Populus trichocarpa
aaaaacatatatatacatagtcaccactgaatacagtcgtttacaaacctcaagaaggtttcactatcagtcaatcaaatacttgcataaacaagaactctcgcaatcctgaaatggcgagggatagctgtctggctcgtgtaacagctggcgttgcggttggaggtgctattggtggcgccgtaggtgctgtttatggaacatatgaggcagtcaggtataaggtgccaggacttttgaagatcagatacattggacaaaccacacttggtagtgcagccattttcggtctcttcctgggtgccgggagcttgatacattgtgggaagtcatattgatttgttgaactaagagcatgaagaaattcacttcgttcttgtcacaaggatatgtggttcaacttcgtttacctttgagctgatggatgcaacttgtggtggcgagtagttctctctttcaacataaaatttcccatatgatgtttggggtttcagaagcagctgaacaagtagtcttgtgaaatttcttggactttcataggtttctgacaccttgatggttgcttcgtttatttattttttatggaaactgttgagctacgattacgaattccgtgacctcaatgtgctacttaatgggtgctc

SEQ ID NO: 1165 - DNA, 669 bp, Populus trichocarpa
aaaaacatatatatacatagtcaccactgaatacagtcgtttacaaacctcaagaaggtttcactatcagtcaatcaaatacttgcataaacaagaactctcgcaatcctgaaatggcgagggatagctgtctggctcgtgtaacagctggcgttgcggttggaggtgctattggtggcgccgtaggtgctgtttatggaacatatgaggcagtcaggtataaggtgccaggacttttgaagatcagatacattggacaaaccacacttggtagtgcagccattttcggtctcttcctgggtgccgggagcttgatacattgtgggaagtcatattgatttgttgaactaagagcatgaagaaattcacttcgttcttgtcacaaggatatgtggttcaacttcgtttacctttgagctgatggatgcaacttgtggtggcgagtagttctctctttcaacataaaatttcccatatgatgtttggggtttcagaagcagcttaacaagtagtcttgtgaaatttcttggactttcataggtttctgacaccttgatggttgcttcgtttatttattttttatggaaactgttgagctacgattacgaattccgtgacctcaatgtgctacttaatggtgaatgcaaaggcaaatgcgaggtatttttt

SEQ ID NO: 1166 - DNA, 653 bp, Panicum virgatum
aaacgcgcgctgcgaacgggcgacctggattatccgcgcaagaaaaaacaaagaattccgcgaggaaggcagcaagccaagagccaagagaggtgtccaccaaaaaaaaaagagccaagagaggtggacgagagcgcggcggcggcggcggcggcagaggccgagaggaggtgatggcgaggacggacagctgcctggcgcgcgtgggcgccggagccgccatcggtggcgcggtcggcggagccgtcggtgcttgctatggaacttttgaggcattcagatacaagatccctggtttgctaaagatcagatacattggacagaccactgtgggtagcgcagcaatttttgggcttttcttgggggctggcagcttgattcactgtggaaaatcctactagttcgtgtcatccttttttttttgaaaaaaatactcggttgatgggcttccctgggtggcctcagaggacgtctgtgaaaacatttgttcaatgtttatgtacaatttaacagctaatagctcagggtggatagaacaatcatgctatttgatatgccggtcctagttttggtgtggaaataaaacccatgttcatctatacgcttgaatcatcaattcctggatgcatctactttctgatgttattatacca

SEQ ID NO: 1167 - DNA, 495 bp, Panicum virgatum
ggtgtccaccaaaaaaaaaaaagagccaagagaggtggacgagagcgcggcggcggcggcggcggcagaggccgagaggaggtgatggcgaggacggacagctgcctggcgcgcgtgggcgccggagccgccatcggtggcgcggtcggcggagccgtcggtgcttgctatggaacttttgaggcattcagatacaagatccctggtttgctaaagatcagatacattggacagaccactgtgggtagcgcagcaatttttgggcttttcttgggggctggcagcttgattcactgtggaaaatcctactagttcgtgtcatccttttttttttgaaaaaatactcggttgatgggcttccctgggtggcctcagaggacgtctgtgaaaacatttgttcaatgtttatgtacaatttaacagctaatagctcagggtggatagaacaatcatgctatttgatatgccggtcctagttttggtgtggaaataaaa

SEQ ID NO: 1168 - DNA, 573 bp, Panicum virgatum
gcaagaaaaaaaagaattccgcgacgaaggcagcaagagccaagaggtggacgagagcgcggcggcggcggcggcggcggacgagaggaggtgatggcgaggaccgacagctgcctggcgcgcgtgggcgccggagccgccatcggtggcgcggtcggcggagccgtcggtgcttgctatggaacttttgaggcattcagatacaagatccctgggttgctaaagatcagatacattggacagaccactgtgggcagcgcagcaatttttgggcttttcttgggggctggcagcttgattcactgtggaaaatcctactagtttgtgtcatcctttttgtgaaaaaaatactcagttgatgggcttccctggagggcctcagaggacgactgtgaaaacatttgttcaatgattatgtacaatttaacagcaaatagctcagggtggaaagaacaatcatgttatttgatacgctggtcctagttttggtgtggaaataaaatccatgttcatctgtactcttgaatcatgaattgctggatgcatctagggtcagatgttcttatacaatct

SEQ ID NO: 1169 - DNA, 581 bp, Panicum virgatum
ccacgcaagaaaaaaaaaaagaattccgcgacgaaggcagcaagagccaagaggtggacgagagcgcggcggcggcggcggcggcggacgagaggaggtgatggcgaggaccgacagctgcctggcgcgcgtgggcgccggagccgccatcggtggcgcggtcggcggagccgtcggtgcttgctatggaacttttgaggcattcagatacaagatccctgggttgctaaagatcagatacattggacagaccactgtgggcagcgcagcaatttttgggcttttcttgggggctggcagcttgattcactgtggaaaatcctactagtttgtgtcatcctttttgtgaaaaaaaatactcagttgatgggcttccctgggtggcctcagaggacgactgtgaaaacatttgttcaatgcttatgtacaatttaacagcaaatagctcagggtggaaagaacaatcatgttatttgatacgctggtcctagttttggtgtggaaataaaatccatgttcatctgtactcttgaatcatgaattcctggatgcatctagggtcagatgttcttatacaatct

SEQ ID NO: 1170 - DNA, 613 bp, Vinca minor
ctgagaaaagaggatcagattcatggcgagggacagctgtttaaccagagtcatggccggtgttgctgttggcggcgcggttggtggcgctgttggtgcggtttatggaacatatgaagcagtgagattcaaggttcctggacttttgaaaattagatatattggacaaaccaccttgggtagtgctgccattttcggtcttttcttaggtgctggaagcttgatacactgcgggaaatcatattgattgtggtctcatgaaactaaggattaataagcatataacttttgtattgttaccgaacgttgaatttccgtttagttggtttctccaggtttagcttctttggaacctggttttttcttgaaaatagaggtacctctggttgcctttgcttgtgaaaacgatatcaatattggagagttctgaatcgccaatatacgcctcttatcctttggcatgtatccggccttgtgggactggccctacgatcctctcacatgagttggagtggagtctacatgcaaagtaggttccactacaacttatgtgagagggttgtggtgtcagtcccacaatgccggtcctatattagaattttcttcttatgtg

SEQ ID NO: 1171 - DNA, 1316 bp, Artemisia annua
tcttcatctttctttcatttctggtgacaaagataatggctacttctttacacaccagccaactcgggtctgcgtttttgggtgagagaaatggtctatgtgtttctactgttcctgttgcacgtcttggttttagaaggaacactgttgagtgtaaagagtcgagaattgggaagcagccaattgaagttccgtccaatgtggtaattacaatggaaggtcaagatatgaaggtgaagggtcctttaggtgaacttgcattgtcttatccacgagagattatgattgacaggcaggaggcagttcttaaagtatgcaaggcagtcgagacaagaagagccaaccaaatgcacgggctattcaggactctcacgagcaacatggttattggtgtatccaagggattcgagaaaaaacttcagctagttggtgtcggatatcgtgcaacagtagaagggaaagagttgatattgagtcttggattctctcatccagtcaaaatgacaatcccggatgacctaaaggtcaaagttgaagacaacaccagaatcacagtgagcggatatgataagtcaaacattggtcaatttgcagctacaataaggaagtggagaccaccagagccatacaaaggtaagggagttaaatatgcagatgaaatcattagaagaaaggaaggaaaagccgggaagaagaagtaggctacatattcacctttgttcaaatctcaatgtaatttcccttttgttacttatttaaatttttgtatcagaaattcggtctcagtcttgcttaaaaacattgtggcttgtcttggtaagatattcaagaggttagattgaattaaaaaagagaattgtgcccatcagcaataagaagttataaagtcgactaaggttttattgtttgtaaatccaaagaacactcttagtaggacttcccacagtgtatcaagctcccagcaccaagaaaaagaccaaaaagtgcagcactaccaagcgttgcttgtccgacgtgtcttatcttcgtaaatccaggtaaaactgacctcaacctaaaggcatcataagttccatatacagcgccaacagcgccgccaacagcaccgccgacagcaactccggctgttattctcgccaaacaactatcttttgccatctctctctgtaaaagttttttttttatcttgtttttctgtcaagaaagaagctgtttatttgtttaggtttaagtgtgttctgttcctctcacatgttttttagttgtcatgtttttattttaaggtaactcatttttacttgaagaaaaagatatcc

SEQ ID NO: 1172 - DNA, 345 bp, Amsonia hubrichtii
aaggaggagcagatacatggcgagggatagctgtttaaccagagttatggccggtgctgcagtaggcggcgcggttggtggcgctgttggtgcggtttatggaacctacgaggctgtgaggttcaaggttcctgggcttttgaaaattagatatattggacaaacaactcttggaagtgctgccatttttggtcttttcttgggcgcaggaagcttgatacactgtgggaaatcatattgattttgttctaggttcaagtaattttgttgtttttggaattgctgatgtttagacttgaaactaaggataataagcatatattgttacaggaagttgtatactgt

SEQ ID NO: 1173 - DNA, 636 bp, Brassica rapa
aagtaaaaaaaaaaaaaaacttaaaaagcggcgagagggcaacctcaaaattatttcccgacagaaagaaaacacacatcaaaagtaagttactgtcccaaaacctcccagagaaacaagtgttccaaagatggctagagaaacaagttgtttgactagaatcactgccggagttgcaatcggcggcgcacttggcggtgctgtaggtgctgtctatggaacttacgaggcggttagattcagggtacctgggcttatgaagataaggtacattgggcaaacaacactcggcagcgcagcaatttttgggctattcctaggtgcaggcagtttgatacactgtggaaaataagcttttaagtttggtgtgtcttgcaaagtttcctggtgaaagatttgtttattttctgtaagattttgagctttatgaattattaagctttttaaatgaatcgtctcatgtgtttctgcctctatgtgaatcagttcaatctattggggtttgatgcttcttattaatgaatgagaagatagaatcttagttccaaaataaagcgtagaaactttagtaaaagaagcatgttaaacccttttattaatgataaataattatctgtattcaaccgtatatgcaac

SEQ ID NO: 1174 - DNA, 511 bp, Fagus grandifolia
cccactcctctctctagtcttggctttcaacactgcgcctatttcacttcacctcgttgaaacacaaagcacaaacacaaacacaaacacaaacacaaaaacagacacacaggtttcattaagatggcaagggatagctgcttggctcgtgtcaccgccggcgttgctgtcggcggcgccattggtggcgccgttggtgcggtatatgggacatatgaggctattaggtttaaggtaccaggaattatgaagatcaggtatattggacaaactacactaggcagtgctgcaatttttggtcttttcttgggtgctggaagcctgatacattgtgggaagtcttattaagcactatttttttaaactattttgtctgtttactaagttctgctttgaacttggatgtcacattccctgggacagttgaaaagagtgcataatcatgataacttgtttcttcaatggcaaaacttctgttgttttcatgggtcttaacgaacatcttggcaaa

SEQ ID NO: 1175 - DNA, 463 bp, Brassica napus
agtaagtaactgtcccaaaacctcccagagaaacaagtgttccaaagatggcgagagaaacgaattgtttgaccagaatcactgccggagttgcaatcggcggcgcacttggcggtgctgtaggtgctgtctatggaacttacgaggcgattagattcagggtgcctgggcttatgaagataaggtacattgggcaaacaacactcggcagcgcagcaatttttgggcttttcctaggtgcaggcagtttgatacactgtggaaaataagcttttaagtttggtgtgtcttgcgaagtttcctggtgaaagatttgtttcttttctgtaagattttgagctttatgaattattaagcgttttaaatgaatcgtctcatgtgtttctgcctctatgtgaatcagttcaatctattggggtttgatgcttcttattaatgaatgagaagatagaatcttagtttc

SEQ ID NO: 1176 - DNA, 430 bp, Cichorium intybus
ccaggaattcggcacgaggcctcgtgccgcttcacgcatcaatcacacctctagactggcaagggatagttgtctagccagagtaaccgccggagtcgccgtgggtggtgccgtcggaggcgctgtcggtgctgtttatggaacttatgaagctgttaggtacaaggtcccgggacttatgaagatcagatacattggacaaacgacacttgggagtgctgcaatttttggactttttctgggtgcagggagcttgatacattgtgggaagtcgtattgagagagtggttatttggatatttgaaaacaataaaaaaattagccgaatttgataacattttggtgctcatgtgcacaattctcttgttaagtttgaaatcaaaagtggagcatttctgttgctatggtttttatattattcaagttttgt

SEQ ID NO: 1177 - DNA, 1276 bp, Eucalyptus grandis
atcgcatcggcggcgtcgaagcagagctataaagaacgaggcgaagagccgccgaccacgctcgcgaggagaaggcagggacgccggcgagggtagcgaccgatggcgagggacagctgcttggcgcgcgtcggagccggcgtcgcggtcggcggcgcgatcggcggcgccgtcggtgctgtttacgggacatatgaggctatccgatacaaggtcccgggaatgatgaagattaggtatgtggggcaaactacacttgggagtgcagccatttttggtcttttcttgggtgccgggagcttgatacattgtgggaagtcatactaattgttcctgttgtttcgagggaccgatgtaataataactttaattatcttgaggcagattcttttttggctctctctctctctctctctctctctctctcacagcgggtgtttgcgtgtatatgtgtgtgttgtcgggtggggtatgtgcgtgtacatgaaccctaatcctcagcgtatccaactaccgtcgttaggctccgaatttgtgcaagacagtcggattggaccatgttattttcttggacatgacgcatgagactgatggagctggtgaaatcaggcatataactatcattccattgcaagtggaagacgttagtgaaggctttgtccaggctcagaacacgaaattctcctctcttcttcttcatctcgtggaaacttctccatcatcagcaagaacccaaattaagaagtggtttatcagtaaatgaagggaggaatggccgtgagaagcagcatgataatttggatggcgatgcaggtatggggagcttttagtggatggttctccacttgcgttttggttgctgatgagattgctcgttctctggagactcaagaataccatgttgttgtagactgaaaaatcattagaaagtccagttgctcgatcaatcctgcacgagtttgagttgaatttactggatcagaggcaaaagaacaggtttttcattatcttgtttgtgtgtatatgtttcgacattattctctcagcaacagacaatttcttgcatcacccatttcttggcttagcaacaagtgattgagaagacagaacctccatgagaaatcatatgattttcccctgtttttgtcaaatatctctaattagtgattcattactcaggccgatgataaatattcttgcaataattagtggttggatgtcagccttgattgatatctcccatctttcatgaaataattgatgactgttacgtttg

SEQ ID NO: 1178 - DNA, 622 bp, Flaveria ramosissima
atggggatacattggctactttttactttttatggtgcaatattagcaacttgtgaatcgtcccgatactctttgttctacgacaaagtgactaatatagagagtaaacataggaaccaaacaagttgtccttgatatctccgagttaaacctaaccttgctcgtatcagaattgacgagagagatggcaagagatagctgtctagccagagtaaccgccggagtcgccgtcggtggtgctgtcggaggcgctgtcggagctgtatatggaacttatgaggccgttaggtacaaggtccctgggcttatgaaaatcagatatattggacaaacaacacttggtagtgctgccatttttggtctttttctggtgctgggagcttgatacattgtgggaagtcctactgaaagagagagagagagagagtttaataaaaccttaggtgaatttggttacttgttttttagaatttctgttggggaagcaaaatgacatgcaattgtgcagtcatctcattttatatttggtatgtgctactctttaactcttcttttattgtttaaaaaagtcccttatgcatgtgttgggtctcacttatggccatcaccaacaagcggggta

SEQ ID NO: 1179 - DNA, 604 bp, Setaria italica
caggcccataaacgcaggctgcaaacggcgacccggataggcactccacgcaagaaaaagaagaattccgcgaggaaaccaggcagccagcaggtggacgagagcggcggcggcggcggcggccgagaggaggtgatggcgaggaccgatagctgcctcgcgcgcgtgggcgctggagccgtaatcggcggcgcggtcggcggagccgttggtgcttgctatggaacttttgaggcattcagatacaagatccctgggttgctaaagatcagatacattggacaaacaactgttggcagcgcagcaatttttgggcttttcttgggggctggcagcttgattcactgtggaaaatcctactagtttgtgtcatcttttttgaaaaatactcggttgatgggcttcactggctgcctcagaggaccgtctgtgaaaacatttgttcaatgcttatgtacaatttaacagctaatagctcagggttggaaacaacatcatgttatttgatatgctggtcctagttttggtgtggaaataaaatccatgttcatctgtacgattgaatcaccaatttctggacgcatctagtgtctgatgttctaag

SEQ ID NO: 1180 - DNA, 548 bp, Capsicum annuum
gcacgaggatcataacaaaaaaccatttgttggaaaacggtgcatttgagtgaatcagagatggcaagagatgggtgtctagcgagagtaactgctggtgttgctgttggtggtgctgttggtggcgctgtcggtgctgtatatgggacttacgaggctgttaggttcaaggtgcctgcacttctgaaaatcagatatattgggcaaactactttgggaagtgcagctatttttggtctcttcttgggtgctggaagcttgatacactgtgggaagtcttactaagcatatatttgctagctgtgtcgaacattttgattgtcgtagagcatggaattgaattgttgttatcagaataatgtgcttgtgcaattccagtatatttgagtcaagtactctggtaattggtgattcaaaattgagcttctctcttaccttttagcagcagtttataactcggcaggctatggtagtatgcttgtccttgccccataaaaaggggaaaaagaagctttttagccattttcgaatgatagatacatacctgg

SEQ ID NO: 1181 - DNA, 631 bp, Papaver somniferum
agaagagaaaagaagagatggcgagagatggttgcctaactcgtgttgcaactggtgttgctgtcggtggcgctgtcggtggcgctgttggagctgtttatggaacttatgaagctataagatacaaggtgcctggactattgaagattaggtacattgggcaaacaacactggggagtgcagctattttcgggttgttcttaggagctgggagcttaatacactgcggcaaatcctactgaaggcacacccttattttgttgctaaattatatgtcgaaataagttttactttattaaagagagaatggtagcagtgtcagaagaatcatttcctactgccagatttcgtaatattagcagtaaaatgtatgagaacatttttgttcctgttcaactgtgcctttttattgttcttccttcaaagtaagaattaattttctggtgtaacttggtcagtcagttgtattttcatggatgcacctcctctatctcttgctggtgagctttcttccttggcatttctccaaaagtgtcagactcttttatggtcaatattttcactaactcgttccgactctggcagaattaatatatcctccacgttatgcaagttttgtggcaaggatgac

SEQ ID NO: 1182 - DNA, 566 bp, Solanum tuberosum
ggagaaagaggagagagagagcgagaaatggcgagagatagctgcttggcgcgtgtgacggcgggggtggccgtcggtggtgcaattggtggcgctgttggtgctgtttatgggacatatgaggctgttagatacaaggttcccggcttaatgaaaattcgatacattggacaaactactctgggaagtgctgccatttttggtctctttttgggagctggaagcttgatacactgtggaaagtcatattgaggatttcttttagtgctgactaaaactctttttgtctcatgagtatagaacaatatcatcattatcagaagaatgcttcgtgttcttccgatttgtttttcgttctgtaattttccggttcaaaccgagttttctcttagcttttacctccatttaatggtggagccttacccgttgtgaatcttgattagtcgagctagtggatttccgagaccggatggttaaacaaaaaagaagtgttagagagtttcacttgtaaaagtcgaaattcaagaacaatatccaagagttcgaagatgtgtcatgagtgaatt

SEQ ID NO: 1183 - DNA, 610 bp, Sesamum indicum
gtccaagtcttctacattgctgtggcctaaggctcaagttttcttgtagagcgagagaaaaacaaattactgtcagatttgtagattttgagagaaaaataatagtggtagtagagcagatatggcgagggatgggtgtctggcacgggtgaccgcgggcttcgccgtcggcggtgctgttggcggtgcagttggtgctgtttatggaacttacgaggctgtaagattcaaggtcccaggtatcctgaaaatacgatatattggacagacgacgttagggagtgctgctgtttttggtcttttccttggagccggaagcttaatacactgtgggaaatcttattaggcttctcattccagtttgccatgaagtcttattgacctgaattccatgtcaatatatgtaattcctattagattttcttggcattttctgcttttgtatatcaaagataattgaatggtacatcatgaaatttaatcgctatgtgggcactgatcagattggtggtgatcattagaacttatgttcaatgacttttgaaatagagttttgacagaacatccatgcttcccatctttggaggagattttaaagatatgttggcag

SEQ ID NO: 1184 - DNA, 677 bp, Solanum phureja
gaacaacgaactcaaattaccccattgaagagagagaaagaggagagagagagcgagaaatggcgagagatagctgcttggcgcgtgtgacggcgggggtggccgtcggtggtgcaattggtggcgctgttggtgctgtttatgggacatatgaggctgttagatacaaggttcccggcttaatgaaaattcgatacattggacaaactactctgggaagtgctgccatttttggtctctttttgggagctggaagcttgatacactgtggaaagtcatactgaggatttcttttatctttttgtctcaagagcatagaacaatatcatcattatcagaagaatgctttgtgttcttccgatttgtttttcgttctgtaattttctggttcaaaccgagttttctcttagcttttacctccatttaatggtggagccttacccgttgtgaatcttgattagtcgagctagtggatttccaagaccggatggttgaacaaaaaagaagtgttggagagtttaacttgtaaaagtcgaaattcgagaacaatatccaagagttcgaagatgtgtcatgagtgaattaataatcctttagcattatttgagaaactaattcattaaaacattatttcattcatgatataataaagtccgtgcaaaaaaaataatatattg

SEQ ID NO: 1185 - DNA, 403 bp, Tabernaemontana elegans
gagcgcgctaagtagccagtgtcctttcgatagaaaccattctccgagataaatttcttcaaaagaaacgataactcacagtggaggagcagcggatacatggcgagggatagctgtttaacgagagttatggccggcgttgcagtcggcggcgcagttggtggcgctgttggtgctgtatatggaacctatgaggctgtgaggttcaaggttcctgggcttttgaaaattagatatattggacaaaccaccctgggcagtgctgctattttcggtcttttcttggtgctggaagcttgatacactgtgggaaatcatattgattttgttctcatctagcttgaagtaaattttgtttgtctttgtagaatcagtgttgttaaacatgaaagacaaggactaa

SEQ ID NO: 1186 - DNA, 692 bp, Solanum lycopersicum
gaacaaaaagctcgaattcccccattgaagagagagaaagaggaagagagagagagagagaaatggcgagagatagctgcttggcgcgtgtgacggctggggtggccgtcggtggtgcaattggtggcgctgttggtgctgtttatgggacttatgaggctgttagatacaaggttcccggcttaatgaaaattcgatacattggacaaactactctgggaagtgctgccatttttggtctctttttgggagctggaagcttgatacactgtggaaagtcatactgaggatctctttactctttttgtctcaaagagtatagaacaatatcatcaacattatcagaagcatgcttcgtgttcttccaatttgcttttcattctgtaattttccggttcaaaccgagttttctcttagcttttacctccatttaatggtggagccttacccgttgtgaatcttgattagtcgagctagtggatttcagagaccggatgggttaaacgaaaaagaagtgttggagagtttcactcgtaaaagtcgaaattcgagaacaatatcaaagagttcgaagatgtgtgtgtcatgagtgatttaataatcctttagcattatttgaggaacttattcatttaaacattatctcattcatggtatggtaaagtccatgcaaaaagaataatatattgggt

SEQ ID NO: 1187 - DNA, 501 bp, Valeriana officinalis
taaagagatggctagagatggttgcttggccagagtaaccgcaggtgtcgccgtcggtggcgctgttggaggtgccgttggtgctgtttatggtacttacgaggctgttaagtttaaggtccctggtcttctgaagataagatatatcggacagacgacacttggaagtgctgcaattttcggactctttttgggcgccggaagtttgatacattgtggaaagtcttattaagatctttgtttcattttttaaccctagcctttttcaatcttaaatgcggttgtgaattttggtgactcaaggaaatctatgcaaaatattcagtcattttatcctgtttttgagagttgctttgtgttctttgtgtctgaaaataatgtttcatagacaatttcatgtaggttacaagaaatttctcaattatatttgtgtgttctactcattcatgaataaaattctatatgtattgcatttcaagattatatgtatacacactgatc

SEQ ID NO: 1188 - DNA, 1973 bp, Secale cereale
tttgggagcggcgatccgcaatcgactggctccgctccgagctgctaccggcaatcgaagccatcaggcgattcctctccgagccgcagtccgcaatcgaagcggctcccttttttagcggcaatccggccggaatcaaagcagtccttcccggattacaatcagaatcaggccctctttcgaattcagtcttcgagtttccattggtggcgggaacccagcagctatagagaccaattcatgtcgcggcaacccgtgagccttcatcagcttccaaattcagggtgaccaattcttctcgggcctcggcggatctacgcgggagccatggggaaaggcaataaggatgataggctcagcgcattgccggatgacattctggtcaacattcttgaccgactcaatgtgcgtgatgctgccagaaccagcgtcctctcaagacggtggagtcagctctgcgccaagctctctcgacttgtaataagtgctctggacttcctgcccaagggtgcgtcacgcagcagtgccaacatctctgacgatgaattggttcggatcaatgcagccgtggttcaggcaacaaatagcatactggtgcgcagaaatccaggggaacacaccatcggccttctgtccacgacgttccacttgatcgatgatatccctatatccatcgggcaggttgttggtcgtgccatagcgacgcacctggtcaagaatgccaaattctgtgttaggacaaggaaggatgatgacgatgaaattgatgatgatgaagaactggtcatttgggcgagacgattcatgttgttcttccatgcttctcctgttgcatttgctggtctcactagtctcaacataggaaatttgagatttggtgaatcggacatgtccagcatcctcaccacctgcaagcggctcaagcgtatgcacctgtacaattgtgactgtggtgattctagcactctgcaagttgaacacgctaatctcagtgagctttgtatcgtatattgtcgtctcgagcaagttaagctgaactggctccctcgactcacacgcatagactttgacggttggatagatttccaagatccactgcttcttggtcatgttccgttgctcgagtctgtaagcctcacaaatgttgcccttagttacaacaagatggtcaagttaagtaggtttcttggcggtgcctctccacgagttctgaaattggggtttaggtccgaaaagatttgggtgcagccagaatgcccaacgcaagatctggcatctgtgttccgccaactaaggtttgtgaaccttgttaaacttcctgaagggtatgatctcacctggacaatgtttattcttcaagctgcacccttactgaaggagctatacatgacagtctgggatgatttgtgttcaatggaaatggacgaggagaagagaaaaaagggatcgtatagtgagaacaagggcgtagagtggggcgtggctgcagctgatttccaacaccacaatttggtcacactcgtcatctttggctttgaatctgaagattatgctgtggattatgtcagacgtgtcatggtggcggcggtcaatctagaggatgtgttcctctacagtaggctggagttggagtgcggcaactgccaggacaagaagcccaccaggttcgcgtggactaaaaggcagaagatttcactgaagaagagaatcaccgcggggattgagtcgttcgccataatccactccaacaagacgataagggctgaccataaagcgaaaatgctttacccaaagtgctcacactttgacacagcaagtggttgatttaacagtgaactgtattatcaacagtggttgctttcaacttttggaagcgtttgttagtactttggttattaacggttctcattttatttttgccgtctgaactgtattttctgttgtgttattatgatgaaaggatgatgagtact

SEQ ID NO: 1189 - DNA, 2211 bp, Secale cereale
ggggatcgggagttagttatgcgccgccgcctgccgtgcaccgatctcccccctcgcgttgtcgcaattgccgtcggcggcctcgaatgcggatccattgctgcttgcgaagaggcgaccaaataagcagctctcaaagcgggggctgcagtccccaacggaagcagcaagagcagcagctcttttgggagcggcggtcccgatccgcaatcgaccggctccgctccgagctgcaaccggcaatcgaagcaatcaggcgactcctctccgagccgcagtccgcaatcgaagcggctcctctccgagccgcagtccgcaatcgaagcggctcccttttttagcggcaatccggccggaatcaaagcagtccttcccggattacaatcagaatcaggccctctttcgaattcagtcttcgagtttccattggtggcgggaacccagcagctatagagaccaattcatgtcgcggcaacccttaagccttcatcagcttccaaattcagggtgatcaattcttctcgggcctcggcggatctacgcgggagggagccatggggaaaggaaataaagatgataggctcagcgcattgccggatgacattctggtcaacattcttgaccgactcaatgtacgcgatgctgcaagaaccagcgtcctctcaagacggtggagtcagctctgcgccaagctctctcgacttgtaataagtgctctggacttcctgcccaagggtgcgtcacgcagcagtgccaacatctctgacgatgaattggttcggatcaatgcaggcgtggttcaggcaacaaatagcatactggtgcgcagaaatcctggtgaacacaccatcggccttctatccgcgacgttccacctgatagatgatatccccatatccatcgggcacgccgtcggtcatgccatagcgacgcacctagtcaagaacgccaaattctgtgttaggacaaggaaggatgatgacgatgaaatcgatgatgatgaagaactggtcaattgggcgagacgattcatgttgttcttccatgcttctcctgttgcatttgctggtctcactagtctcaacataggaaatttgagatttgatgaatcggacatatccagcatcctcaccacctgcaagcggtctttctaagcgtatgctacctggtacaattgtgattgtggtgattctagcaccctgcaagttgaacacgctaatctcaatgagctttgtatcgtatattgtcgtctcgagcaagttaagctgaactggctccctcgactcacacgcatagtctttgacggttggatagatttccaagatccactgcttcttggtcatgttccgttgctcgagtctgtaagcctcacaaatgttgcccttagttacaacaagatggtcaagttaagtaggtttcttggcggtgcctctccacgagttctgaaattggggtttaggtccgaaaagatttgggtgcagccagaatgtccaacgcaagatctggcatctgtgttccgccaactaaggtttgtgaaccttgttaaacttcctgaagggtatgatctcacctggacaatgtttattcttgaagccgcacccttactgaaggagctatacatgacagtctggaatgatttgtgttcaatggaaatggatgaggagaagagaaaaaagggatcgtatagtgagaacaagggtgtagagtggggcgcggctgcagctgatttccaacaccacaatttggtcacactcgtcatctttggctttgaatctgaagattatgctgtggattatgtcagacgtgtcatggtggcggcggtcaatctagaggatgtgttcctctacagtaggctggagttggagtgcggcaactgccaggacaagaagcccaccaggttcgcctggactaaaaggcagaagatttcactcaagaagagaatcaccgcggggatcgagtcgtttgccataatccactccaacaagacaataagggatgaccataaagcaaaaatgctttacccaaagtgctcacactttgacacaacaagtggttgatttaacagtgaactgtattatcaacagtggttgctttgaacttttggaagcgattgttagtactttggttattaacagttctcaatttactttggccgtctgaactgtattttctgttgtgttatgatgatgaaaggctgatgagtactgaatg

SEQ ID NO: 1190 - DNA, 2384 bp, Secale cereale
tggggcccacctaggttccttccaccagactctcaaaaaagaaaaagaaaaaaaaactaaagggttccaccagagagcaaaggggatcgggtatcagttatgcgccaccgcctgccgtgcgcccatcttccccctctcgccgtcgcaatcgccgtcggatgcctcgaatgaggattcagtgctgcttgcgaacaggcgaccaaataagcagttccccttttgggagctgcagtctccagtcgaatcagcagctcttttgggagcggcgatccgcaatcaagcggctcctctccgagctgcaaccggcaatccaaccaatcaagcggctcctccccgagcagcagtcggaaatcgaagcggctccccttttagtggctaatccggaaccaaagcagtcctttccggattacaatcagaaacaggccctgtttcgaattcattatccgagtctccattggtggcgggaacccagcagatatatacatatctggccggggtacttctccagccaatcttcggaggagaccaatggggccaactcgtgagccttcatcagctgccagattcacggtgaccgaatcctctcgggcgtcgccagatcttcgtggcagccatggggaaaggaaataaagatgataggctcagcgcattgcctgatgatattctggtcaacattcttgaccgactcaatgtccctgaggctgcaagaacaagcatcctctccaaacgttggactcatctctgcgccaagctctctcggcttagtataagtgttctggacttcctgcctgaggatgcgtctcacgccaccagcgacatctgtgacgatgaattggttcggatcaatacagctgcagttcaagcaacagagggcgtactggcgcgcagaaatccaggtgaacacaccatccgccttctgtccacgacgttctacttgagagatgatgtccccatatccattgggcgtgctgttggtaatgccatggcgacacacctggtcgagaatgccaaattctttgttagagcaaggaaggatgacctcactgaaattgataatgatgatgaagtggtcgcctggggagagaattcatgttgttctttgatgcttgtccaaatgcatttggtggtctcactagcctcaacctaaataatttgagatttggtgaatcagacatatccagcatcctcaccacttgcaagcggttgaagcatctgcacttgtacaattgtgactgtggtgatggtagcactctgcaagttgaacacgctaatctcagtgagctttgtatcatcagttgtcttctcgtacaagttacgctgagctggctccctcagctcacacggctagcctttgatggttggatagaattccaagatccactggttcttggtcatgttccattgctcgaggctgtaagcctttcaaatattgcccttagtgtcaacaagatggtcaaattgagtacttttcttagcagtacctctgtgcgagttctgaagttggggtttagttctgaaaagatctgggtgcagccagaatgtcctaggcaaagtctggcatctgtgttccgccaactaaggtttgtaaatctagttaaacttcctgaagggtgtgatcttacctggacaatgttcattcttgaagctgcgcccttactgaaggagctatacatgacagtatgggatgatttgtgttcaatggaaatggatgaggagaaaaggaaaaagcaattgtatagtgagaacaaaggtgtggagtggggctcggctgcagctgatttccaacaccatagtttggtcacactcgtcatctttggctttgaatcggaagattaccttgttagttatgtcagacgtgttatggaggcggccgtcaatctagaggacgtgttcctgtatagtaggctggagttggagtgtggccattgccaggacaagaagccgaccaggttcccctggactaaaaggcagaagatttcattgaagaagagaatcattgcggggattgagtcgtttgccataatccactccaacaagacgataagggctgatcatgaagcaaaaatgatttacccacagtgcttactcgactaaaaggcagaggatttcattggagaagataaccaccgccgggatcgagtcgtttgccataatccactgcaacaagatgataagagtttatgatgaagcaaaaatcctttatccacggtgctcactgcttgacagtgagctgaccagttgttgatttaacagtgtactgttggaagtgtttgtcacttaggttattattgtttgtcacttaggttgttattatcttggccgtgtgaactgtattatgatgaatgctgaatggttgaattcgtgtagtgttgatgaaacttctt

SEQ ID NO: 1191 - DNA, 1308 bp, Secale cereale
gactgcccaacatctcgtctcttctcactctacaaaagccgcgggccgaccaccgcgcttccccacacccttgccaactcgtgacgccacctgacctgaccacctcggctgctagacgggcacggcctcgccgactccttctttcatcagggtttgatctcaactgtgggagctcacacttttggatccgagttcaggcctcacaatttttccagtcgaaacttgaaggcttgatccgtgagctcgaactgcaacctctgcggtaccaatccgaattagaagcttgatcatggaaggagccactccctcgatcacaaggattgctgtggtcaccggcgggagcaaagggatcgggctggaggcgtgcaagcagctggcaggcggcggcgccatcacggttgttctgacggccagggacgaaacgaggggaacggcggcggtcgagcagatcaagcggctggggcacgcagatgtcatctttcatcagctggacatcacggacgcttccagcatcgctcgactcgcagatttcctcaagacccgtttcgggaagcttgacatcctggtgaataacgccgcgacagatgggattgagcacgtcatcgatccagtttatggcttaatgcccggcgatgaaacgtttaatggcatggatgcggaccagaggatggattggatgtggaccacttgccgacagacctacgaaactgcaaaacagggcctgcagacaaactactacggcacaaagcgggtgacggtggctctcctgcccctgctccgatcctcgtccgacggaaggatcgtcaatgtctcctccaacttcggattgctaagctttttcaggaacgaggagctgaagcaggagctgaacggcgtcgacagcctgaccgaggagaggctggacgagctgctggccatgttcctcaaggacttcgagagcggcggggcggaggcgcgcgggtggccggcggagttctcggcgtacaaggtggccaaggccgccatgaacgcctactcgaggatcctggccaagaggcacccggagctgcgcgtcaactgcgcgcaccccggctacgtgaagacggacatcaccaggaactctgggatactgacgccagaggagggcgcgcgcaacatcacgagcgttgcgctgctgccggaaggcgggcccaccggcaagtacttctccgaaggcgaggaggcatccttcctgtgaaaaaatctgtagtactactgctttgttgcgctgggtctgtaagttcaagaataaggctatgttgagttaaaaaaaagaataaagttacgttt

SEQ ID NO: 1192 - DNA, 1326 bp, Secale cereale
gactcatctcgtctcttcccactctacaaaagccgcgggccgaccaccgcgcttccccacacccttgccaactcgtgacgccacctgacctgaccacctcggctgctagacgggcacggcctcgccgactccttccatcagggtttgatctcatctgtgggagctcacacttttggttccgagttcaggccctcaatttttccagtcgaaacttgaagccttgacccgtgagctcgaactgcaacctctgcggtaccaatccgaattagaagcttgatcatggaaggagccactccctcgatcacaaggattgctgtggtcaccggcgggagcaaagggatcgggctggaggcgtgcaagcagctggcaggcagcggccccatcacggttgttctgacggccagggacgagacgaggggaacggcggcggtcgagcagatcaaacggctggggtacgcagatgtcatctttcatcagctagacatcacggacgctcccagcatcgctcgactcgcagatttcatcaagacccgtttcgggaagcttgacatcttggtgaataacgccgcgacagatgggattgagcatgtcatcgatccagtttatggcttaatgcccggcgatgaaacgttcaatggcatggatgcggaccagaggatcgattggatgtggaccagctgccgggagacgtacgagaccgcgaaacagggcctgcagacaaactactacggcacaaagcgggtgacggaggctctcctgcccctactccgatcctcgtccgacggaaggatcgtcaatgtctcctccaacttcggattgctaagctttttcaggaacgaggagctgaagcaggagctgaacgacgtcgacagcctgaccgaggagaggctggacgagctgctggccatgttcctcaaggacttcgagagcggcggggcggaggcgcgcgggtggccggccgagttctcggcgtacaaggtggccaaggccgccatgaactcctactcgagaatcctggccaagaggcacccggagctgcgcgtcaactgcgcgcacccaggctacgtgaagacggacatcaccaggaactccgggatcctgacgcctgaggagggcgcgcgcaacatcacgagcgttgcgctgctgccggaaggcgggccgaccggcaagtacttctccgaaggcgaggaggcatccttcctgtgaaaaaaacatctgtagtactgctgctttgttgcgcttctggggtaaaatataatctgtaagttcaagaataaggctatgttgagttaaaaaaatagaggaataaagctacgtttgtggggg

SEQ ID NO: 1193 - DNA, 987 bp, Triticum aestivum
aggattgctgtggtcaccggcgggagcaaagggatcgggctggaggcgtgcaagcagctggcaggcggcggcgccatcaccgttgttctgacggccagggacgagacgagggggacggcggcggtcgagcagatcaagcggctggggcacgcagatgtcatctttcatcagctggacatcacggatgcttccagcatcgctcgactcgcagatttcctcaagacccgtttcgggaagcttgacatcctggtgaataacgccgcgactgatgggattgagcatgtcattgatccagtttatggcttaacgcccggtgatgaaacgttcaatggcatggacgcgggccagaggatcgattggatgtggaccagctgccggcagacgtacgagaccgcgaaacagggcctgcagacaaactactacggcacgaagcgggtgacggaggctctcctgcccctgctccgatcctcgtccgacggaaggatcgtcaacgtctcctccaacttcggattgctcagctttttcaggaacgaggagctgaagcaggagctgaacgacgtcgacagcctgaccgaggagaggctggacgagctgctggccatgttcctcaaggacttcgagagcggcggggcggaggcgcgcgggtggccggccgagttctcggcgtacaaggtggccaaggccgccatgaacgcctactcgaggatcctggccaagaggcacccggagctgcgcgtcaactgcgcgcaccccggctacgtgaagacggacatcaccaggaactccgggatcctgacgccggaggagggcgcgcgcaacatcaccagcgttgcgctgctgccggaaggcgggcccaccggcaagtacttctccgaaggcgaggaggcatccttcgtgtgaaagagcatctgtagtactactgttttgttgcgcttatctgtggtgtgtggtgggataatctgcaaagtcgagttcaaaaaaaggaat

SEQ ID NO: 1194 - DNA, 1266 bp, Leymus cinereus x Leymus triticoides
  misc_feature (1171)..(1171): n is a, c, g, or t
  misc_feature (1175)..(1175): n is a, c, g, or t
  misc_feature (1185)..(1185): n is a, c, g, or t
  misc_feature (1195)..(1195): n is a, c, g, or t
  misc_feature (1197)..(1197): n is a, c, g, or t
  misc_feature (1199)..(1199): n is a, c, g, or t
  misc_feature (1208)..(1208): n is a, c, g, or t
  misc_feature (1235)..(1235): n is a, c, g, or t
cgcgcttccccacacccagagacaccctgctagctcgcgacgctacctccgctctcagacgtactcggcgactcctccttccatcaggttttgatctgtgggagctcaagcttttggatccgagttcaggcttgacagttattttcaatccgaatctgaaggcttgatctgtgagcgagctcgatctgcagctctgcagtaccaatccggatcggaagcttgatcatgaaaggagccactcccattccctcgaacacaaggatcgctgtggtcaccggtgggagcaaagggatagggctggaggtgtgcaagcagctggcaggcagcggtgccatcaccgttgttctgacggccagggacgagacgaggggaacggcggcggccgagcagatcaaacggctgggccattcggatgtcatctttcatcagctagacatcacggatgcttcgagcatcgctggactcgcagatttcgtgaagacccgtttcgggaagcttgatatgctggtgaataacgccgcgacggatgggattgagcatgtcattgatccagtttatggtttaatgcccggtgatgaaacgttcaatggcatggatgcggaccagaggattgattggatgtggaccacttgccggcagacgtacgaaactgcaaaacagggcctgcagacaaactactacggcacaaagcgggtgaccgaggctctcctgcctctgctccgatcctcatcagatggtagaatcgtcaatgtctcctccaacttcggattgctcagctttttcaggaacgaggagctgaagcaggagctgaacggcgtcgacagcctgaccgaggagaggctggacgagctgctggccatgttcctcaaggacttcgaggccggcggggtggaggcgcgcgggtggccggcggagttctcggcgtacaaggtggccaaggccaccatgaacgcctactcgaggatcctggccaagaggcacccggagctgcgcgtcaactgcgcgcaccccggctacgtgaagacggacatcaccaggaactccgggatcctgacgccagaggagggcgcgcgcaacatcacgagcgttgcgctgctgccggaaggcgggccgactggcaagtacttttccgaaggcgaggaggcagcatcgttcgtgtgaaaaaagcatntagnacactgtttngttgcgctantntntggtggganaatctgtaagttcaagaataaggctangttcagtttgaaaagaagggactgactacca

SEQ ID NO: 1195 - DNA, 1358 bp, Brachypodium distachyon
ttcatcccttctccactccaactcaggccgccgcacgtaccgacgaccccgtgttatatcgcgagctcgaattttttggatcctgaactgaggcttgtcaatttttcaatcagggctcgacaacagcccgagtggaaagcttgatctgtcaggtggaagtacgcgcaacgttttgtattccgacattaaatttcgtgttgaaaggtcaatttttgtgctcatggaaggagccattcccatttcctggaacacaaggattgctgtggtcaccggcggcagcaaagggatcgggctagaggtgtgcaagcaactggcaggcagcggcatcacggtcgtcctcacagccagggatgagacgagggggacggcggcggtcgagcagatcgtacgcttgggccactcagatgtgattttccatcagctagacatcacggatgctctgagcatcgctcggttgactgactttctgaaggctcgttttgggaagcttgacattctggtgaataatgccgctactgatgggattgagcaagtacttgatcctgtttatggttcgatacccggcgacgaaaagttcgatggaatggatgcgtaccagagaattgattggatgtgggccaattgccgggagacttacgagaccgcaaaacagggcctgcagacgaactactacgggaccaagcgggtaacagaagctctcctgcccctgctccaatcctcctcagatggaaggatcgtcaatgtctcctccaacttcggattactaagccttttccgcaatgaggagctgaagcaggagctgaacgacgtcgaacgcctgacggaggagaggctggacgagctgctggccatattcctccaagacttcgaggccggcgcagcggaggcgcgcgggtggccggcggaattctcggcgtacaaggtggccaaggcggccatgaacgcgtactcgaggatcttggcgaagagacacccggagctgcgcctcaactgcgcgcacccgggatacgtaaggaccgacatcaccaggaactccgggatcctgacgcccgaggagggcgcgcgcaacgtcgtgaaggtggcgctgctgccggaagacgggccgaccggcgtgtacttccacgagggccaggaggcgtctttcgtgtgatagtagcagtactgttccaccgtcgtgctatgtgctgccataatctgcaaggcaagattgagaagaagcgaggtcgagagttattgtattttgttacgtgtaaacctgtcggattgatcgtcctgttactgctcggcctcgagttggtatcacaccggtgattttttttaggggatgttatcacaccggggttcttcctctcttctcc

SEQ ID NO: 1196 - DNA, 1111 bp, Secale cereale
ctcccactcccactcccacgctgacacgggaagagcaggggcaggtaacacctaggtgccgcgccgccgggaccctagtctcgccgtctccggcggcgtactcccagatctcgactcccaagtctgtctctgttccgcgcgaaatcaactgacggaggcggtggccagcgtcgtccgcagctgagtcgggatgggcggcagcagcaccagcaccttcgtcatcaggtggatcaacttcctcaccatgatactggcgatacttgtggtgggttttgggttctggatgagcacccacaatgacgaatgccgacggtcactgacgatccctgtcatgggtcttggaggagtaatttttctcatgtcgctggccggattcgtgggtgcttggaagaacatttcctgcttgctttggacatatctaataatgctgttcgtggtcctggtggcaatcatggtcttcacagtgcttgcgtttatcatcacaaatactggaactggtcatgctgttcctgggtccagatataaagagtatcgtctccgggactacagttcttggttcgtcaaacagctcaatgacactgataaatggactcatctgagaagttgccttgtgaagtcggatgattgcaatagcttgtcaaaaagatataagtctctaaaacaatacaagctcgctgatctgactcccattgagtctggctgttgccgcccaccagcggagtgtggatacccacctttgaatgcttccaattttgatctgagctaccatccggtgagcacaaacgtcgactgtaaactgtacaaaaatgatcggtccctcaggtgctatgactgtaattcttgcaaagctggcgttgcgcaatacatgaagacagagtggcgagtggttgccatcttcaatgtgatattgtttgtcattttgtcattcgtgtattttgttggctgctgcgcacgtcgacatgctggaggtagcgattctaaagttcctggaagatgactatgtactttgaagtgaatcctctcgatgattcacgcgtcacaggaagagttagctttgccgtcccttgtaataacattgttcattcaagttcagttgatgaaatggagtgcc

SEQ ID NO: 1197 - DNA, 1346 bp, Triticum aestivum
cccacgctgacacctacccaggtgccgcgccgccgggaccccagcctcgccgtctccggcggcgtgctcccagatctcgactcgccagtctgtctctgctccgcgcggaatcgtctgacggaggcgggtggccagcgtcgtccgcagctgatccgggatggccggcagcagcaccagcaccttcgtcatcaggtggatcaacttcctcaccatgatactggcgatacttgtggtgggttttgggttctggatgagcacccacaatgacgaatgccgacggtcactgacgatccctgtcatgggtcttggaggagtcatttttctcatgtcgctggcgggatttgtgggtgcttggaagaacatttcttgcttgctttggacatatctaataatgctgttcgtggtcctggtggcaatcatggtcttcacagtgcttgcgtttatcattacaaatactggaactggtcatgctgttcctgggtccagatataaagagtatcgtcttcaggactacagttcttggttcgtcaaacagctcaatgacactgataaatggactcatctgagaagttgccttgtgaagtcggatgattgcaatagcttgtcaaaaagatataagactctaaaacaatacaagctcgctgagctgactcccattgagtctggctgttgccgcccaccagcggagtgtggatatccagctttgaatgcttccaattttgatctgagctaccatccggtgagcacaaacgtcgactgcaaactgtacaaaaatgatcggttcctcaggtgctatgactgtaattcttgcaaagctggtgttgcgcaatacatgaagacagagtggcgagtggttgccatcttcaatgtgatattgtttatcattttgtcattcgtgtactttgttggctgctgcgcacgtcgacatgctggaggtagcgattctaaagttcctcgaagatgactgtgtactttgaagtgaatcctctctatgattcacgtgtcacagcgagagttagctttaccgccccttgtgataacattgttcattcaagttcagctgatgaaatggagtgtcaaggcttctgttctgtgggtgatttctttgtgccagtagcattttggacatctatgaaaaagaacgtccgacaatcttctgaaatacagcctgatgatcttgcacaatgtgtgatgccaatgtctgacatgcgagtaaactggaataacttaccaaccgaagcaattggtgtgcttctcgcggtcaggtttttggagggtacatttccttttgaacacagtataatgtagatgctcacatacactcatctccattaacacatgtccgc

SEQ ID NO: 1198 - DNA, 1151 bp, Triticum aestivum
gacggaggcgggtggccagcgtcgtccgcagctgattcgggatggccggcagcagcaccagcaccttcgtcatcaggtggatcaacttcctcaccatgatactggcgatacttgtggtgggttttgggttttggatgagcacccacaatgacgagtgccggcggtcactcacaatccctgtcatgggtcttggaggagtcatttttctcatgtcgctggcgggatttgtgggtgcttggaagaacatttcttgcttgctttggacatatctaataatgctgttcgtggtcctggtggcaatcatggtcttcacagtgcttgcgtttatcattacaaatactggaactggtcatgctgttcctgggtccagatataaagagtatcgtcttcaggactacagttcttggttcgtcaaacagctcaatgacactgataaatggactcatctgagaagttgccttgtgaagtcggatgattgcaatagcttgtcaaaaagatataagactctaaaacaatacaagctcgctgagctgactcccattgagtctggctgttgccgcccaccagcggagtgtggatatccagctttgaatgcttccaattttgatctgagctaccatccggtgagcacaaacgtcgactgcaaactgtacaaaaatgatcggttcctcaggtgctatgactgtaattcttgcaaagctggtgttgcgcaatacatgaagacagagtggcgagtggttgccatcttcaatgtgatattgtttatcattttgtcattcgtgtactttgttggctgctgcgcacgtcgacatgctggaggtagtgattctaaagttcctcgaagatgactcttactttgaagtgaatcctctctatgattcacgtgtcacagcgagagttagctttaccgtcccttgtaaaacattgttcattcaagttcagctgatgaaatggagtgtcaaggcttctgttctgtgggtgatttctttgtgccagtagcattttggacatctatgaaaatgaacgtcccacaatcttctgaaatacagcctgatgatcttgcacaatgtgtgatgccaatatctgacatgtgagtaaactggaataacttaccaaccgaagcaattggtgtgcttctcgcggtcaggttt

SEQ ID NO: 1199 - DNA, 1272 bp, Brachypodium distachyon
gcggcctctgtcttcaagcccacacacgaaatcaaaccacactcccacgcacccactggccaggggtggcgccgtgccagcgacacgggtctcgtccctttccccgccgtctccggcgtcgcatacccagatctcgtctccaccgtctgtctagtgaccgaggccatcctcatccccagctgattcgggatgggaagcagcacgagcaccttcgtcataaggtggattaacttcctcaccatggtacttgcaatacttgtggtgggttttgggttttggatgagcacccacaatgacgaatgcagacggtcgctgacgatccctgtcatggcccttggaggagtaatttttctcatgtcgcttgtgggatttgttggtgcttggaagaacattgcttgcttgctttggacatatctaataatgctattcgtggtcctggtggcaatcatggtgttcacagtgcttgcgtttatcatcacaaataccggaactggtcatgctgttccaggggccagatacaaagagtaccgtctgcaggattatagctcttggtttatcaaacagctcaatgacactgaaaagtggactagtctgagaagttgccttgtgaagtcggatgattgcaatagcttatcaaaaagatacaagactcttaagcaatacaggcttgctgatctgactcccattgaatccggttgttgccgcccaccggcagagtgtggatatccggctttgaatgcttccaattttgatttgagctatcatcctgtgagcacgaatgtcgactgcaaactgtacaaaaatgatcgatctatcaagtgctatgactgcaattcttgcaaagccggcgttgcacaatacatgaagaaagagtggcaagtggttgccatcttcaatgtgattttatttgttattttgtcattcgtgtactttgttgggtgctgcgcacggcgacacgctggaggcagcgattctaaagttcctttctgagatgaattccttctgtaatccagtgtcacagcaagagttagctttgccatcacttgtaataacattgttcaatcaagttcagttgatgaaatgcaagtcaagcctttttgttctttgttgaaattggattctagatatttacgaatacaaaaggagcctcctttctgaaatatacaatcgaattcatttagtttttgacaatgcagaggccaattctgacctctgtgaataaaacttgaagctgtttgccacttgtaagcaagctcaaagctttgtccactc

SEQ ID NO: 1200 - DNA, 2116 bp, Panicum virgatum
aaaggagtaaggacgtagccattctggcggcggccggaagaattgcttggtcggtcggcccgaggctgcaagacgtacgcggcttaatgtccatgcacagggatgtatagctttccaccaccgatatgcctatggcctctgggcactacagataccgttccccgtcgcagctcaacaacgcccccaaaactgagctgccaccatcccggccgcgcgaaacggcacgccgctcttgaatccgaccgggctcgggaaccgtcggctcaggcacgcggcccggccgcaggccgcacggagaaaagacacggccgcgcctagccgcctaccacgttcaaacccgacccggacgcgctcttgttcccttttccctcggccccaccaccgccccggccggaccatggtcaggcggcaggccggaccgaacacccatgctcactgctgcctgccagccgccgccagccaccccgacaccgcggccccgcgcgcgggggccccgcatgtcatcgtctccgctctttgtgtgtccccagcgcgacggcgcgagcaggtctgcaggccgctgctgatctgcgctcgtgcctggcttagctgcgactgttgtctttaagctcgcacgcgaaccgacccgcactgcgcgcaagccactgccaccgcccggcgccgccagccagcctccgcctccactccgctggtgccctgccctcctcccctgccctcgtgcccgggtcgccgtcttcgcagcagccgccgccgcctcgccagatcccgtcccgcgacgcggcgcggaatcccgtggcgctcccggcttgctggggaggatgggcagcaccagcgcgttcgtcatcaggtggatcaacttcttcaccatgatactggcactgctggtggtgggtttcgggttctggatgagcacccacaatgatgagtgcaggcggtccttgaccatccctgtcatagctctgggaggagtgatctttctcatatcactcatcggattccttggtgcttggaagaacatttcttgcttgctttggacatacctaatcatgttgtttgtggtcttggtggcaatcatggtgttcacagtgcttgcgtttataataaccaatacaggaactggccatgttgttcctggggctagatataaagagtaccgtcttcaagattacagctcctggtttgttaaacagctcaataacacggagaaatggactcacctgagaagttgccttgtgaagtcagatgactgcaataacctgtcaaaaagatacaagactctgaaacaatacaagcttgcagaacttactcccatggagtccggctgctgccgcccaccagcagagtgtgggtacccagctctgaatgcctcctatttcgatctgagctatcatccgatgagcaccaacattgactgcaaactgtacaagaatgcgcgctctgtcaggtgctacgactgtgattcttgcaaagctggggttgcgcagtacatgaagaccgagtggcgcgtggttgcaatctttaacgtgatattgttcgtcatcctgttgttcgtgtactttgtgggatgttgcgcgcggcggaacgctggaggtagcgatgcaaaaggtaatggaaggtgaaagaaacactatgtgggctgttgcccgcagcagaacgctggaggtagcaatgcaagaggttgtggaaggtgaaagaaaacacttcgaggtgacgcgcttggccatccgatgtggaagcaggaattagctttagcacccctgtaaaattgttccatcaaattcctttgatgaaaagatatttgggcttatctgctgtgtggtgatattctctgctgcaaatgggttgcgaacatcttgcagataaaattcattttgcctctgatttcatgacatttattttcaggatggaaagaactagaagctccagtgtctgatgcttattacaataatcatgataagtacacttactgtggcagtatgaagatcaacggatctcaaaattgagcattctttagtgataacaagaagccaaaacaagtagccaaaacaaatgcctaggtctgatacattccttcggatggaatgtcatgggcatctgcttccgtgcagcccgtgtg

SEQ ID NO: 1201 - DNA, 1726 bp, Setaria italica
cctctcccaccgacacctcggccccacaatcgtagggcccatgtgccatcgtctccgctccctgtgcccaccgcgacggcgcgagcaggtgcccagcccagcccgctgctgctgctgctcatctgcgcccgtgcctggcttagctgcgaccgttgtctttaagctcgcacgcgaaccgaaccccgatacactctgcgccaagccactgccactgcctccgccgccgccgccagcgtccgtctccaccggtgccctcgtccccggccgccgcctcgccagatcccgtccagtgacccggctggttgcggagcgaggggaggatgggcagcaccagcgggttcgtcatcaggtggatcaacttcttcaccatgatactggcactactggtggtgggtttcgggttctggatgagcacccacaacgatgagtgtaggcgatccttgaccatccctgtcatagcccttggaggagtgatctttctcatatcactcgttggattccttggtgcttggaagaacatttcttgcttgctttggacatacctaatcatgctgttcgtagtcttggtggcaatcatggtcttcacggtacttgcgtttatcataacaaatacaggaactggccatgttgttcctggggctaggtataaagagtaccgtcttcaggattacagctcctggtttctcaatgacactgagaaatggactcacctgagaagttgccttgtgaagtcagatgactgcaataacctgtcaaaaagatacaagactctgaaacaatacaagcttgcagaacttactcccatggagtccggttgctgctgcccaccagccgagtgtgggtacccagctctgaacgcgtcctatttcgatctgagctatcatccggtgagcaccaacatcgactgcaagctgtacaagaatgcacgctccgtcaagtgctacgactgtgattcttgcaaagctggggttgcgcagtacatgaagaccgagtggcgcgtggttgccatcttcaacgtgatattgttcgtcatcctgtcgttcgtgtacttcgtcggctgctgcgcgcggcggaacgctggaggtagcgatgcaaaaggtcgtggaaggtgacaaaaacactttgaggtgaagcacttggccatccgatgtggaagcgggaatcagctttagcacccctgtaaattgttccatcaaattcctttgatgaaagatacctgggcctttctgttgtgtggtgattattctctcttgcgaatgggttgtgaacatcttggaggtaaaaagaatggaatgacatttcctcatgacaattttgaggagacagagctagagaagctccggtgtctgatacttattacatttatcatgataagtacgcttactgtggcagtatgaagctcgatggatctcaaaattgaacattcttttggtgaagtaatcatgtctaagcaaatgaatggcgcgatacaaagccattatacgtataacgtgggcattaaatctccgccgagatgctttctagctgagtaactaaattaaaaatggttaataacgagtggccaaaacaaatgcctaaatctgatacattccttccaatggaatgtcaggaacatctgcttcagtgcagcccgtgagagttttcagatttatttgtcgctcacaagcgggctgtaaatagggtaccacattttccgagccacataatccaccgtttccaactgtca

SEQ ID NO: 1202 - DNA, 1105 bp, Pennisetum glaucum
cgccaccgccgccgccgccaccgctgatctccaccggtgccctcttccccggccgccgccttgtcggatcccgtcaagtgacccagctggttgcggagggagggaggggaggatgggcagcaccagcgggttcgtcatcaggtggatcaacttcttcaccatgatactggcactactggtggtgggtttcgggttctggatgagcacccacaacgatgagtgcaggcgatccttgaccgttcctgtcatagccctcggaggagcgatatttctcatatccctcgttggattccttggtgcttggaagaacatttcttgcttgctttggacatacctaatcatgctgttcgtggtcttggtggcaatcatggtcttcacggtgcttgcgtttatcataacaaatacaggaactggccatgttgttcctggggctagatataaagagtaccgtcttcaggattacagctcctggtttgtcaaacagctcaatgacactgagaaatggactcacctgagaagttgccttgtgaagtcagacgactgcaataacctgtcgaaaagatacaagactctgaaacaatacaagcttgcagaacttactcccgtggagtcaggttgctgccgccctccaacagagtgtgggtacccagctctgaatgcctcctatttcgatctgagctttcacccagtaagcaccaacatcgactgcaaattgtacaagaatgcaccctccgtcaagtgctacgactgtgattcttgcaaagctggggttgcgcagtacatgaagaccgagtggcgtgtggttgccatcttcaacgtgatattgttcgtcatcctgtcgttcgtgtacttcgtcggctgctgcgcgcggcggaacaccggaggtaacgatgcaaaaggtcgtggaaggtgacagaaacacttcgaggtgaagcgcgcttggccatccgatgtggaagcataaagtagatttagcacccctgtaaaaattgttccatcaaattccgttgatgaaagatacccgggcttatctgttgtgtggtgattattctgtcttgcaaatgggctgtgaacatcttgggtgtaaaagatggatgtcatttcc

SEQ ID NO: 1203 - DNA, 1735 bp, Panicum virgatum
  misc_feature (553)..(553): n is a, c, g, or t
  misc_feature (641)..(641): n is a, c, g, or t
aacaacgcccccaaaactgagctgccaccatcccggccgcgcgaaacggcacgccgctcttgaatccgaccgggctcgggaaccgtcggctcaggcacgcggcccggccgcaggccgcacggagaaaagacacggccgcgcctagccgcctaccacgttcaaacccgacccggacgcgctcttgttcccttttccctcggccccaccaccgccccggccggaccatggtcaggcggcaggccggaccgaacacccatgctcactgctgcctgccagccgccgccagccaccccgacaccgcggccccgcgcgcgggggccccgcatgtcatcgtctccgctctttgtgtgtccccagcgcgacggcgcgagcaggtctgcaggccgctgctgatctgcgctcgtgcctggcttagctgcgactgttgtctttaagctcgcacgcgaaccgacccgcactgcgcgcaagccactgccaccgcccggcgccgccagccagcctccgcctccactccgctggtgccctgccctcctcccctgccctcgtgcccggntcgccgtcttcgcagcagccgccgccgcctcgccagatcccgtcccgcgacgcgcgcggaatcccgtggcgctcccggcttgctgggnggatggcagcaccagcgcgtcgtcatcaggtggatcaacttcttcaccatgatactggcactgctggtggtgggttcgggttctggatgagcacccacaatgatgagtgcaggcggtccttgaccatccctgtcatagctctgggaggagtgatctttctcatatcactcatcggattccttggtgcttggaagaacatttcttgcttgctttggacatacctaatcatgttgttcgtggtcttggtggcaatcatggtgttcacagtgcttgcgtttataataaccaatacaggaactggccatgttgttcctggggctagatataaagagtaccgtcttcaagattacagctcctggtttgttaaacagctcaataacacggagaaatggactcactgagaagttgccttgtgaagtcagatgactgcaataacctgtcaaaaagatacaagactctgaaacaatacaagcttgcagaacttactcccatggagtccggctgctgccgcccaccagcagagtgtgggtacccagctctgaacgcctcctatttcgatctgagctatcatccggtgagcaccaacattgactgcaaactgtacaagaatgcgcgctctgtcagtgctacgactgtgattcttgcaaagctggggttgcgcagtacatgaagaccgagtggcgcgtggttgcaatctttaacgtgatattgttcgtcatcctgttgttcgtgtactttgtgggatgttgcgcgcggcggaacgctggaggtagcgatgcaaaaggtaatggaaggtgaaagaaacactatgtgggctgttgcccgcagcagaacgctggaggtagcaatgcaagaggttgtggaaggtgaaagaaaacacttcgaggtgacgcgcttggccatccgatgtggaagcaggaattagctttagcacccctgtaaaattgttccatcaaattcctttgatgaaaagatatttgggcttatctgctgtgtggtgatattctctgctgcaaatgggttgcgaacatcttgcagataaaattcattttgcctctgatttcatgacatttattttcaggatggaaagaact

SEQ ID NO: 1204 - DNA, 1609 bp, Oryza sativa
gaaagattagatttataaagttatcctgttggatcagaatcccgtgctctagtaatcctctttttatgaaaatctccgaccgttttcattccatatacaaaccgcggccaccgttcaaacaatcaaaccagcccaacaaaacaaaattgaataggaccacacgcagtcactcacgctcgccgccagcacacacctccgtgaagccggcgccacggtgaggcactgacgccgtgggcccacgagtctcccgggcccacgcgtcatcctctccatcccctcgtcgtcgtccgctcgcctctgcccccgtgccgaccttaactgccgccgttgtcttctcctccacccaaaagctcgcgaatcaatccacgcttcagagagagagagagagagagagaggcaggtggcgccgccgctgtcccgctcgtctccggtggccggcaggcggccgcagatctcgtctgtccaggatccagtgtgtgcggccgcgggccgccattgtttgggaggaggaggaggatgggtagtagcacaagcgccttcgtcatcaggtggatcaacttcttcaccatgatactggcactactggtggtggggttcgggttctggatgagcacccacaacgacgaatgcaggcggtccttgacgatccctgtcatgggtcttggaggagtaattttcctcatatcgctcgtggggtttcttggtgcttggaagaaaattgcttgcttgctatggacatatctggtaatgctgttcgtggttttggtggcaatcatggtgttcacagtgcttgcgtttattatcacaaataccggaactggccattctgtctctggggtgagatacaaagagtatcgtctgcaggattatagctcttggtttatcaaacagctgaatgacactgaaaaatggactcacctgagaagctgtcttgtgaaatcagatgattgtaatggcttgtcaagaagatacaagactctgaaacaatacaagcttgcagatcttactcctatggagtctggttgctgccgtccaccggcagagtgcgggtacccagctgtaaacgcttcctactttgatttgagctatcatccagtcagcacgaatgtcgactgcaaactgtacaaaaacgcacgctctgttctgtgctatgattgtgattcttgcaaagctggggttgctcaatacatgaaaacagagtggagggtggtagccatctttaacgtcatactgtttgtcatcttgtctttcgtctacttcgtcgcgtgctgtgcgcgccgaaacaccggagagagcgactccaaggttcctacaagatggcatgcatgattggcagatgaagcatcgtagagttagcttttgctattgcttgtagtggcattgttcagtcaagtctcgttggtgaaatggaatgcaagggcttttcctttctggtgtgggatgatgatgttctttgttgcagttggcttgtgaacattttaggaataagttcattttaggtcccttaactttacaccgaatccgattttcatccttcaacccaaaaaccagatacaatcggtccctgagctatcaaaaccggtgcaaacgaggtcccttggcggtttag

SEQ ID NO: 1205 - DNA, 1420 bp, Sorghum bicolor
ctcctcactcaccgctgccactgccagcttctgcagctcgcaccgctcccgtcccgtgtccgagtccaacacagcacgaggagcagccgacgccaccccgggcggtcgccctcccccaccgacaccgcgggcccgcacgcggaggccccacatgccaccgtcttctcttgttgccccaccgagcaggtggccttggctttagcttaagctgcgaccgttgcctttaagctcgcacgcgaaacgacccacacacactctgcgcgagccactgccgccgccgccgccgccgccgccttcggtgtccgtctccaccggtcggtgccgagctcgtctccccggccgccctcgcagcggcggcctgcctcgccagatcccgtccgagaatcccgtggcaatccggttgcttggggacggagggaggatgggcagcgccagcgcgttcgtcatcaggtggatcaacttcttcaccatgatactggcactactggtggtgggtttcgggttctggatgagcacccacaacgacgagtgcaggcggtccttgaccgtccctgtcattgctctcggtggagtgatctttctcatatcgctcgtcggattccttggtgcttggaagaacgtttcctgcttgctctggacatacctaatcatgctattcgtggtcttggtggcaatcatggtgttcacggtgcttgcgtttatcataacaaactctggaagtggtcatactgttcctggggcaaggtataaagagtatcgtcttcaggattacagctcctggtttgtcaaacagctcgatgacacagagaaatgggctcgcctgaaaagctgcctagtgaagacagatgactgcaataacttgtcgaaaagatacaagactgcaaaagaatacaagcttgcagaccttactcccatggagtcgggttgctgccgcccgccagcagagtgtgggtacccagctctgaatgcatcctatttcgatctgagctttcatccggtgagcaccaacgtcgactgcaaactgtacaagaacacccgatctgtcagatgctacgactgcaattcttgcaaagctggggtcgcgcagtacatgaagacagagtggcgagtggtggctatcttcaacgtgatattgttcgtcatcctgtcgttcgtgtacttcgttggctgctgtgcgcggcgaaacactggaggaagcgatgcgaaaggtcgtggcaggtgacagaaacacttcgaggtgaagcgcttggccatccgatgtgaagttagcttagcatcccctgtaaaattgttccatcaaactcctatattcctttgatgaagtacctggacctatcgctgcctagtaatagtgtgttgcaaatgagctgtgaacacgtttcttgttggtaaaaaagaatgtcattccgcttctgatctc

SEQ ID NO: 1206 - DNA, 1672 bp, Zea mays
accgctgccagcttctgcagctcgcaccgctcccgagtccgagtccaacaaggcttgagcagccgacgccaccccggtcggtcgacctccctctccccaccgacaccgcgggcccgcacgcagagaccccgcatgtcaccgtctacactcggtgacggcgcgagcaggtttccagccgcgagccccgcgactgatctgagctcgtgcctggctagctagtagatgtctccgaccgttgcctttaagctcgcacgcgaaccgtcccacactctgcgcaagccactgccgctgccgctgccgccgccgccgccgccttcagtctccgtctccaccggtgccctcgtctcccagccgctgccgccgccgccgccgccccgtgagagccggcgcagcaatccggttgcttggggacgcagcgaggatgggcagcaccagcgcgttcgtcatcaggtggatcaacttcttcaccatgatactggcgctactggtggtgggcttcgggttctggatgagcacccacgacgacgagtgcaggcggaccttgaccgtccccgtcatcgccctcggtggagtgatcttcctcatatcgctcgtcggattccttggtgcctggaagaacatctcctgcttgctctggacatatctgatcatgctgttcgtggtcttggtggcaatcatggtgttcacggtgctcgcgtttatcataacaaactccggaagtggccatactgttcctggggctaggtataaagagtaccgtctccaggactacagctcctggtttgtcaaacagctcgatgacacggagaaatgggctcgcctgaaaagctgcctggtgaagacagatgactgcaatagcctgtcgagaagatacaagaccgcgagagaatacaagctcgcggacctcactcccatggagtcgggttgctgccgcccgccagcagagtgcgggttcccagctctgaacgcgtcctatttcgatctgagctatcacccggcgagcgccaacgccgactgcaaactgtacaggaacgcgcgctctgtccggtgctacgactgcagctcttgcaaagctggtgtcgcgcagtacatgaagacggagtggcgagtggtggctatcttcaacgtgatattgttcgtcatcctgtcgttcgtgtacttcgttggctgctgcgcgcggcgaaacgctggaggaggcgacgcgaaaggccgtggcaggtgacgggatcacttcttcgaggtgaagtgaagcgcttggccatcctatgtggagttagttaagcttagtatcaacaccccccctgtaaaattgttccatcaaatattcaaagttcctttgatgaagtaccaggacctgtcgctgcctagtaatactctgttgcaaatgtgggctgtgtttcttggtggtaaaagggaatgtcatttcgctcagcaaatcgcgcatgcttttgcacggcagattatacttagacgtggcaggctgtggaataggaagtttgctagagatacgtgcagtgtgatgtgccaaatactgcaggtcttcactcttcagcaacgcccgtcagccaggtgttcagcaacagcagcgcggacgactgctgcgccgacacgtgcagtgatgtgcctaatactgcagggtttagtgcttgtaattggacgaccatcagtgtga

SEQ ID NO: 1207 - DNA, 1641 bp, Panicum virgatum
cggacggacgccctcttgtctgtctccttttccctctggccccaccgcctggccggaccatggccaggccgccaggcccgcgcacccatgctcaccggtcaccgctgccagccggcctctgccatccgcagccgccgccagccgcaccgagccgactccctctcccaccgacaccgcggccccgcgcgcggagggccccgcatgtcatcgactccactccctgcgtgtgtccccaccgcgactgcgcgagcaggtagccgctgctgatctgcgcccagcgcccgtgcctggcttagctgcgaccgttgtctttaagctcgcactgcgcgcaagccactgccaccgccgggcgccgccatcctccgcctccactctgccagtgccctgccctcctccccttttctcgagcccgggtcgccgtcttcgccgccgcttcgccagatcccgtcccgcgacgcggcgcggaatcccgtggcggtcccggcttgctgggggaggatgggcagcgccagcgctttcgtcatcaggtggatcaacttcttcaccatgatactggcattactggtggtgggtttcggattctggatgagcacccacaacgatgagtgcaggcggtccttgaccatccctgtcatagctctgggaggagtgatctttctcatatcgctcatcggattccttggtgcttggaagaacatttcttgcttgctttggacatacctaatcacgctgtttgtggtcttggtggcaatcatggtgttcacggtgcttgcgtttatcataaccaatacaggaactggccatgttgttcctggggctagatataaagagtaccgtcttcaagattacagctcttggtttgtcaaacagctcaataacacggagaaatggactcacctgagaagttgccttgtcaagtcagatgactgcaataatctgtcaaaaagatacaagactctgaaacaatacaagcttgcagaacttactcccatggaatctggctgctgccgcccaccagcagagtgtgggtacccagctctgaacgcctcctatttcgatctgagctatcatccagcgagcaccaacattgactgcaaactgtacaagaacgtacgctctgtcaggtgctacgactgtgattcttgcaaagctggggttgcacagtacatgaagaccgagtggcgtgtggtcgcaatcttcaacgtgatattgttcatcatcctgtcgttcgtgtactttgtgggctgctgcgcgcggcggaacgctggaggtagcaatgcaaaaggtagtggaaggggaaagaaacactctgtgggctgttgcggcggaatgatggaggtagcaatgcaaaaggtttgtggaaggtgaaataaaacacttcgaggtgaagcgcttggccatcagatgtggaagcaagatctagctttagcacccctgtaaaattgttccatcaaattcctttgatgaaaattatctgctgtgtggtgatattctctgttgcaaatgggttgcaaacatctcggagataaaaattcattttgcctctgatttcgtgacatttttttctggatggaaagaactagagaagctccagtgtctgatgcttattacaataatcatgataaatacacttactgtggc

SEQ ID NO: 1208 - DNA, 994 bp, Secale cereale
tccattgccttggaccggagagagagaggggaaagagaaaataagaggttagctaaaatggcaatggccacagcaaggctaatccacccatgcatggtggtgtccaagagcccaagagcgccaccagcacccttgttcctccacacccacaagcccctgaccaccgcactgacctcatctcacttcacgctccactccgtcgacgtctccaaggacgacaagccgctggacacggcgctcgagaccaaacaagaagatgcaaccgccgccggcggcgacctgacgacgccactgccgggtgagttggacgcggaggaggacgggccgaagcttgacccccgccggttcgaggagcagttcgcggtgttgaacacgggggtgcacgagtgccggtcctgcggctacctgtacgaccaggcgaagggagacccgtcctacccggtgcccccggggctgccgttctccaaggtcccggacgactggcggtgcccaacgtgcggcgcggcgcagtccttcttcgacagcaagagcgtcgagatcgccgggttcgcgcagaaccagcagttcgggctcggcggcaactcgctcacctctggccagaagacgctactcatctacggaagcctccttgtcggcttcgccttcttcctctccggctacttcttgcaatgagtacccagctaggcataccatcctttgatccattccaggaggcttcttgcaattagtgaagaggagaaactaagtaaggctgttaccgggttaatcttgataagtacttactgtactaaatttgtgtgtatagatacctattgcttctgctaccaagagcccctgcgaggggcgatgtatagcagaggggaaaagggacatttgtttgaggtgctggctataattttcttgtgaatgcagttcccagacaaaaaaaaaaaaactaaaaaaaaacaaaacgtgaatcacgacgacgcgtacaacgggagtaaggccgcccccc

SEQ ID NO: 1209 - DNA, 1042 bp, Triticum aestivum
gatggattccctcccctcacctccattaccttggaccggagagcgagagagaggaaagagaaaataaggggttagctaaaatggcaatggccacagcaaggctaatccacccatccatggtggtgtccaagagcccaagagcgccaccagcacccttgctcctccacacccataagcccctgaccaccgcactgacctcatcgtttcacttcacgctccactccgtcgacgtctccaaggacgacaagccgctggacacggcgctcgagaccaaacaagaagatgcaaccgccgccgccgccggcgacctggcgacgccactgccgggggagttggacgcggaggaggacaggccgaagcttgacccccgccggtttgaggagcagttcgcggtgctgaacacgggggtgcacgagtgccggtcctgcggctacctgtacgaccaggcgaagggagacccgtcctacccggtgccctcggggctgccgttcaacaagctgccggacgactggcggtgcccgacgtgcggcgcggcgcagtccttcttcgacagcaagagcgtcgagatcgccgggttcgcgcagaaccagcagttcgggctcggcggcaactcgctcacctctggccagaagacgctactcatctacggaagcctccttgtcggcttcgccttcttcctctccggctacttcttgcaatgagtaccgagctaggcatcatccttcctttgatccattccaggaggcttcttgcaattagtgaagaggagaaactgagtaaggctgttaccgggttaatcttgataagtactgtactaaatttgtgtgtatagatacctattgcttctgctacaaagcgcccagcgaggggcgatgtatagcagaggggaaatgggacatttgttttgaggtgctggctataattttcttgtgaatgcagttcgcggacaaatttggactagaattgcttcgagtggttaggcctgaatcccctctcgcaaggccactgttgaatatttgagcaatttttcatgaagtttaat

SEQ ID NO: 1210 - DNA, 821 bp, Pseudoroegneria spicata
catgcatggtggtgtccaagagcccaagaacaccaccagcacccttgctcctccacacccataagccgctgaccaccgcactgacctcatcgtctcacttcacgctccactccgtcgacgtctccaaggacgacaagccgctggacacggcgctcgagaccaaacaagaagatgcaaccgccgccgacgccggcgacctggcgacgccactgccgggggagttggacgcggaggaggacgggccgaagcttgacccccgccggttcgaggagcagttcgcggtgctgaacacgggggtgcacgagtgccggtcctgcggctacctgtacgaccaggcgaagggagacccgtcctacccggtgcccccggggctgccgttcgccaaggtcccggacgactggcggtgcccgacgtgcggcgcggcgcagtccttcttcgacagcaagagcgtcgagatcgccgggttcgcgcagaaccagcagttcgggctcggcggcaactcgctcacctctggccagaagacgctactcatctacgggagcctccttgtcggcttcgccttcttcctctccggctacttcttgcaatgagtaccgagctaggcatatcattcctttgatccattccaggaggcttcttgcaattagtgaagaggagaaactaagtaaggctgttaccgggttaatcttgataagtactgtactaaatttgtgtgtatagatacctattgcttctgctaccaggcgccgagcggggggcgatgtatagcagaggggaaaagggacatttgttttgaggtgctggctataattttcttgtga

SEQ ID NO: 1211 - DNA, 936 bp, Avena sativa
tactaacatctagacagggaggaggagatagaggttagctacaatggcattggccacagcaaggctaattcacccatgcactgtggtgtcgaagaacccgagaacgccacaaccaccctttttcatccacacccacaagcccctgactaccagactgacctcatcatctcacttctggctccagtccgtcgacgtatccaaggacgacaagccgctggacacagcggccgagaccaaacaagaagacttgtcagctccattgcggggggagctggacgaggaggatggcggggaaaagcttgacccccgccggttcgaggagcagtttgcggtgctgaacacgggagtgtacgagtgccagtcgtgcggctatatgtacgaccaggcggcaggtgacccgttctacccggtgccccgggggctgccgttcgccaagctccctgacgactggcgttgcccgacttgcggcgcggcgcagtccttcttcgacagcaagagcgtcgagatcgccgggttcgcgcagaaccagcagtttggcctcggtggtaactcgctcacctctggccagaagactctgctcatctacggaagcctccttgtcggcttcgccttctttctctccggctatttcttgcaataagaacacagctagctaggtatcatctattggtccattccaccccgcgttttggaattatggaagaggaggaaggttgttactggtgatgttgataattactgaatttgtgtgaataggtatgcatgtaccagagagagacatgcgcttgcttttgaggttaatggactataattttttagcatgggaatgcagttccgggaaaaatctaggctataattctgcgagtcttgtaatgggttaggacaggaattactattttgttcttgtgaaatttaatcctgcaccgttgcacacta

SEQ ID NO: 1212 - DNA, 708 bp, Pseudoroegneria spicata
gaggcaacaagggcaactctcatttcgccgctcaccgagccctcgaggcgcactatccatggccacctactacccttccggtgcttccgcgctcctgctccccgtcccgcgaactcgcgccgcctttccgcagaggtttcccggtccggcttccgggaggagctctccctgtgcagttgttcggcggcagcggaggggaaggggagcggttggtgtcgtgcgagcatgcttcaatccttttggggacgaacgcatcctccgggaggccttgaaggagccagttgcattcatgggtggcgtgtttgctggtctcttgaggcttgacctgaatgaggatcctctcaaggagtgggtaactcgaacggtagaggcttctggaatagctgaggagaacactaccgaggaatcaaatgagggagctcaaaatgatggaccccaacaaattgagattgagtgagctgtgcagggcctagcaggttgttgggcggcgctttccaactaataatcgaatgatggacaaggatctagctgcactggcctgaagggtatccttcgcttgtaagtttccggctgcaacttgcttgcgagctgtgttattatggttgtggaatggttggcattccagtgccactagctgttatcgtcgctgttttgaccaatgacgtgaacacaagtgataaatcattgcaactgttatctgcctgacga

SEQ ID NO: 1213 - DNA, 683 bp, Triticum aestivum
ctccagaaaagatcccctccgcccccgaccccgaggcaacaagggcagctcgcatttcgccgctcaccgagccctcgaggcgcgctatccatggccacgtactacccttccggcgcctccgcgctcctgctccccgtcccgcgaacccgcgccgccaggtttcccggtccggcttccgggaggagctctccctgtgcagctgttcggccgcagcggaggggaaggggagcggtgggcgtcgtgcgagcatgcttcaatcctttcggggacgaacgcatcctccgggaggccttgaaggagccagttgcattcatgggtggcgtgtttgctggtctcttgaggcttgacctgaatgaggatcctctcaaggagtgggtaactcgaacggtagaggcttctggaatagctgaagagaatagtgctgaggaatcagatgagggagctcaaaatgatggaccccaacaaattgagattgagtgaggtgcattagttgccttttgccctcctttacagccttacttgtaatttatcctgaatatttgtaatatctaagcaataaaatgcttgcccatatttttgtgtttatagtacagctctaagtcaaattattagcacattgtcattatttactaactttgcctcttcttagtgggtataacactaaatactacatcttattagtt

SEQ ID NO: 1214 - DNA, 521 bp, Secale cereale
ccgatttcgccgctcaccgagccctcgaggcgcgctatccatggccacctgctacccatccggcgcttccgcgctcctgctccccgccccgcgaacccgcgccgcctttccgcagaggtttgccggcccggcttccgggaggagctctccccgtgcagctgttcggcggcagcggacgggaaggggagcggtgggtgtggtgcgagcatgcttcaatcctttcggggacgaacgcatcctccgggaggcctttaaggagccagttgcattcatgggtggcgtgtttgctggtctcttgaggcttgacctgaatgaggatcctctcaaggagtgggtaactcgaacggtagaggcttctggaatagctgaagagaatagtgctgaggaatcaaatgagggagctcaaaatgatggaccccaacaaattgagattgagtgaggtgcattagttgccttttgcctcctttacagccttacctgtaacttgtcctgaatatttgtaatatctaagcaataaaatg

SEQ ID NO: 1215 - DNA, 795 bp, Triticum aestivum
ctctaagcgagacatagcattcgcgctgcacctctgcgttcgcccgcggctccagaaaagatcccctccgcctccgaccccgaggcaacaaggcagctcgcatttcgccgctcaccgagccctcgaggcgcgctatccatggccacctactgcccatccggcgcctccgcgctcctgctctccgccccgcgaacccgcgccgcctttccgcagaggtttcccggtccggcttccgggaggagctctccctgtgcagctgctcggcggcagaggagggggaggggagcggtgggtgccgtgcgagcatgcttcaatcctttcggggacgaacgcatcctccgggaggccttgaaggagccagttgcattcatgggtggcgtgtttgctggtctcttaaggcttgacctgaatgaggatcctcttaaggagtgggttactcgaacggtagaggcttctggaatagctgaggagaacagcaccgaggaatcaaatgagggagctcaaaatgatggaccccagcaaattgagattgagtgaggtgcattagttgccttttgccctcctttacagccttacttgtaacttatcctgaatatttgtaatatctaagcaataaaatgcttgcccatatttttgtgtttatagtacagctctaagtcaaaatattagcacattgtcattatttgcaaactgtgcctcttcttagtgggtataacactaatactacatcttattagttcccttcgtattttgggtcaaactttgaccatatatttaactagcaaaatgcaagtt

SEQ ID NO: 1216 - DNA, 477 bp, Secale cereale
ctacccttccggcgcctccgcgctcctgctgcccgtcccgcgaacccgcgccgcctttccgcagaggtttcccggtccggcttccgggaggagctctccccgtgcagctgttcggcagcagcggacgggaaggggagcggctggtgtcgtgcgagcatgcttcaatcctttcggggacgagcgcatcctccgggaggcctttaaggagccagttgcattcatgggtggcgtgtttgctggtctcttgaggcttgacctgaatgaggatcctctcaaggagtgggtaactcgaacggtagaggcttctggaatagctgaagagaatagtgctgaggaatcaaatgagggagctcaaaatgatggaccccaacaaattgagattgagtgaggtgcattagttgccttttgccctcctttacagccttacctgtaacttgtcctgaatatttgtaatatctaagcaataaaatgcttgcc

SEQ ID NO: 1217 - DNA, 917 bp, Brachypodium distachyon
aaaaaggctcccaaaagatcccctccgcctccgtcctcgagcgagccaacgcagcctcgcttttcgccgctctccgaccgctcgacgcacgttatccatggccacctgttatccttctggtgtttctgctctgctcctccccaacccgcgaactcccgcctccaggttttccggtccggcttccgggagcgttccatgtgcagtttttcgacgggagagtaggagaaggaaagcggtgggcatcgcgcgagcatgcttcaaccctttcggggacgagcgcatcctccgggaggccatgaaggagcctgttgcatttatgggtggcgtgtttgctggtctcttgaggcttgacctgaatgaagatcctctcaaggagtgggtcactcggacggtagaggcttctggaatagctgaggagaacagtaccgaggaatcaaacgagggagctcaaaatgatgcaccccaacaaatagagattgagtgaggtgcattgttgccttttgcgctctctacaccttcaccttgtaacttatcctgaatatttgtaatatctatgcaataaaatgcttgtttcaattttaatgtgttactacaaagtacagatttacgtctaaatattggcttgtcatcgttatttgcaaagtgtgtctaagtttgtataacactaacgagaagtttggattttttttcttagaataattaagaaaggacaaaagaaaaactcattgatatgcatgtctttttttatgcggggcattgatattattgtctatatttgtgaattgtggtaaaatgcttaaaagttctaaacaacgtcaaacttttgaagttcagacccataaattgcaataatttgttgagataatcgaaattctaaagggactgcacccacatatacctcgctctggatccgctac

SEQ ID NO: 1218 - DNA, 727 bp, Avena sativa
cgttggcctgctgctccaaggaaaaaatctcctccgcctccgtctcgagggctcgaggcaacaaggcagctcgcatttcgccgctcgctcgagggaggcgcgttatccatggccacctatagtccttccggtgcttccgctctcctcctccccgccccccggacttccgccaccaggtgtcccggcccatctttcagttccaggaggagctctccctgcgcagcggttcggcgggagaggaggagaaggggagcggtggttgccgtgcgagcatgcttcaatcctctcggggacgagcgcatcctccgggaggccttgaaggagccagttgcattcttgggtggcgtgtttgctggtctcttgaggcttgacctaaatgaggatcctctcaaggagtgggtaactcgaacggtagaggcttctggaatttctgaggagagcagtagtgaggaatcaaatgagggagctcaagacgacggaccccaacaaatcgagatcgagtgaggtgcattagttaccttttgcctcctttataccctgtaactcgtccagaatatctgtaatatctgagtaataaaatgcttgctccaattttaatgtgcagctttaagtaaaaacattagcacatcttccttgtctgcaaactgtaccagattcttagtgggtgtaacacaaataagaagttattgtgtgcagaacaaattgagcagaattcagaaaggaaaaa

SEQ ID NO: 1219 - DNA, 1665 bp, Triticum aestivum
cggcggcggcggcggttggccctctcgagtcatggtgctacccgccaccctctcgcgcgacgccggagctcactcgtgccctgcgcaggacggccagggggaagcggggccgccgcgcccgcgcagaccgcccgcgttctacagctccgtgttcgcgcagatcgaagaggtcgggtgggggcagctagtgagcgccacaggcgatgacggcgtgtcgtgcctcaccttccgcgtcgtggatgagcagcgacggcaacatttactggagatcacactgcccatgaactacccggcatgccctccttcaattgctgcggatgttccttatctccccaaattacagtggtcaaaaagctcaagactgaaggatgttctctgccagttccaagagcacctgaaggtattgcaagattactggtctacaatggatggcattgacaaggccctttgggttgtcgatcctacaaagccgacatatgctatgtctcatcatcgcatagctttgggtgatgattgctatattttactacatgttgatacgcacaagcccaactccttaccagagtgccgcttcctaggcacagatgggaaattggaaaggctgataaagaattggagaaaaaatcgtaagagatggagcgctgacagaaagttccatgaaaacctggcaaccgtcttagattttgctctgccgcaacccccttctgtgagtatcaaagatgaccagcaagctgattgtgggatatgttacgccacgcatctgcccgtcgatgacgaactcgggactcagagcgggtgcgcggcggactacaagtgcgaaaaccctagctgcagcagagccttccactccgtgtgcctgagagactggctgcgcaccattactacgacaaggcagtcgttcgatgttctgttcgggaactgcccttactgcagtgagcctgtcgccgtgaagagcaccgacagctgaacctgccttcttcgcatttacaaatcgagatgctgaagttgggttaatgtgagcggtttgtctggatataaactaagttatggaaactgtgtatgcttgtataatagtaggagtagcatgtttccaccttccagggtgtgctttccggtaatgaccttcaagcaggtgtggttccaggtttcaggcggaccagtaaaaaggaagagggacgaaataatctaggtcgcctgctgaaggccggtcgtcatgatctagatgtcatcaatggagctgcaaggggtcaaaattcccgtttgtttctacgaaattggcgtccacttctagagatgaaagaagtgtgccagcctaattactgaaaattggtgtctcttacgcacccttctagatttgggacgaatgaggaattgctgactggtataattacagtggtttggatctctgaatgtcaatgcgcattagtatttccattggttgctcgcctaacggtgacccttgaattagtttaccaattactcccccaagccgcctgatgagaaaataataccaagtactacctccgtcctgatttattagttcccgctgtattttgggtcaaagtttgatcatatcatataactagcaaaatattaatgcatgtcactgaaaattatgttgttggattcgtattcgaatgtagttttcaatgatattatttctgc

SEQ ID NO: 1220 - DNA, 1331 bp, Secale cereale
agacggctgcggcggcggttggcccgtctcgagtcatggtgctacccgccaacctctcgcgcgacgccggtgctcactcgtgccctgcgcaggacggccagggggaagcggggccgccgcgcccgcgcagaccgcccgcgttctacagctctgtgttcgcgcagatcgaagaggtcgggtgggggcagctggtgagcgccacaggcgacgacggcgtgtcgtgcctcaccttccgcgtcatggatgagcagcatcggcaccatttactggagatcacactgcccatgaactacccagcatgccctccttcaattgccgcggatgttccttatctccccaaattacagtggtaaaaaagctcaagactgaaggatgttctctgccagttccaagagcacctgaaggtattgcaagattactggtctacaatggatggcattgacaaggccctttgggttgtcgatcctacaaagccgacatatgctatgtctcatcgtcgcatagctttgggtgatgattgctatattttactacatgttgatatgcacaagcccaactccttaccagagtgccgcttcctaggcacaaatgggaaactgggaaggctgataaagaattggagaaaaaatcgtaagagatggagcgctgacagaaagttccacgaaaacctggcaaccgtcttagattttgctctgccgcaacccccttctatgagtatcaaagatgaccagcaagctgattgtgggatatgttacgccacccatctgccagtcgatgacgaactcgggactcagaacgggtgtgcggcgaactacaagtgcgaaaaccctagctgcagcagagccttccactccgtgtgcctgagggactggctgcgcaccattactacgacaaggcagtcgttcgatgttctgttcgggaactgcccctattgcagtgagcctgtcgccgtgaagggcaccgacagctgaacccgccttcttcgcatttacaaatcgagatgctgaagttgggttaatgtgagcggtttgtctggatataaactaagttatggaaactgtgtatgctttgtataatagtaggagtagcatgtttccaccttccagcgtgtgcttttcggtaatgaccttcaaagcaggtgtggttccaggtttcaggcggaccagtaaaaaggagagggacgaaataatctaggtcgcctgctgaaggccggtcgtcatgatctagatgtcatcaatggagctgcaagggtcaaattccaattgttactacgaaattggcgtccacttgtagagatagaaagagtgtgccagcctaatactagaaaattc

SEQ ID NO: 1221 - DNA, 1278 bp, Brachypodium distachyon
cgcgcgcggcggcggttggtcctctcgacgctcgagccatggtgctgccgaccactatctcgcgcgactccgaagctcgctcggctcctccgcaaaacttccaggaggaagcggagcccccgcgcccgcggaggccgcccgcgttctacagctccgtgttcgcgcagatcgaagaggtcgggtgggggcggctggtgaccgccactggtgatgacggtgtgtcctgcctcgccttccgcgtcatggatgagcaaggacgacaacatttactggaggtcacactgcccatgaattatcctgcatgtcctccttcaatttccgcggatgttccttgtcttccaaaattacagtggtcaaaactctcaagactgaaggatgttgtctgccaattccaagagcacctgaagaatttgcaaaattactggtgtacaatggatgacatcgataaggccctttgggttgttgatccaacaaagccgagctatgctatgtctcatcgtcgtattgctttgggtgatgattgctatatattactgcatgttgatgcacacaagcccagctccttaccagagtgccgcttcctgggcacagatgggaaactggaaaggctgataaagaattggagaaaaaatcgtaaaagatggactgcagacaagaagttccatgaaaacctgtcaaccgtcttagattttgaactgccacagcccccttctgtcagcatcaaagatgaccagcaagctgattgcgggatatgttatgccacccatctgcctattgatgacgaactggggactgacagcggatgcgcaacggactacacatgtgaaaactccagctgtgacagagctttccactctgtgtgtttgagagattggttgtgtacgattactacaacaaggcagtcgttcgatgttctgtttgggaactgcccgtattgcagtgagcctgttgctgtgaagatcgctgagcactaacttggcttcgcattttcaaagtgagacccgttgagttataaacttataatctatgttatgaaaacttgtattcatgtatagtagcttattttcgcctccaagcatatgcatctccttttaacaaaggttttagatggaacaaggacaaaaaaaagtggagccttacaaggaatggtcatctagaccgctacgtggacgcgttcatcaggttccgtaagaaattggtaaccatgatatactagacgtcttaatggagatgcagcagccaacaggtcgaaattgtccgtccgcttctagagatgaa

SEQ ID NO: 1222 - DNA, 841 bp, Triticum aestivum
ctgacacacaggcagcagcggcggcggcagcggaaccaagcatgtggtcgggagcggcagccgcggcggcgcgcaccgtgtccccgccgctccacgcgccgacgtccctgaccgggcggcgcggcgcggggcggccgtcgacggtgtcggtgcgcgcgggcggcggcgggctgatggacttcgtgggcggcgacctggtgaagccggacctggggcggtggctggacgacgtggaggagcacaaggcgctggccatctacccgccgcacgagggcggctacgagggccgctacctcaaccgcctccgctaccagggctactacttcctcgacctctccgcgcgcggcctcggcgaccccgagtccaccctcaccaagatccaccccgtctgcccgcctagcctcgggaggcagccggtggcgaggtggtacttcccgccggaggtggactacaggctcagcctgctgcacccggacgccaaagggctcatcgtctgggtctacgaggccaaggttctgtccaaggccgagctgcagttcctggccatgctccctgacctccgccccaaagtcagggtcatcgcggaatgcggcaactggagaaaattcatctggaaaccgctgaagcaaatatcgggcctcgagcctgatccggacgccgaggaatgaggagccaccctccggcggctgcctcgtctcatctctcgccttacactccgttttcagctttgtactaaagcaggacaatgatgtatgtacatacgtatacatttgacatctgggctcggttaattccacaagagaaccatcaatcgtgtaacacctttcaaacatacacatct

SEQ ID NO: 1223 - DNA, 906 bp, Avena sativa
ttcccgccacaggctgccgcggcaactcaacccacacacgcccgaacggtggcggcagcagcaggccagcagcagcagcgaaagtaaagcatgtggtcgggagcagcggcagccgcggcggcggcgcgtgcggtttccccgccgctccacgcgccgacgtcactgtccgggcggcgcggcgctgggcggccgtccacggtgtcgatgcgcgcgggcggcgggctgatggacttcgtgggcggcgacctggtgaagccggacctggggcggtggctggacgacgtggaggagcacaaggcgctggccgtgtactcgccgcacgagggcggctacgagggccgctacctgaaccgcctccgctaccaggggtactacttcctcgacctctccgcgcgcggcctcggcgaccccgagaccaccctcaccaagatccaccccgtctgcccgcctagcctcgggaggcagccggtggcgaggtggtacttcccgccggaggtggactacaggctcagcttgctgcaccccgacgccaaaggcctcgtcgtctgggtcctcgaagcaaaggttctgtccaaggccgagctgcagttcctggccatgctcccggacctccgccccaaagtcagggtgatcgcggaatgcggcaactggagaaaattcatctggaaaccgctgaagcaaatatcaggcctcgagcctgaccccgacgcggaacaatgagaaaaaccatcatgcggcggccggctacctcgtctcatctcttgacttacactctgtttccagctttgagcaagaaaggatgtacatacgtatacatttgacatttcggctcaaatttgacaggagaatcatcgatcatgtaaaacctttcaaatataaagatccaacaaatcgtaaaaaaaaaaa

SEQ ID NO: 1224 - DNA, 1760 bp, Brachypodium distachyon
acggctcgcccaacggacgagcggcgccgagacttatctcctcgcggttaccttcccgccacaggctctgccccgctgcgactcgcccggtcgccccacacaacccccaacgggcaacgccggcatccgcagcagctgcaacaaacaacatgtggtcaggatccgcgcctgccgcggcgcgcacggcgtccccgcggctcccggcgccgtcccactcttcgtcccggcgcgcggtccgtccgggattgtcgtcggtagtgcgcgcgggcggcggcggcggcgggctgatggacttcgtgggcggggacctggtgaagccggacctggggcggtggctggaggacgtggagaagcacaaggcgctggccatctacccgccgcacgagggcggctacgagggccgctacctcaaccgcctccgctaccagggctactacttcctcgacctctccgcccgtggcctcggcgacccggaatccaccctcaccaagatccaccccgtctgcccgcctagcctcgggaggcagccgatcgcgaggtggtacttcccccccgaggtggactacaggctcagcttgctgcacccggacgccaaaggcctcgtcgtctgggtcctcgaagccaaggttctgtccaaggctgagctgcagttcctcgcaatgctcccggatctccgccccaaagtcagggtcatcgcggaatgtggcaactggagaaaatttatatggaagccgctgaagcaaatatccggccttgaacctgatccggacgcggaacaatgagcaaccatcacacggcagttattctgaacctgaagacatacacctcgtctcatctctcgccttacgtgcattctcttttcagcttttatttttaccaaggatggcaagaaataatttgtacatatacattacggctcaaattccacgaggcaatcatgtacggagtagaacctttcaaatatacaggtccaataaatcattcatggtttacatacatcccgttacagagatgccttggtttcagattcagatgcatcgcatgcattgcccatttgcccaccacaaccaaaatgttaaattcagcgccgtaggtacacgaggtcggttctgagaaggaaagggtagccgatccctctcctcctggaagggaacatcacgaagaggaggctgaccacaaagcctaccacgaggggcacggtgttcaccaccttcctgggcacgccggggtagtagcaccggaccatgtcgtggtgcgaagcggcgaaggtggcgaacgcgaccagcgacagggcagtgtggaagaggtccgaccaccgcagcctgtacttctctggctccctcggtgccttcctccggtggccaccacagaatgtgcggatgcccgtcggagtggcgatgccatagcggaggcggcccgtggcggagcggaagctgtcggtgagcgtgaagaacacgcacgaggcggcgcagagcagcacgaacgcagcggtgaggatgcggttgacacgggtgcacttgccatcgtcggtgacgagaggcacgaagatggcgaatgtcaggatggtcgccgtcgggaggaggacattgagccgggccgtgccgctgaggaccaggttggcgagcaagatgaagctcgaagtgtcatcatcactgtcatcgtcttcttggtgtgggtcaccgtcggcgtctttgctggcttgctcgatgagcaccttgtattcttctccgtcagccattgacagtgcgtgtgcaagaacg

SEQ ID NO: 1225 - DNA, 985 bp, Setaria italica
gacaaacgactcctatccacacacgcacgcacgcacggtgaccaccgcagcagccagcatgtggtcggcaacggcggcgcgcgcggtggtgtccccgctcccggcgccgtcgctcctgggcggccgcgggcggcgcggcgggtcggcgcgcgggggcggcggccgggcggcgacggtgtcggtgcggagcacgctgtgggacttcgtgggcggggacctggtgaagcccgacatggcgcggtggctggacgacgtggagaagcacaaggcgctggcaatctacccgccccacgagggcggctacgagggccgctacctcaacaacctccgttaccagggctactacttcctcgacctcaccgcgcgcggcctcggcgacccggagaccacgctcaccaagatccaccccgtctgcccgccgagcctcgggaggcagccggtggcgaggtggtacttcccgccggaggtggactacaggctcagcctgctgcacccggacgccaagggcctcgtcgtctgggtcatcgaagccaaggttctatccaaggctgagcttcagttcctggccatgctcccggacctccgccccaaagtcagggtgattgcggaatgcggcaattggaggaaatttatttggaagccactgaagcaaatcgcaggccttgagcctgacccggacgcagaaaaatgaccaagctgacattttcaaggcaaccacagctacactcaaattgcttctcgatcatctctccgggcttgcatacttgcagcttcgtactgaaggagagagaattgaggatgtatatacgttttggctctgcgcggtcgcacaggccagaacctatttccattatctaaaaaaacatacggtttggcacaagtttcaggagagaaccacgtgaatttttccatgtatacaaattgaaagaatcacggttgcaatgtgttcaaacttgaagcaaattatagaaaatcgagtttttca

SEQ ID NO: 1226 - DNA, 981 bp, Secale cereale
cggtgtcggtccgcgcgggcggcggcgggctgatggacttcgtgggcggggacctggtgaagccggacctggggcggtggctggacgacgtggagaagcacaaggcgctggccatctacccgccgcacgagggcggctacgagggccgctacctcaaccgcctccgctaccagggctactacttcctcgacctctccgcgcgcggcctcggcgaccccgagtccaccctcaccaagatccaccccgtctgcccgcctagcctcgggaggcagccggtggcgaggtggtacttcccgccggaggtggactacaggctcagcctgctgcacccggacgccaaggggctcatcgtctgggtctacgaggccaaggttctgtccaaggctgagctgcagttcctggccatgctccccgacctccgccccaaagtcagggtgatcgcggaatgcggcaactggagaaaattcatctggaaaccgctgaagcaaatatcgggccttgagcctgatccggacgccgaggaatgaggagccaccatccggcagctgcctcggctcatctctcgccttgcactctgttttcagctttgtaccaaggagcacaagaaaggatgtacataagtatacattttggctcagttccacaagagaatcatcaatcgtgtaaagcctttcaaatatacagatccaacaaatcaaatcatatatgcaagctcacgcgcgttccgatacagtcagaggcctcagcttctggattcaggtccactgcacatgcccagcacagcacggcacggccaaaatgttcagcgacgcaggtacacgaggtcggtccctgagcaggaacgggtagccgatccccctcctcttggaagggaacgtcacgaagaggaggctgacgacgaagccgacgacggaggggcacggtgttcaaccaccttcctggacgcgccggggtagtagtaccggacgatgtcgtggtagg

SEQ ID NO: 1227 - DNA, 944 bp, Sorghum bicolor
cttcagtcttggtcgattcggctgacagaccaacggacagcctcgattgcagacttatccgcgacctcaccccacttccccacttcaccgcaagccatcttcccgccacatgctcaaaagcaagcgacttcccactcccatccacccacacgcgcacggccgcaggcagtagaagcagcaggatgtggtcggcagcagcggcggcggcgcgcgcggtgtccgtgcccgtgtctccggtcccggcgccctcgctcctcagcggccggcgcggcgggccgcggggcggccgtggcgcggtgtccgtgcgcagctcgttgctggacttcgtgggcggggacctggtgcggccggacctgggcaagtggctggacgacgtggagaagcacaaggcgctggccatctacccgccgcacgagggcggctacgagggccgctacctcaaccgcctccgctaccagggctactacttcctcgacctctccgcgcggggcctcggcgatccggagaccacgctcaccaagatccaccccgtctgcccgcctagcctcggcaggcagccggtggcgcggtggtacttcccgccggaggtggactacaggctcagcctgctgcacccagacgccaaaggcctcgtcgtctggatccacgaagccaaggttctgtccaaggctgagctgcagttcctggccatgctcccagacatccgtcccaaagtcagggtgctcgcagaagtcggcaactggagaagttttgtttggaagccactgaagcaaattgcaggccttgagcagaacccggacgcggaagaatgatcaagcgacatgtctggggcaactacagctacactcaaattgcttctgggatcgacatctctccctgccattcttgcagctttgcactgaatgagagaggcaattaataaagatgtgcatacattttggcac

SEQ ID NO: 1228 - DNA, 907 bp, Panicum virgatum
acacacacacaactcacacggcggccgcagcagccagcatgtggtcggtagcagcggtgcgcgcggtgtccccgctcccggcgccgtcgctccggggcggcggcgcggcgcgcgggggcggcggcggcagccgagcggcgacggtgtcggtgcggagcacgctgtgggacttcgtcggcggggacctggtgaagcccgacctcgggcagtggctggacgacgtggaggagcacaaggcgctggccatctacccgccgcacgagggcgggtacgagggccgctacctcaaccaactccgctacaagggctactacttcctcgacctctccgcgcgcggcctcggcgacccggagaccacgctcaccaagatccaccccgtctgcccgccgagcctcgggaggcagccggtggcgaggtggtacttcccgccggaggtggactacaggctcagcctgctgcacccggacgcccaaggcctcgtcgtctggatcatggaagccaaggttctgtccaaggctgagctgcagttcctggccatgctcccggatctccgcccaaaggtcagggtcatcgcagaatgcggcaactggagaaaatttgtgtggaagccactgaagcagatcgcgggcctcgagcccaacccggacgcgtaacaatgatcaagcagacattctcaaggcaaagtcacagctacactcaaattgcttcttcataatccctcccggcttccacggttttgtactaaggagaggcaatgaagtttgtacatacattttggcacaaatttcagtaaagaaccatgtaaattaaaattttccatacaagcaaatcaaacgaatcatggtcgcaatgcgttttaaacttgaagcaatgcacaaattgcagaggggttggacctatttttccc

SEQ ID NO: 1229 - DNA, 4606 bp, Oryza sativa
tccgcggagatcaccgctcagttgaacaaactgggcgcacgacaccgtctccgagtcttatccgctcaacgcggtcagtacgcgcgcggctgttatcttcccgccacaggctcaaacaaacgacacccacccacccacacacactacactacagcaaccagcgatgtggtcggcggcggcggcgcgcacggtgaccccgctgccggcggcgtcgcccctgcagcagcatcagcagcggcgcggggcgtgggcgcgggtgggcaatggtcgggcggcgagcacgacggcggcgcgggcagggctgtgggacttcgtgggaggggacctggtgaagccggacatggggcggtggctggacgacgtggagaagcacaagtcgctggccatctacccgccgcacgagggcggctacgagggccgctacctcagccgcctcagctaccagggctactacttcctcgacctctccgcccgcggcctcggcgaccccgagaccaccctcaccaagatccaccccgtctgcccgccgagcctcgggaggcagccggtggcgaggtggtacttcccgccggaggtggactacaggctcagcttgctgcacccggacgccaagggcctcgtcgtctgggtcatggaagccaaggttctctccaaggccgagctgcagttcctcgccattctccctgacatccgccccaaagtcagggtgatcgcggaatgcggcaactggaggaaatttgtgtggaagccgctgaagcaaatcgcgggccttgagccggaccctgacgcagaggaatgaacaagatcaagaccattaacaggcagcctgaaacaaagttacttgatatatatctcatccaacacacattgtttcccgctttgtacttcacttgagagaggcaatgaagaatgtacatacattttggctcaaattaccccaagacaaccatgtaaaatcaaactttcacataatacaaatccatcagaagaccatgcgatcctttcgtctcatcagcggcgtaggtagacaaggtcggtgctgagcaggaacgggtacccgattcccctcctcttggacgggaagagcacgaagaggaggctgaccacgaagccgatcacgaggggcaccgtgttcaccaccttcctgggcacgccggggtagtagcacagcacgatgtcgtggtgcgacgcggcgaacgtgacgaaggcgacgagggccagggcggtgtggaagaggtccgaccaccgcagcctgtacctctccggctccctcggccccgccttcccgccgccccgccggcgacgccggccgccgacgcagaacgtgcggatgccgctcgtcgtggcgatgccgtaccggaggcggccggtgggggagcggaagctgtcggtgagcgtgaagaagacgcaggaggcagcgcagaggagcatgagggcgccggtgagggcgcggttgaggcgggtgcacttgccgtcgtcggtgaggaggggcgcgaagatggcgaaggcgaggatggtggcggtggggaggaggacgttgagccgcgccgtgccgctcaggatgaggttggtcagcaggatgaggctcgagctatcgtcgtcgtcttcgtcttcgcagtcgtcgtcttggtgtggatcaccagcttcgttgctggcttgatcgatgagcaccttgcattcttctttctcagccattggtaggggctgtatgagtgtatgcacgagcttgttgggggacttgggatgatgagagaaggttagttaaaagagtgagctgaaacaactaaataaacaagaaactgaaaagaatccacctttcggtactcatgaacttaggcaaggaagaaaggattgcttcagcaagagtaccgagccaaccgaacctttgcccccacatagaagctaagaacatcacagcaacagataatgaaaatagatccagcagcctgaatgaaggggaggtaaaaaaaaaaggttcttgacggaaatcagcaatggtatcttcttggagttgctcttcctacttctaattgttcatttcaaagaatacaacagttccaaagaacggcatatgcatctatcagaccatcacccgggatttacatccaaaaaacctttttgattctaacccattctgggtatcttgagatgtataaggggtatctatccccaatctgtaccgatgtctcaaaaattacaggggagccgagcttttaccttataagacctaaagtacatctacaatttgtatggaatgaaagaatggctgggattgcttgcagttcgctggtcaaaatcattctgctgctcttggtgacctaagagggaggccttcagcagcagacctgagggggatgccttcagccgcatagccatcttcatccatatctttcgtcttgtgaagaagaaacgtcccagaaaggatggtaacaaaaccacacatctctgtcacaatttgagttggattttgacgatcccagtcctgcatgcaagtatattagttatccacaacacaacttgagcttgttcactaagcacagcaggtttccaccgctacatgtataactgataggacagtggacagcagtgatagtttatatttaagttttgcagactgcaagaagtattttatattttagtttatatttaagttagatgggacaggctgcaaggcataatattgaccacaaccacaaggctcaaaattatataaagattctatgtccatgtagcgtaacaattcagccaacagccaaatcaactgactagcaacaaagttaaggccctgtttagatcccaccccaaaatttttcaccctgtcacatcgaacgtttgaacacctgcatgaagtattaaatataggctaaaaaaaattaattgcacagattgcgactaatttgcgagacaaatcttttaaacctaattgctccatgatttgacaatgtggtgctacagtaaacatttgctaatgacggattaattaggcttaataaattcatcttgcggtttactgacggattctgtaattagtttttttattagtgtccgaaaaccccatgcgacaccctatataatacctagcgtgacacaccaaaactttacacccctggatctaaacactccttaatcaagttgaacaggtcaagcattgatagcaggattgcctagggaacttcaaaacaatagctttgtcatggatcatacagttggttcaatgtctacagcttcaaataataatcaaatttatcaggtaatggccagtaagtcagtgactgccctcaaaaacaaaatatttggggatgatatgagttggactaatcttgatagaagagaaggattgtaagtgttaactttgatgcctaactttccatgcaatcttagtcacaccacacattataaggagtttagtccactgccacagttgtggcttccagactctaagccatagctgtctcaacccatcatcacaaagttgggcataaaccaaacatgcattactggcactgagtacagctgtcagcaagctgagctcgagcaagcttaggtcccaggctcaagctccacataaactagagctgagctcaatctgagcctagactaaccttcaagcttgtaattagtctaagtttcgactcggatgaagctcaagcctgcttgagctcggctacacaaagctcggaatctcaccaggaccgcggtggtgatgatgcctggagatgtattatccagcagaccagcaggggagtaccctgctgccctggtcacactagcagctcacagaaggagaaatagagagaaggagcaaggagagtagacaggcggctgccaccggtatgaataagatgatgtgtggcatactggcatgcaactaggatgcattgcagatagctagcattactgcactagccttgggcttgacattgaggaattgaaaacttcaatgtagagcaggtaaagcatgagagattgacaggctatgagaagagcataatccttatgcatgcattagagcttggctcaatgcggagcacgagccttaggcttgatctcagttcgttttaggcttgagccaagcccagaacaagctgagctcgagtagctcacaagccttaagcaaagactgttaagtgccctcgagttttttttacagccttagcagagtactaagcacacaagtacatactccatattaactaggaaaatgtggtatagagtgaataggatcggtatttctgtactcatctagcaagaaatgccacttagtttctacagaaacatgtgcccttgtattatggggtggccacagaagcagatggccagaatggtaataaatttcagcagtgtatgcttcagcaaaatcttacagcatggtatttgtcccgacaatgctaatgatagaaatctcacaaaaaagttgaacaaatagaacggcgatgaggttcaggacaataggtgatactgtaaagagcggttcaagaatcaattgtacgtcacacgctcaaactattggagaaagaagggaaaataaatgagaaacatgaaggtgttaaagctcaattcctagtttctgatttgttctgatgagactcagttatctcccttattt

SEQ ID NO: 1230 - DNA, 2135 bp, Triticum aestivum
ccgcaaaacccagcggccaccaccatggcaccggccgccatggcgttccaggcgctcaccttctcgcccctccccctccacctccccgccacgcggcgccgggcccgcgtgctcgccgtggcggccgaccagacccctccgcccccgcaggcctccccgtccgagccggcgaacagcccgagccggctcctccgggagctcgcgcagcggaagaaggccgtctcgcccaagaagaagcacccgccgcggcggttcatcctcaagccgccgctcgacgacgagcgcctcacccagcggttcctcaacagcccgcagctgtcgctcaagtcgctgccgctgctctcctcctgcctcccctcctcgccgctctccgccgccgaccgcacctggatggacgagtacctcctcgaggccaagcaggcgctcggctacccgctcgccccctccgagacgctcggcgagggcgacgactgccccgcgcgccacttcgacgtcctcctctacctcgccttccagcacctggacccctcctccgagcgcacgcggacgcgccacgtgcggaacggccactccaggctgtggttcctgggccagttcgtgctggagctcgccttctgcgagttcttcctgcagaggtaccccagggagtcccctggcccgatgcgggagcgggtgttcgcgctcatcgggaagaagatgctgcccaaatggatcaaggcggcgagcctgcataatttggtgtttccttacgacgatttggataagatgatacggaaggacagggaaccgcccacgaaggctgtgttctgggcattatttggagctatatatctgtgctttggaatgcctgaagtctatcgtgttctctttgaggcgttcgggatggaccctgaagaagagagctgtcagccaaaactgcggcgtcaactagaagacgttgattatgtttcagtggagtttgagaagagacaactcgcatggcaagatgttgctgcctaccggccaccagcggatgctctttttgctcatcctaggcttttccgggcatgtgtgccaccaggcatgcatcgtttcagaggaaacatttgggattttgataatagacccaaaatcatgaacatcctaggataccccttgccagcgaatgataaaattccagaaattacagaagcaaggaatatagaacttggacttggcctccagctgtgcttcatgcatccctcaaagtacaagtttgagcatccaagattttgttttgagcgtctggaatatgttggtcagaagattcaggatctagtattggcagagaggctgctcatgaagcatctcgacgcacctggcaggtggttgtcagagaagcataggaggttgttgatgaacaagtattgcgggcggtacctgcgggacaagcaccttcaccactacattatatacggggagactgtacaggacagattcgaacacaaccgccggctgagaaatccttccacgactgccgtccagcaagcgatacatgggctctcgtactgcgtctacggcaaacctgatgtgcggcgcttgatgttcgaggtgtttgacttcgaacaggtccagccgaaagctgtatgaggaggatatgctccgtgtcggtttgtgctgaactgatgaccggcgagattgccagcgcttgaaggaaaaatgcagggtcatcaaaatcctagcgcggatcagatcgcgctgttccgaagcctgagcccaaagccggaccgtggattaaagcaagcactgcccgtccagcctcttctggacccccacagctcttgtaacctcttgtcttgcgtactagagataggcagctgtattagagatgattaaaattgaacgccgtagttttttcgaagttacagttttgagagttgactgtaaattccaatttgagcagaaacacaaacagctgcagctgcagcagcaggaagatatagagttatccgtgagaaacatgctttgtaatgttgtagccgaaaatgtgaatgcaacgtgtactgctaacgtgcaatgtcatttgtcatacgggtgcacaagtttatctcttttttctaacatagtacaatcgaagtcacttgttgggtgcataagtttatcctgtggaacttgtt

SEQ ID NO: 1231 - DNA, 2286 bp, Brachypodium distachyon
agatattttctcgcatttcgcacggctccgccagatctaagccatccaacataaaacggacggttcaacattggtccccttcctatcgttatcctcttctcttcttcctccctccagcccccagacccacaaaaccccaacccaagctcgcagtggccaccaccatggcgccacccgccatggcgtgccaagctctcacctacgcgcccctccccctccacctaccaaccgcgcggcgccgtgtccgggtccgcgttctcgccgtagccgccgaccagactcctgccccacaggcctccccatcttccgagccggcgaacagcccgagccggctcctccgggagctcgcggaacgaaagaaggctgtatccccgaaaaagaagcacccgccgcgccgcttcatcctgaagccgccgctcgacgacgagcgcctcacccagcggttcctcagcagcccgcagctgtcgctcaagtcgctcccgctcctctcctcctgcctcccctcctcgccgctctccgccgccgaccggacctggatggacgagtacctcctcgaggccaagcaggcgctcggctacccgctggctccctcggagacgctcggcgacggcgacgactgccccgcgcggcacttcgacgtcctgctctacctcgccttccagcacctggacccctcctgcgagcgcacgcggacgcgccacgtgcggaatggccactctaggctgtggttcctgggccagttcgtcttggagcttgcgttctccgagttcttcctgcagagataccccagggaatcccctggaccgatgcgagagagggtgttcgcattgattgggaagaggatgctaccaagatggctcaaagcggcaagcctgcataatttggtgtttccgtatgacaatttggatcggatgatacggaaagaccgggaaccaccgaccaaggctgtattctgggcactgtttggagctatatatttgtgctttggaatgcctgaagtctatcgtgttctttttgaggcgtttgggatggaccctgaagaagagagctgtcagccaaaactgcggcgccaactagaagatgttgattacgtttctgtggaatttgaaaagagacaactcacgtggcaagatgttgctgcctacaggccaccagcggatgctctttttgctcatcccaggcttttccgagcatgcgtgccaccaggaatgcatcgtttcagaggaaatatttgggactttgacaatagacccaaagtcatgaacatcctaggatatcccttgcctatgaatgatagaattccggaaatcacggaagcgaggaatatagaacttggacttggtcttcagttgtgcttcctgcatccctcaaagcataagtttgagcatccaagattttgtttcgagcgtcttgaatacgttggacagaagattcaggatcttgtattggcagagaggttgctcatgaagcaccttgacgcacccggcaggtggttgggggagaaacataggaggatgttgatgaacaagtattgcggacggtacctgcgggataagcaccttcaccactacattatttacggggagtctgtacaagacagattcgaacacaaccgccggctaagaaatccttccacgactgctgtccagcaagcgatacatggccttgcgtactgtgtctatggcaaacctgatgtgcgacgcttgatgtttgaggtgtttgactttgaacaagtccagccgaaagctatatgaagatgtgctccatccattttgcgcttgcttgctgagcagcgagattgccagcacttgagaagatgcagaatcgtcaaaatacaacacagatcatactgttccgaagtctgaaccagagtcagactgtggattaaacgctgcccatccggtctttttccgagcccacaactcttttaatctctttgtctactggatagcaagctggatcagagatgatgtaaaatcgaagtgtagattttggaagttacagttttgacagctggctggctgtcaatcccatttgagcagaaaaagcaaacagcagcagcagcaagaaatagagtatccgttagaaacatgctttgtagaggaagatgtcaatgtacgaatagcgtgtattggtggtgtcgtctgttatatgaaactcttttgcagctacgaatgtttcctttgttttagctgttggattacgaaaaactagcaaaagaactcgtgtgttgctatggaacaacggaaaattatatcaaaacgtcaaattaaatgttggaggtaa

SEQ ID NO: 1232 - DNA, 2233 bp, Oryza sativa
aaagcagatatttttccgtgtcgcaaagctcctccaatcgagaccgttgatcacgaaacggacggctcaaagttgttctccgcttatcctcttcctcttcttcttcctcaaacccgcaaaaccccaagccccgagctcacacaccaccaccaccgccatcgccatggcgccacctgccatggccttccaagctctcgctctcggccccctccccctccccctccccgcggcgcgtcgccgccgccgcgtgcgagtcctcgccgtggccgcagaccacaccccgccgccgccgccgtcgccgtcctcccctcccgagccggcgaacagcccgagccggctcctccgtgagctcgcggagcggaagaaggccgtgtccccgaagaagaagcacccgccgcggcgcttcatcctgaagccgccgctcgacgacgagcgcctcacccagcggttcctcagcagcccgcagctgtcgctcaaggcgctcccgctgctatcctcctgcctcccgtcggcgccgctctccgccgcagaccggacatggatggacgagtacctcctcgaggccaagcaggcgctgggctacccgctcgccccctccgagacgctcggggacggcgacgacgacggctgccccgcgcggcacttcgacgtgctgctctacctcgcgttccagcacctggacacgtcctgcgagcgcacgcggacgcggcacgtccggagtggccactccaggctctggttcctgggccagtacgtcctggagctcgcgttctgcgagttcttcctgcagaggtacccccgggaatcccccgggccgatgcgggagcgggtgttcgcgctgatcgggaagagagcgattcccaagtggatcaaggcagctagccttcacaatttggtgttcccttatgacgatttggataagatgattcggaaggaccgggagccaccagcaaaggctgtattctgggcactgtttggagctatatatttgtgctttggaatgcctgaagtctaccgtgttctttttgaggcgtttggcatggaccctgaagatgagagctgccagccaaagctgcggcgccaactagaagatgttgactatgtatcagtggagtttgaaaagagacaactcacatggcaagatgttgctgcctatcggccaccaccagatgccctctttgctcaccctaggctatttcgagcatgcgtgccaccaggcatgcatcgtttcagaggaaatatttgggattttgacaatagacccaaggtcatgaacacactgggatatccattgcctatgaatgatagaattccagaaatcacagaagcaaggaacatagagcttggacttggtcttcagttgtgcttcttgcatccctcaaagcataagtttgagcatccaagattttgtttagaacgcctggagtatgttggacagaaaattcaggatctagtgatggcggagaggctgctcatgaagcatctcgatgcacccggtaggtggttggcagagaagcatcggaggttgctaatgaacaaatactgcggacgatacctccgggacaagcacctgcaccactacattatctacggggagtcggtgcaagacagatttgaacacaaccgccggctgagaaatccttccacgaccgccgtccagcaagcaatacacggccttgcttactgcgtctatggcaaaccggatgtaaggcgattgatgttcgaggtgtttgacttcgaacaggtccagccaaaagcagtatgagggtggtcacaaaacctgtgcttgtgctgagctgctgatacgctgacattaccggcgtttgaaagctgaaatgcttcagtgttgtgacctgtgaacagatccaagcgcagacagttctgagtctgatccccgaagtcgaaaagcaggttaacacacgtaactcatgcaccctcgtttctacgagatgaactggattagagatgttgtaaatcgaacgctgttgttttctgaatttacagttttgacgatttgatgtaaatttccatttgagcagaaaatgcaagcagcatcagagacaaaaaacagcataggaagaatttttcctgtgaaacatgcttgtaaaggagtttgtaatagatctgcagaacatctttgcaaccaatgatacaagcagcttcatcttttacatatcagtgcgccattcttgtaagtgtagcagtcaatgaatgcatcatgtgtgttctctct

SEQ ID NO: 1233 - DNA, 2063 bp, Secale cereale
tggcccttgggcacgtcgtccaggaaccccacgcgggccaccacccatggcaccggccgccatggcgttccaggcgctcgccttcctcgcccctccccctcccacctccccgccacgcggcgccgggtccgcgtgctcgccgtggccgcggacccagacccctccgcccccgcaggcctcccctccgagccggcgaacagcccgagccggctcctccgggagctcgcgcagcggaagaaggccgtatcgcccaagaagaagcaccctccgcggcggttcatcctcaagccgccgctcgacgacgagcgcctcacccagcgcttcctcaacagcccgcagctgtcgctcaagtcgctgccgctcctctcctcatgcctcccctcggcgccgctctccgccgccgaccggacctggatggacgagtacctccttgaggccaagcaggcgctcggctacccgctcgccccctccgagacgctcggcgagggcgacgattgccccgcgcgccacttcgacgtcctcctctacctcgtcttccagcacctggacccctcctccgagcgcacgcggacgcgccacgtgcggaacggccactccaggctgtggttcctgggccagttcgtgctggagctcgccttctgcgagttcttcctgcagaggtaccccagggagtcccctgggccgatgcgggagcgggtcttcgcgctcatcgggaagaagatgctgcccaaatggatcaaggcggcgagcctgcataatttggtgtttccctacgacgatttggataagatgatacggaaggacagggaaccgcccacgaaggctgtgttctgggcattatttggagctatatatctgtgctttggaatgcctgaagtctatcgtgtcctctttgaggcgttcgggatggaccctgaagaagagagctgtcagccaaaactgcggcgtcaactagaagacgttgattatgtttcagtggagtttgaaaagagacaactcgcatggcaagatgttgctgcctaccggccaccagcggatgccctttttgctcatcctaggcttttccgagcatgcgtgccaccaggcatgcatcgtttcagaggaaacatttgggattttgataatagacccaaagtcatgaacattctaggatatcccttgcccgcgaatgataaaattccagaaattacagaagcaaggaatatagaacttggacttggcctccagctgtgcttcatgcatccctcgaagtacaagtttgagcatccaagattttgttttgagcgtctggaatacgttggtcagaagattcaggatctagtattggcagagaggctgctcatgaagcatctcgacgcacctggcaggtggctgtcagagaagcataggaggttgttgatgaacaagtattgcgggcggtacctgcgggacaagcacctccaccactacattatatacggggagactgtacaggacagattcgaacacaaccgccggctgagaaatccttccacgaccgccgtccagcaagcgatacacgggctctcgtactgcgtctacggcaaacctgatgtgcggcgcttgatgttcgaggtgtttgacttcgaacaggtccagccgaaagctgtatgaggaggacatgctccgtgtcggtttgtgctgaactgatgaccggcgagattgccagcgcttttgaagaagaaaatgcagggtcgtcaaaatcctagcgcggatcagaccgcgcagttctgaagcctgagcccaaagccggaccgtggattaaagcaagcactgcccgtccagcctcttctggacccccaaagctcttgtgtgatctcttgtcttgcgtactagataggcagctgtattagagatgatgtaaaatcggacgctgtagtttttcgaagttacagttttgagagttgactgtaaattccaatttgagcagaaacacaagcagctgctgctgcagcagcaggaagatatagagtcatccgtgagaaacatgctttgtaatgttgtagccgaaaatgtgaatgcagcgtgtactgctaacgtgcaat

SEQ ID NO: 1234 - DNA, 2331 bp, Panicum virgatum
agattttttttttcagcgctccccacagaaccaacccatctcaaccaccgatcaggagacgaacggctcatggctctcctccgcttatcctcttcctcctcttccccaactggccaactcccaccaaattccccgcaaaaccccagccggagctcgcggtcgccggtcgccaccaccaatggcgccacccgccatggcgttacaagcactcaccctcacgccgctccccctctcgctccccagctctcgccgccgcgtccgggtccgcgtcctcgccgtcgcggccgaccagacccctccgccgccgccggtgcccccatcggagccggcgaacagcccgagccgcctcctccgggagctcgcgcagcggaagaaggccgtatcccctaagaagaagcacccgccgcgccgctttatcctcaagccgccgctcgacgacgagcgcctcacccggcggttcctcagcagcccgcagctgtcgctcaaggcgctcccgctgctctcgtcctgcctcccctccgctccgctctccaccgccgacaggacctggatggacgagtacctcctcgaggccaagcaggcgctcgggtacccgctcgcgccctcggagacgctcggcgaaggcgatgactgccccgcgcgtcatttcgatgtgctgctctacctcgcattccagcatctggacccctcctgcgagcgcacgcggacgcggcacgtccggaacggccactccaggctctggttcctgggtcagtacgttctggagctcgctttctgcgagtttttcttgcaaaggtaccccagggagtcacccgggccgatgagggagcgggtgttcgctctgattgggaagaaggtgttgcccaaatggctcaaggcggccagcctgcacaacttggtgttcctttatgatgatttggataagatgatacgcaaggaccgggagccaccatccaaggctgtattctgggcattatttggggctatatatttgtgctttgggatgcccgaagtataccgagtcctttttgaggcatttgggatggaccctgacgatgagagctgtcagccaaaattgaggcgccaactagaagatgttgattatgtttcagtggagtttgaaaagagacaactcacgtggcaggatgttgctgcctacaggccaccaccagatgctcttttcgctcatccaaggcttttccgagcttgtgtgccaccaggcatgcatcgtttcagaggaaacatttgggattttgacagtagacccaaggtcatggacaccctaggatatcccttgcccatgaatgacagaattcccgaaatcacagaagcgaggaatatagagctcggacttggtcttcagctctgctttttgcacccgtcaaaacataagtttgaacatccaagattctgttttgagcgactcgaatatgtcggccagaagattcaggatcttgtgctggctgagaggctgctcatgaagcatctagatgcaccgggcaggtggttggcggagaagcataggaggatgttgatgaacaagtattgcggtagatacttgcgggacaagcacctgcaccactatgttatctatggggagtcagtgcaagacagattcgaacacaaccgacgtctcaggaatccttcaacaacctctgtccagcaagcattacacgggcttgcatactgtgtgtatggcaaacctgatgtgcggcgcttgatgtttgaggtgttcgacttcgaacaggttcagccaaaagcagtatgaggatgttctccatgggtatcgatgccgagttgctggccaacgagaccgccagtggcagtgacaaaaatactgcagcctcttgaagtaaaccaataggagatcgttctattctgaagcctgaaaccagagctgggagtctgagatggcagttgagccagtggggatctggaatcccgaattcgtcactttccaatcaattgtccgtccgcaatggtagaatagagatgttgcaaagcggcaactgcagcattttagagttactgtgttgacagctggttgtaaattactatttgagcaggaatgcaaacaggagcagcaccagcaacatgacggatttcttctcagaaaattttaatttgtatccgagagcagagcgatggataatacatacaagcatacagtttcatcagccatgttagtgcgtgtatttatgcagataattcagatgcgattatgatttagtttcgataccgaactgaatcgtgagtttgttggatggccgttttcttcggtggtgaattgaacaaacagctctaataagcttatcttttgtttcttttttt

SEQ ID NO: 1235 - DNA, 2221 bp, Setaria italica
agatattttttcccagagcgctccctgatccaagccatcacagccatcgatcgcaaaacggacagctcgtatttctcctccgcttatcctcttcctcctcttccccagccccaattcccccgcaaaaccccagccggagctcgcggtcgccggtcgccaccaccaatggcgccacccgccatggcgttccaagtcctcaccctcacgccactccccctctctctccccagctcgaaccgccgatttcgcgtccgcgtcctcgccgtcgcggccgaccagacccctccgccgccgccggtgcccccttcggagccggcgaacagccctagccgcctcctccgggagctcgcgcagcggaagaaggccgtatcccccaagaagaagcacccgccgcgccggttcatcctcaagcctccgctcgacgacgagcgcctcacccggcgtttcctcagcagcccgcagttgtcactcaaggcgctcccgctgctctcctcatgcctcccctccgcgccgctctccaccgccgacaggacctggatggacgagtacctcctcgaggccaagcaggcgctcgggtacccgctcgcgccctcggagacgctcggcgaaggtgatgactgccccgcccgtcatttcgatgtgctgctctacctcgcgttccagcatctggacccctcctgcgagcgcacgcggacgcggcacgtccggaacggccactccaggctctggttcctgggccagtacgtcctggagctcgcgttctgtgagttcttcttgcagaggtacccgagggaatcacccgggccgatgagggagcgggtgttcgctctgattgggaagaaggtgttgcccaaatggctcaaggcggccagcctgcacaacttggtgttcccttatgatgatttggataagatgatacgcaaggaccgggagccgccatccaaggctgtattctgggcattatttggggctatatatttgtgctttgggatgcccgaagtctatcgagtcctttttgaggcatttgggatggaccctgatgatgagagctgtcagccaaaattgaggcgccaactagaagatgttgattatgtctcagtggagtttgaaaagagacaactcacatggcaggatgttgctgcctacaggccaccaccagatgcccttttcgctcatccgaggcttttccgagcttgtgtgccaccaggcatgcatcgtttcagaggaaacatttgggattttgacagtagacccaaggtcatgaacaccctaggatatcccttgcccatgaatgacagaattcctgaaatcacagaagcaaggaatatagagcttggacttggtctacagctctgctttttgcacccgtcaaaacataagtttgagcatccaagattctgttttgagcgactcgaatatgttggccagaagattcaggatcttgtgctggctgagaggctgctcatgaagcatctagatgcaccaggcaggtggttggcggagaagcataggaggatgttgatgaacaagtattgcggacgatacctgcgggacaagcacctgcaccactacgttatctatggggaatcggtgcaagagaaatttgaacacaaccgacgtctcaggaatccttcaacaacctctgtccagcaagcgttacacgggcttgcatactgtgtgtatggcaaacctgacgtgcggcgcttgatgtttgaggtgtttgacttcgaacaggttcagccgaaagcagtatgaggatgttcgccatggtattgatgccgagttgctgaccaacaacaccgccagtggcaggggtaaaaatactgcagcctcaacaggagatctttccattctgaagcctgagactcgagctgggagcctagaacggcagatgagccagtggggatctggtctcctgagctgaatccgtcacttcccagccaattgtccgtctgagatggttagaatagagatgttgcgaatcgactgcagcattttggagttgcagctttgaaaattggttgtaaaatattatttgatcaggaatgcaaataggagcagcatcagcaacatgacagattcgtttcctgtcagaattttaatttgtaaccgagaagcagagcgcagagagaaggataatacacgcatacagtttcatcggccattttttgtgcgtgtatttatgcagataattcagttgcggctatgatttatttcgtca

SEQ ID NO: 1236 - DNA, 2266 bp, Sorghum bicolor
gaaggatagatattttttcccggctcgctcactgatccaccccatcgcagccatcgatcaagaaatgaacggctcataattctcgtccgcttatcctctccctcctcttccccaacttcaaccggcagtaccccgcaaaaccccacagccggagctcgcggtcgccggtcgccaccaccaatggggccacccgccatggcgttccaagccctcaccctcaccccagtccccttctcactccacagctcgagtcgccgcgtccgcgtccgcgtgcttgccgtcgcggctgaccagacccctccgccgccggcggtccccccttcggagccggcgaacagccctagccgcctccttcgggagctcgcgcagcggaagaaggccgtatcccctaagaagaagcacccgccgcgtcgcttcatcctgaagccacctctcgacgacgagcgcctcacccggcggttcctcagcagcccgcagctgtcgctcaaggcgctcccgctgctctcttcctgcctcccctccgcgccgctctccaccgccgacaggacctggatggacgagtacctcctagaggccaagcaggcgctcgggtacccgctcgcgccctcggagacgctcggcgaaggcgatgactgccccgcgcggcatttcgatgtgctgctctacctcgcgttccagcatctggacccctcctccgagcgcacgcggacgcggcacgtgcggaacggtcactccaggctctggttcctgggtcagtacgttctggagctcgcgttctgtgagttcttcttgcagaggtaccccagggagtctcctgggccgatgagggagcgggtgttcgctctgattgggaagaaggtgttgccccgatggctcaaggcagccagcctgcacaatttggtcttcccctatgatgatttggataagatgatacgtaaggaccgggagccgccgtccaaggctgtgttctgggcactatttggagctatatatttgtgctttggaatgcctgaagtctatcgtgtcctatttgaggcatttgggatggacccagacgatgagagctgtcagccaaaattgcgtcggcaactagaggatgttgattatgtttcagtggagtttgaaaagagacagctcacgtggcaggatgttgctgcctacaggccaccaccggatgctctttttgctcatcctaggcttttccgagcttgtgtgccaccaggcatgcatcgcttcagaggaaatatttgggattttgacagtagacccaaggtcatgaataccctaggatatcccttgcccatgaatgacagaattccagaaatcacagaagcaaggaatatagagcttggacttggtcttcagctgtgctttttgcacccgtcaaaacataagtttgagcatccaagattctgttatgagcgccttgaatatgtcggccagaaaattcaggatttagtaatggcagagaggctactcatgaagcacctcgatgcaccgggcaggtggctggcagaaaagcatcggaggacgttaatgaacaagtattgcggacggtacctgcgggacaagcacctgcagcactatattatttacggggagacagtgcaagacagattcgaacacaatcgacgtctaaggaatccttcaacgacctctgtccagcaagcgctacatgggcttgcatactgtgtgtatggcaaacctgacgtgcggcgcttgatgttcgaggtgtttgactttgaacaggttcagcctaaagcagtatgatgtgtttgacttcgaacagttcgaggtgctcgagttgctgaccaacaagaccgccaatggcagcggtaaaaatgctgtggcttctggaagtcatccatccgacaggagatattcagttctgaagcctgaagcatgaaccctgatctgaggccactgagtagccactgggtgcggcctctcctgaaactatcaccgttccaacctcctcgtccgtcggaaatggtagactagtgatgctgtaaatcggaagttgctgttctttgaacttacaattttgacaattagttgaattcctgtttgggcagaaacgcaaatagcagcagcatggcatattcatttcctatcagaattgtagtctgtaatcgagaagcagtgagatgaataatacaaagatattcattcgtccgcagtccgccacattattgcatgattcgtggttcgtgcatatataatgatataataatgtgattcgtgcatataatgatttctgttacac

SEQ ID NO: 1237 - DNA, 2380 bp, Panicum virgatum
cagtgttgtgcttagccacgtcatttcgaaggttagctgagatttttttcccagcgctccccacggaaccaattagcccatttcaaccaccgatgaagaaacgaacggctcatgattctcctccgcttatcctcttcctcctcttccccaactgggcaactcccacgaaattccccgcaaaaccccacagccggagcgcgcagtcgccggtcgccaccacaaatggcaccacccgccatggcgttccaagcgctcaccctcacgccactccccctctcgctccccaactctcgccgccgcgtccgggtccgcgtcctggctgtcgcggccgaccagacccctccgccgccgccggtcccctcatcggagccggcgaacagcccgaggcgcctcctccgggagctcgcgcagaggaagaaggccgtatcccctaagaagaagcacccgccgcgccgctttatcctcaagccgccgctcgacgacgagcgcctcacccggcggttcctcagcagcccgcagctgtcgctcaaggcgctcccgctgctctcgtcctgcctcccctccgccccgctctccaccgccgacaggacctggatggacgagtacctcctcgaggccaagcaggcgctcgggtacccgctcgcgccctcggagacgctcggcgaaggcgatgactgccccgcgcgtcatttcgatgtgctgctctacctcgcattccagcatctggacccctcctgcgagcgcacgcgcccgcggcacgtccggaacggccactccaggctctggttcctgggtcagtacgttctggagctcgctttctgcgagtttttcttgcaaaggtaccccagggagtcacccgggccgatgagggagcgggcgttcgctctgattgggaagaaggtgttgcccaaatggctcaaggcggccagcctgcacaatttggtgttcccttatgatgatttggataagatgatacgcaaggaccgggagccaccatccaaggctgtattctgggcattatttggggctatatatttgtgctttgggatgcccgaagtctatcgagtccttttcgaggcatttgggatggaccctgacgatgagagctgtcagccaaaattgaggcgccaactagaagatgttgattatgtttcggtggagtttgaaaagagacaactcacatggcaggacgttgctgcctacaggccaccaccagatgctcttttcgctcatccaaggcttttccgagcttgtgtgccaccaggcatgcatcgattcagaggaaacatctgggattttgacagtagacccaaggtcatggacaccctaggatatcccttgcccatgaatgacagaattcccgaaatcacagaagctaggaatatagagctcggacttggtcttcagctctgctttttgcacccgtcaaaacataagtttgagcatccaagattctgttttgagcgactcgaatatgtcggccagaagattcaggatcttgtgctggctgagaggctgctcatgaagcatctagatgcaccgggcaggtggctggcggagaagcataggaggatgttgatgaacaagtattgcggacgatacttgcgggacaagcacttgcaccactatgttatctatggggagtcagtgcaagacagattcgaacacaaccgacgtctcaggaatccttcgacaacttctgtccagcaagcgttacatgggcttgcatactgtgtgtatggcaaacctgacgtgcggcgcttgatgtttgaggtgttcgacttcgaacaggttcatccgaaagctgtatgaggatgttctccatgggtaatcgatgccaaatcgcttgccaagagactgccagtggcagtgctaaaaatactgcagcatcttgaagtgaaataataggagatcattctattctgaagcctgaaacctgagctgggagtctgggacagcagatgagccagtggggatctggaatcctgaattcggcactttccaatcaactgttcctccgcaatggtggaatagagatgttgcaacttgcaaatcggcaactgcagcatttagagttacagcttttacagttgtttgtaaattactatttgagcaggaatgcaaataggagcagcaccagcgatatgacggatttcctgtcagaaaagtttaatttgtaactgagagcagagtgatggattatacacatacagtttcatcggccatgtagggcgtgtatttatgcagataattcagttgcgaatatgatttaatttcgataccaaactgaatcgtgactttgctggatggccttttatttttgtggtcaattgagcaaacggctattaatctgcttgtcagcttgtgcagggtttttacc

SEQ ID NO: 1238 - DNA, 1683 bp, Secale cereale
cccctcccccgcacggcatcatcgctacccaccaaactcctcactccacccgtggaatctcgcctactttcccggctcagatccgatctcgtacgcgaaatggtgatcctttgtgctggccaccctgctccttcggttcattctgaatttctgtctcgatggctatcactcaacagtcccaaaatgccttacgctctgaactcaaccggaaggaaactcggaaagcaaaacagacatcggcggatgatcacttttgcaaaaagttcttcattacaagattcactggcctctgtaaagccatctcgtcttctgccgacagttgaaccaaaaacatttcccagtagtgtccctgatgagatactatcaaaactgagattggaagaatctgatgccttttacatactagagttgtgcacaagtagagaacttagttcctctttgctagataagaactccgcaatcttaatctgtttaattgatgttgacggtgactccttgttacaaagagtaccagcaatctatgggaaccaacctgcacatggcaccaaggcatcacaattcctcccctttcaaagtggttcagttgatataatcacctttaaaggtcccaaattgcagacaatcaaagaaatctggatcggccttgaatcaggttcatggagattagatggtttaagtttgaaagtgatccatggagcacggaatacacctgaagatcttgagggaacacttgagctcaagttcagcggtttacagtacatgttcgacaagctcggtgcgctgcttggtgaggatggagcttcagtagtggaagcaaggccaattgctgtgactgacctgtcaggaattagcatttctgatcttcaagaggggcagttatcctcagcaaggacagcctcaagcattaaggaattgaaggaagatggactgagggagtacgctgatctcaagcaatctttgctgctttacgacatatctattgttataacaggtttctctgccttcactctggcttcgaatgatggagcagcctactcgttccttgttggcgggattggagggttcctgtatctattgctgctccaaagatcagtggatgggttgccggcaattaattctccttcagaagcgagcagttcagagcccactgtgaatttcagcggcgtaagaaggccatggttgatattgtcgattgtaatggttgctggggctgttgcactgaagtacggtgctggtggtgacagcttcgagctgactccgactgagctctttgttggcgccgcagggttcctggcgaacaaggttgctgttcttctggctgcattcaaacccttgcaaagtaacttggagagtgacgatggatcagtggactgagcttcttgatgacattgctctgaatatactagcatagtgttaagaaaaatggggtaaaatgtagcaaggagtagcatttcagagtatctcggtcgcattcaagatctgaagctaagtatctcagagctagaatggaagagtgtatgcttgtcacttcagcctcttggtaacttcattcttgcacaaccacacaaagtttaaatctcttagcattcttttgagagttcaatcaagaactaaaaggtttggttagaataaaatacaataaaactacatttctggccattgtaatgctgctcaaactcgtaa

SEQ ID NO: 1239 - DNA, 1941 bp, Secale cereale
gactgccagatcttcctctactaccgctaccttcgtttctccccctcccccgcacggcagcatcgctacccaccaaactcctcactccacccgtggaatctcgcctactttcccggctcagatccgatctcgtacgcgaaatggtgatcctttgtgctggccaccctgctccttcggttcattctgaatttctgtctcgatggttatcactcaacagccccaaaatgccttacgctctgaactcagccggaaggaaactcggaaagcaaaacagacatcggcggatggtcacttttgcaaaaagttcttcattacaagattcagtggcctctgtaaagccatctcgtcttctgccgacagtcgaaccaaaaacatttcccaatagtgtccctgatgagatactatcaaaactgagattggaagaatctgatgccttctacatactagagttgtgcacaagtagagaacttagttcctctttgctagataagaactccgcaatcttaatctgtttaattgatgttaacggtgactccttgttacaaagagtaccagcaatctatgggaaccaacctgcacatggcaccaaggcatcacaattcctcccctttcaaaatggttcagttgatatcatcacctttaaaggtcccaaattgcagacaatcaaagaaatctggattggccttgaatcaggttcatggagattagacggtttaagtttgaaagcgatccatggagcatggaatacacctgaagatcttgagggaacacttgagctcaagttcagcggtttacagtacacgtttgacaagctcggtgcactgcttggtgaggatggagcttcggtagtggaagcaaggcctattgctgtcactgacctgtcagggattagcatttctgatcttcaagaggggcagctatcctcagcaaggacagcatcaagcattaaggaattgaaggaagatggactgagggagtatgctgatctcaagcaatccttgctgctttatgacatatctattgttataaccggtttctctgccttcactctggcttcgaatgatggagccgcctactcgttcctcgttggtgggattggagggttcctgtatctattgctgctccaaagatcagtggatgggttgccggcaattaattctccttcagaagcgagcagttcagagcccactgtgaatttcagcggcgtaagaaggccatggttgatattgtcgattgtaatggttgctggggctgttgcactgaagtacggtgctggtggtgacagcttcgagttgactccgactgagctctttgttggcgctgcagggttcctggccaacaaggttgctgttcttctggctgcattcaaacccttgcaaagtaacttggagagtgacaatggatcagtggactgagcttcttgatgacattgctctgaatatactagcatagtgttaaaaaaagggggtaagcaaggagtagcatttcagagtatctcggccgcattcaagatctgaagctaagtatctcagagctagaatggaagagtgtatgcttgtcacttcagcctcttggtaacttcattcttgcacaaccacacaagtttaaatctcttagcattcttttgagagtcaatcaagaacaaaaggtttggttgataaaatcataaaatacatttctggccattgtaatgctgctcaaactcgaattgttcagctctatcctacacaaagttgagtacttggctgcgctcaaaggcatgtagaccgtgacacctgaagatgccagatacctcaaatggttcaaatgtgactctcaaatgttcattcgggtgagctggtttggttactaactccaaacttatgatagttctagcattaccatatggtatatcgctgtaaataaattaatcgactgtcccgggcaattgggctgttagat

SEQ ID NO: 1240 - DNA, 2041 bp, Triticum aestivum
tcctctactaccgctacctcgtttctccccctctcctgcacggcagcgtcgttgcccaccaaactcctcactccacccgtggaatctcgcctactttcccggctcagatccgagctcgtacgcgaaatggtgatcctttgtgctggccaccctgctccttcggttcattctgaatttctatctcgatggctatcactcaacagccccaaaatgccttacgctctcaactcaaccggaaggaaactcagaaagcataacagacatcgggggatgaccacttttgcaaacagttcttcattacaagattcactggcctctgtaaagccatctcgtcttctgccgacagttgaaccaaaaacatttcccaatagtgtccctgatgagatactatcgaaactcagattggaagaatctgatgccttttacatactagagctgtgcacaagtggagaacttagttcctctttgcaagataagaactccgcaatcttagtctgcttaatcgatgttgagggtgactccttgttacaaagagtaccagcaatctatggggaccaacctgcatatggcaccaagacatcacaattcctcccctttcaaagtggttcagttgatatcatcacctttaaaggtcccaaattgcagacaatcaaagaaatctggatcggccttgaatcaggttcatggagattagatggtttaagtttgaaagtgatccatggagcacggaatacacctgaagatcttgagggaacacttgggctcaagttcagcggtttacagtacacgttcgacaagctcggtgcgctgcttggtgaggatggagcttcagtagtggaagcaaggccaattgctgtgactgacttctcaggaattagcatttctgatcttcaagaggggcagttatcctcagcaaggacagactcaagcattaaggaattgaaggaagatggactgagagagtatgctgatctcaagcaatccttgctgctttacgacatatctattgttataacaggtttctctgccttcactctggcttcgaatgatggagccgcctactcgttcctcgtcggcgggattggagggttcctgtatctattgctgctccaaagatctgtggacgggttaccggcaattagttctccttcagaagcgagcagttcagagcccagtatgaacttcagcggcgtaagaaggccatggttgatattgtcgattgtaatggttgctggggctgttgcactgaagtacggtgctggtggtgacagcttcgagctgactccgactgagctatttgttggcgctgcagggttcctggcgaacaaggttgctgttcttctggcagcattcaaacccttgcaaagtaatttggagagcgacgatggatctgtggactgagcttcttgacgacattgctctgaatatactagcataatgttaaaaaagggggtaaaatttaacagatgtagcatttcatagtagctcgacagcattcaagatcttaagctaagtatggaaagtgcaggggatcagctcagagatagaattgaagagcgtgtgcttgtaacttgagcctactagtaacttcattcgatcagcatgcacaaccacagaaattcatcccttagcatccttttgagtcagtcaagaacagatggtctggttgataaaatcataaaatacatttctggccgtgacacatggagatgccagatacctcaaatggttcaaatgttcattccggtgagatggtttggttactaactccaaacttatgatattaatagcattaccatatggtatatcgatgtaaattaattaaccgactgtcccgggcaattgggctgctaggtattacaatacagatgtctgcatagaaactggagttatatttgtcatatgttgaatgttcttacgattggaaataatagatagtatttcgatgtagtcaaagaaagaaaagacctagtacgtggtccgctcgtctgtacgactgaccgtacggaccgaacgtaaccgaagggggtaagtaagggga

SEQ ID NO: 1241 - DNA, 2183 bp, Triticum aestivum
tccccgttaaaggaccccggtttacctacgggaccggaaacgttaccgggggccctaacggccgacgtacggggtagttcaacgcacgagtacctcggggacggcctcctagtccttcctcacgacgcaactgaagccgtcgtctttgtactcttcttcttcttccccagatcttcctctactaccgctacctcgtttctccccctctcccgcacggcagcgtcgttgcccgccaaactcctcactccacccgtggaatctcgcctactttcccggctcagatccgagctcgtacgcgaaatggtgatcctttgtgctgcccaacctgctccttcggttcattctgaatttctgtctcgatggttatcactcaacagccccaaaatgccttacgctctcaactcaaccgcaacgaaactcagaaagcaaaacagacgtcggcggataattacttacgcgaaaagttcttcgttacaagattcagtggcctctgtaaagccatctcgtcttctgcccacagtggaaccaaaaacatttcccaatagtgtccctgatgagatactattaaaactcagattggaagaatctgatgccttttacatactagagctgtgcacaagtagagaacttagttcctctttgctagataagaactccgcgatcttagtctgcttaatcgatgttgacggtgactccttgctacaaagagtaccagcaatctatggggaccaacctgcacatgtcaccaagccgttacaattccttccttttcaaagtggttcagttgatatcgtcacctttaaaggtcccaaattgcaaacaattaaagaaatctggatcggccttgaatcaggttcatggagattagatggtttaagtttgaaagtgatccatggagcccggaatacacctgaagatcttgagggaacacttgagcccaagtttagcggtttacggtacacgttcgacaagctaggtgcactgcttggtgaggatggagcttcagtagtggaagcaaggcctactgctgtcactgacctgtcaggaattagcatttctgatcttcaagagggacagctatcctcagcaaagacagcctcaagcattaaggaattgaaggaagatggtctgagggagtatgctgatctcaagcaatccttgctgctttacgacatatctattgttataacaggtttctctgccttcactctggctttgaatgatggagccgcctactcgttcctcgtcggcgggattggagggttcctgtatctattgctgctccaaagatctgtggacgggttaccggcaattagttctccttcagaagcgagcagttcagagcccactatgaacttcagcggcgtaagaaggccatggttgatattgtcgattgtaatggttgctggggctgttgcactgaagtacggtgctggtggtgacagcttcgagctgactccgactgagctatttgttggcgctgcagggttcctggcgaacaaggttgctgttcttctggcagcattcaaacccttgcaaagtaatttggagagcgacgatggatctgtggactgagcttcttgacgacattgctctgaatatactagcataatgttaaaaaagggggtaaaatttaacagatgtagcatttcatagtagctcgacagcattcaagatcttaagctaagtatggaaagtgcaggggatcagctcagagatagaattgaagagcgtgtgcttgtaacttgagcctactagtaacttcattcgatcagcatgcacaaccacagaaattcatcccttagcatccttttgagtcagtcaagaacagatggtctggttgataaaatcataaaatacatttctggccgtgacacatggagatgccagatacctcaaatggttcaaatgttcattccggtgagatggtttggttactaactccaaacttatgatattaatagcattaccatatggtatatcgatgtaaattaattaaccgactgtcccgggcaattgggctgctaggtattacaatacagatgtctgcatagaaactggagttatatttgtcatatgttgaatgttcttacgattggaaatatagatgaattttcagtgtgttaaattaatatttgtgaattatacttgacatttaaacatgatattagtgatatatttca

SEQ ID NO: 1242 - DNA, 2067 bp, Triticum aestivum
gcccatttggcccgtcgcaagtagcttcccctgcgctgcacgcctctgttcccttcctcacgacgcaactgaagccgtcgtctttgtactcttcttcttcttccccagatcttcctctactaccgctacctcgtttctccccctctcccgcacggcagcgtcgttgcccgccaaactcctcactccacccgtggaatctcgcctactttcccggctcagatccgagctcgtacgcgaaatggtgatcctttgtgctgcccaacctgctccttcggttcattctgaatttctgtctcgatggttatcactcaacagccccaaaatgccttacgctctcaactcaaccggaaggaaactcagaaagcataacagacatcgggggatgaccacttttgcaaacagttcttcattacaagattcactggcctctgtaaagccatctcgtcttctgcccacagtggaaccaaaaacatttcccaatagtgtccctgatgagatactatcgaaactcagattggaagaatctgatgccttttacatactagagctgtgcacaagtggagaacttagttcctctttgcaagataagaactccgcaatcttagtctgcttaatcgatgttgagggtgactccttgttacaaagagtaccagcaatctatggggaccaacctgcatatggcaccaagacatcacaattcctccctttcaaagtggttcagttgatataatcacctttaaaggtcccaaattgcagacaatcaaagaaatctggatcggccttgaatcaggttcatggagattagatggtttaaatatgaaagtgatccatggagcacggaatacacctgaagatcttgagggaacacttgagctcaagttcagcggtttacagtacacgttcgacaagctcggtgcgctgcttggtgaggatggagcttcagtagtggaagcaaggccaattgctgtgactgacctgtcagggattagcatttctgatcttcaagaggggcagctatcctcagcaaggacagcctcaagcatcaaggaactgaaggaagatggactgagggagtatgctgatctcaagcaatccttgctgctttacgacatatctattgttataacaggtttctctgccttcactctggctttgaatgatggagccgcctactcgttcctcgtcggcgggattggagggttcctgtatctattgctgctccaaagatctgtggacgggttaccggcaattagttctccttcagaagcgagcagttcagagcccactatgaacttcagcggcgtaagaaggccatggttgatattgtcgattgtaatggttgctggggctgttgcactgaagtacggtgctggtggtgacagcttcgagctgactccgactgagctatttgttggcgccgcagggttcctggcgaacaaggttgctgttcttctggcagcattcaaacccttgcaaagtaatttggagagcgacgatggatctgtggactgagcttcttgacgacattgctctgaatatactagcataatgttaaaaaagggggtaaaatttaacagatgtagcatttcatagtagctcgacagcattcaagatcttaagctaagtatggaaagtgcaggggatcagctcagaggtagaattgaagagcgtgtgcttgtaacttgagcctactagtaacttcactccatcagcatgcacaaccacagaaattcatcccttagcatccttttgagtcagtcaagaacagatagtctggttgataaaatcataaaatacatttctggccgtgacacctggagatgccagatacctcaaatggttcaaatgttcattccggtgagatggtttggttactaactccaaacttattatagttctagcattaccatatggtatacgctgtaaataaactaatcgactgtcccgggcaattaagctgctagatattacaatacacatgtatgtatataaagtggagttatatttgttatatgttgaatgttcttatgattggaaatatagatgtattttcagagtgtaaaatta

SEQ ID NO: 1243 - DNA, 2103 bp, Brachypodium distachyon
ggaacataactcaagcgtctttcttcccgtccccaaaccctggttgcctctcacgtccgcttccctcccctcgcagtcacacggcagcatcaattcccaccaaatccctgacttaacccgtcgaataacaaatccctctctcagatccgagatctcgaggtccggtaagaaatggtgattctttgtaatgggcacgctgctccttcagttcatactgaatttatatctgggtggttatcactcaacacttccaaaatgcgttgtcgtttgaattcaactggaaggaaactccgaaaccgaaacaggcatcagaagatgatttcttttgcaaagagttcttcattacaagattcaatggcctctgtaaagccatctcgtcttctgccaacagttgaaccaagaacatttcccagtagtgtccctgaggagataatatcgagagtgagattacaagagtctgatgcattttatatgctagagcttagcacaagtagagaatttagctcctctttactagataagaacgccgcaatcttaatctgtttaattgatgttgacggtgactccttgttacaaagaataccagcaatctattgggatcaacctgcacaaagcatgaaggctttgcaaccgatccccttccaaagtggctcagttgacataatcacctttaagggtcccaaattgcagagaattaaagaagtctggataggcctcgagtcaggttcatggagattagatggtttgagtttgaaaatgatccatggaccattaaatacacctaatgaccttgaggtgacattggagctcaagtttaatggtttacagtacacatttgacagactcaatgctctgcttggtgaggatggagcttcagtagtggaagctaagcctatgtctctcactgacctgtcaggaattagcatttctgatcttcaagaagggcagttatcctcagcaagtacagcttcaagcattgtagaattggaggatggattgagagagtatgctgatctgaagcaatccttacttctttacgacatagctatcgtgataacaggtttctctgccttcaccctggcttcgaatgatgcagccgcctactcgttccttgtcggcgggattggagggttcctgtatctgttactgctccaaagatctgtcgatgggttgccggctaccagttctccttcagaagctggcagcccagagccctctgtaaaaggtttcagcggcgtacgaaggccatggttgatattgtcgctagcaatggttgctggagctgttgcactgaagtacggtgctggtggtgaaaccttcgagctgactccaaccgagctctttgtgggtgccgcagggttcctggcaaataagatttctgttcttctggcagcattcaaacccttgcagaccaacttgaaaagggaagatggatctggggactgactgaattagactactttgaatactagcacctttgtaatagcttaacagtgtccaagatcctaagctaattatcagaagtaacgaggggagcatgtatacttgccacttcagcctcatgataactcattgtgtcggcatggctgaagaattacacaaaccttctttcaaagcatccttgtaaagtcggccaagaacaagggtccagttataatattactcaagcttgcattgctcagctccagtttatggaaatttgagtattggactgggctcacaggaatgtagactgagacctggatgttccaaatgcctcagccagtccaaatgttcgttcaggtcacaagcttcaaatgtatgatagttctaccagaacaatgtggcatctttgtgtatataagttggctaacttcccggtgcagttgcactattgaataatattgaaagtacatatgtgcatattgaaaaacagagttctagtgctgatgactggaaatatagttatactatttcttatacaaccgtaatggttgtaatgtacatttttcttttgcgctgattgtgatgcactatatctgatttaatctgcaccattggactatgtatatctgattatcgtgctaattttgcaacttaattagactaaatcttgtgatttaa

SEQ ID NO: 1244 - DNA, 1719 bp, Triticum aestivum
catcatcggagtgcggcacgggtgcatacagagaggctagagaagaagagaggagtgaggtgcagccaagagaaaaagagatggagaccaaggcggcgaggtgcctctgcttgctggcgatgctcctggtggccgggctcggggcggcgcgcggcgccggggagtgcggccgcgtgccggcggacaggatggcgctcaagctggccccgtgcgcggcggccacccagaaccccggggccaaggtggcgcccggctgctgcgcgcagatacgcagcatcgggcgcagccccaagtgcctgtgcgccgtcatgctgtccgccaccgcgcgccaggccggcgtcaagcccgccgtcgccatgaccatccccaagcgctgcgccatcgccaaccgccccatcggctacaaatgcggcccatacaccctgccatgaggagcacatgtggtggaactggaagagctttccaactcttggaacatatggaagagcagatgacatacacctgatgccatctttgtcatgtggaacttttacttgaatcttttatgaataaataatgtggttgtaatgcctctgttggaatatataatataatgaagtaccttcccaaatcttatggtatattgacaagaacacttcccaaacttatatgaagttccaacagtaccgttttaatagtacaatgtaaatgatctctgcttctccagcgcttctggtctggagagaggatcagacggtacaagcaggacaggtttgatactatgtataggagtcagagaccagactgcccaggttgggcggaatggaatagggaccctttatgcaacctgacaccaagttctaggtacttgtaggttcattacatttcacagctaaagcacaagctatggaataagaagaaggtaaaggcacacacagacacacacacagcatctgcccaggagtgatgatgcatccaaatactgccaccaccgatgagcgaatgtttctccactatgtaaggtatataactgctatcaaggaaattaggttccacacctctccccttcgatttccttgttcgaaaagggagaggacaccaagctcttgcttagtagtaaaacgagccttgccaccaatcgccatgagaatctgcgacaggatccttcttatccaccttgtaatcactgtattccgcggattgcttaggtgcagagctgccataatattctcggccaccatagtgcacagaagaaccaaaacaagatgatgtaccaaccgagtcatacttgatatccttggtatatgttgtgcggcccctagcaggactccactgggatttaccatctgtcatgctagcctgagcattgccgttctgccccttgaagagaatggcgtacaagtcctgctctttgccgtttaccccgtgcggcgccgggtggaacaggctgctgagcggcgagtcggcgatggcggcgtcggcggcggcagcgcggggaggcgacttcttagtcgccgcgcgcggctggggctgcgcctggggcgaggacctcttgggctccatttcgggggacggacggacggacggagaggaggagctgccgctgaggattagggcacgtgaacggggcggttgtgtcgtaggcggcggcgggaggagggaggaggagacggggagtctaggcaagcgctactgctcaactactcgactcgtggcggtctcctcctccctcctcccgcc

SEQ ID NO: 1245 - DNA, 1645 bp, Triticum aestivum
gaaagagaaccgtgaagcgtagctgcagctgaggagagatggagtccaaggcggcgaggtgcctctgcatgctggcgatgctcctggtggccgggctcggggcggcgcgcggcgccggggagtgcggccgcgtcccggcggacaggatggcgctcaagctggccccgtgcgcggcggccacgcagaacccgcgggccaaggtggcgcccggctgctgcgcgcagatacgcagcatcgggcgcagccccaagtgcctgtgcgccgtcatgctgtccagcaccgcccgccaggccggcgtcaagcccgccgtcgcgatgaccatccccaagcgctgcgccctcgccaaccgccccatcggctacaaatgcggcccatacaccctgccatgaggagcagatgtggtggaactggaagatctttccaactcttggaacttctggaagagcagatggcacacacctgatgccatctttgccatgtggaacttttacttgaatcttttatgaataaataatgtggttgtaatgcctctgttggaatataatataatgaagtacctttgcaaatcttatggtatattgacaaaaacacttcccaaacttatatatgaagttccaacagtacatttttaatagtacaatgtaaatgatctctgcttctccagcgcttctggtctggagagaggatcagacggtacaagcagcacaggtttggtactatgtataggagtcatcagagaccagactgcccaggttaggcggaatggcctcgggaccctttatgcaacctgacaccaagttctaggtacttgtaggttcattacatttcacagctaaagcacaagctatggaataagaaggtaaaggcacacacacgcgcacacagcatctgcccaggagtgatgatgcgtccaaatactgccaccaccgatgagcgaatgtttctccactatgtaaggtatataactgctataaaggaaattaggttcaacagctcccccttcgatttccttgttcgaaaagggagaggacaccaagctcttgcttagtagtaaaacgagccttgccaccaatcgccatgagaatctgcgacaggatccttcttatccaccttgtaatcactgtattccgcagcttgcttgggtgcagagcagccataatattctcggccaccatagtgcacagaagaaccaaaacaagacgatgtaccaaccgagtcatacttgttatccttggtatatgttgtgcggcccctagcaggactccactgggatttaccatctgtcatgctggcctgagcattgccgttctgccccttgaaaagaatggcgtacaagtcctgctctttgccgtttaccccgtgcggcgccgggtggaacaggctgctgagcggcgagtcggcgacggcgtcggcggcggcggcggcgcggggaggcgacttcttagtcgccgcgcgcggctgcggctgggcctggggcgaggacctcttgggctccatttcgggggacggacggacgggcggatggggagggggagctgccgctggggattagggcacgtgaacggggcggttgtgccgtaggcggcggcgggaggagggaggaggagacggggagtccaggcaagcgctactgctcaactactcg

SEQ ID NO: 1246 - DNA, 1166 bp, Secale cereale
agcagtagcgcttgcctagcctccccgtctcctcctcccgccgccgcctacgacacaaccgccccgttcacgtgccctaatcctcagcggcagctctcctctccatccatcccccgaaatggagcccaagaggtcctcgccccaggcgcagccccagccgcgcgcggcgactaagaagtcgcctccccgcgccaccgccgccgccggggccgactcgccgctcagcagcctgttccacccggcgccgtacggggtaaatggcaaagagcaggacttgtacgccattcttttcaaggggcagaacggcaatgctcaggctagcatgacagatggtaaatcccagtggagtcctgctaggggccgcacaacatataccaaggataacaagtatgactcggttggtacatcatcttgttttggttcttctgtgcactatggtggccgagaatattatggcagctccgcacctaagcaagccgcggaatacagtgattacaaggtggataagaaggatcctgtcgctgattctcatggtgattggtggcaaggctcgttttactactaagcaaaagcttggtgtcctctcccttttcgaacaaggaaatcgaagggggaagaggtgttgaacctaatttccttgatagcagttatataccttacatagtggagaaacattcgctcatcggtggtggcagtatttggacgcatcatcactcctgggcagatgctgtgtgtgtgcctttaccttctttttattccatagcttgtgctttagctgtgaagtgtaatgaagttacaagtaccttaagatctactaggtgtcaggttgcataaagggtcccgaggccgttccgcccaacatgggcagtctggtctctgactcctatacatagtatcaaacctggcttgcttgtactgtcggatcctctccccagaccagaagcgctggaggagcagagatcatttacattgtactattaaaactgtactgttggaatttcatataagtttgggaagtgttcttgtcaatatatcatactgtgaaaatttaaaggaaaaaaaaaaaaaaaaaaaagaaaaaaaaaaaaaagaaaaaaaaaaaaaactaaaaagtagaactaagtacgaacgaacgacaacaagggagtaagagagggggggggggg

SEQ ID NO: 1247 - DNA, 1059 bp, Secale cereale
agcagtagcgcttgcctagcctccccgtctcctcctccctcccgccgccgcctacgacacaaccgccccgttcacgtgccctaatcctcagcggcagctctcctctccatccatcccccgaaatggagcccaagaggtcctcgccccaggcgcagccccagccgcgcgcggcgactaagaagtcgcctccccgcgccgccgccgccgccgccgtggacgccgtcgccgccggagccgactcgccgctcagcagcctgttccacccggcgccgtacggggtaaatggcaaagagcaggacttgtacgccattcttttcaaggggcagaacggcaatgctcaggctagcatgacagatggtaaatcccagtggagtcctgctaggggccgcacagcatatagcaaggataacaagtatgactcggttggaacatcatcttgttttggttcttctgtgcactatggtggccgagaatattatggcagctctgcacctaagcaagccgcggaatacagtgattacaaggtggataagaaggatcctgtctccgattctcatggcgattggtggcaaggctcattttactactaagcaagagcttggtgtcctctcccttttcgaacaaggaaatcgaagggggaagaggtgttgaacctaatttccttgatagcagttatataccttacatagtggagaaaacattcgctcatcggtggtggcagtatttggacgcatcatcactcctgggcagatgctgtgtgtgtgtgcctttaccttcttcttattccatagcttgtgctttagctgtgaagtgtaatgaagttacaagtaccttaagatctactaggtgtcaggttgcataaagggtcccgaggccattccgcccaacctgggcagtctggtctctgactcctatacatagtatcaaacctgtcttgcttgtatcgtcggatcctctccccagaccagaagcgctggaggagcagagatcatttacattgtactattaaaactgtactgttggaatttcatataagtttggaaagtgttcttgtcaata

SEQ ID NO: 1248 - DNA, 1699 bp, Avena sativa
ccaaaactcaaaatttaggctaccacgtagcctcgaagtctcgagctttcgcttttctcatctcgtcggcggccatggcagacgacgacgactgccctcccctcgccgtcgaactcccgccgcagacgacctctcctctggctcccgcttcctcctctgcctccgttccggtcggcgtcaccgtcatcaccggctacctcggcgccgggaagtccacgttagtcaactacattttgagtgcgcaacacgggaagagaatagcagtaatactgaacgagttcggagaggaaattggagtagaaagagcaatgatcaatgaggggcaaggtggtgcccttgttgaggagtgggtggagctagcaaatggatgcgtctgttgcactgtaaaacacagcctggttcaagcacttgagcaacttgtgcagagtaaggaaagaatggatcacatactattggagacaactggtttggctgatcctgcaccacttgtctccattctctggctggacgatcagttggagtcatcaatcagactagactctatcattacggttattgatgcaaaaaacttcaggcggcaaattgatgaacacacaaactcttcctcatttcccgaagcatttcatcaaattgcatttgcggatgttgtgatattgaacaaaattgatttagtaaaagacgatctcgaggatttggaaaggaaaattcatgacgtcaatgctcttgttacagtggtgcggtctgtccgatgccagttgacttaaatacaatatttgatcacagcatatggtgtaaagaattcatcgcaagtacaggagcttctggaatacagtaaatcagcgccacccaatagtcgtcatgataacagtatttccaccttgtgcatttcagaaaaagatccagtttacttggctaaggtggaatcatggcttgaagatcttctttgggagaagaagtctaacatggacatataccgttgcaaagggatcttacatatccataattcgaaccaacttcatacattacaggcagtgagggaagtctacgaggtagtcccggcccgggaatggtctgatacacaatctcgtacgaacaagatagttttcataggccgtgatttggatatcagcattcttcaagattcatttagtcgctgcaagcagtgatttatcgaatgatttgcacgacgttttgtacctccctgtcatacaatattggaggctcacatagcctagactcagattaaggggttttatatggttcgcagaagttacattccgttgaacaatcatcagttgaggcaaatcaatttgcaattcctagatcaagagactattccaaactatttttgtgatgttctgcgccacggaagcacctttctggtacacttagttaaaaagacattctgatgagtatctgtatatgctcaacagggggtgcaactgtgctaagttttctagaagaaaaaacgtatccaatcgtaagacgatgttatctgtggaaggattctagttctattaatattcaaagcaaacgatgttacctgtggaaggattctagttctattaatattcaaagcaaagtgatgaacaacatactgggaggccttgaatcgaagtttccttccagaattcttggcttccttgtcctcccagtctgtaccatgcagagcagaatatagctactcccttgttgtacc

SEQ ID NO: 1249 - DNA, 1432 bp, Triticum aestivum
cagacgacctctcctctggttcccgcttcctcctccgcctctgcgccggtcggcgtcaccgtcatcaccggctacctcggcgccggcaagtccacgttagtcaactacattttgagtggacaacatgggaaaagaatagcggtaatactgaatgagttcggagaggaaattggagtagaaagagcaatgatcaatgaggggcaaggtggtgccgttgttgaggaatgggtggagctagcaaatggatgcgtttgttgcactgtaaaacacagcctggttcaagcacttgagcaacttgtgcagactaaggagagaatggatcatatattattggagacaactggtttggctgatcctgcaccacttgtatccattctctggctggacgatcaattggagtcatcaatcagactagactctatcattacggttattgatgcaaaaaacttcaggcggcaaattgatgaacacacgaactcttcctcatttcctgaagcatttcaccaaatcgcatttgcggatgttgtgatattaaacaaaattgacttagtaaaagacgatcttgaggatttggaaaggcaaattcatgatgtcaatgcgcttgttacagtggtgcggtctgtgcggtgccaggttgatttaaatacaatatttgatcgacaggcatatggtgtgaagaattcatcacaactacaagagcttctggagtacagtaaatcagcaccacctaatagtcgccatgataacagtatttccaccttgtgcatttatgaacaggatccagtttacttgactaaggtggaatcatggcttgaagatcttctttgggagaagaagtccaacatggatatatatcgttgcaaagggattttaaatatccataattcgaaccaacttcataccttacaggcagtgagggaagtctatgaggttgtgccagctcgagaatggtcggagacacaatctcgcatgaacaagatagttttcataggccgtgatttggatatcagtatcctccaagattcatttagtcgctgcaagcactgattatcgaatgatttgcacgtcaccttgtacctctgtcactgaatacttcatggaggctcacacagcctggactgagattagggtgttctcgtatggttccccgaagttacattctgttgaacaatcttcagtagaggcgaagcagtttgcagtgccgagatcaagagacgacttcaactgctgctgtgaggctatgtgccacgggagcacctccctgatacactagaaaggcattacgctgagcatttgtatatgttcagtatagcaaatgcaactgtgttaggttttgcagagggaaaatgtatccaatcgtaagaggatgtgatctcaatatggtgcagaaagacctaaattgaaatgaacggaagatgcctctggaactttt

SEQ ID NO: 1250 - DNA, 1738 bp, Secale cereale
ccccggttcccgctccctcctccgcctccgcctccgtgccggtcggcgtcaccgtcatcaccggctacctcggcgccggcaagtccacgttggtcaactacattttgagtggacaacatgggaaaagaatagcggtaatactgaatgagttcggagaggaaattggagtagaaagagcaatgatcaatgaggggcaaggtggtgctgttgttgaggagtgggtggagctagcaaatggatgtgtttgttgcactgtaaaacacagcctggttcaagcacttgagcaacttgtgcagacaaaggagagaatggatcatatattattggagacaactggtttggctgatcctgcaccacttgtctccattctctggctcgacgatcaattggagtcatcaatcagactagactctatcatcacggttattgatgcaaaaaacttcaggcggcaaattgatgaacacacaaactcttcctctttccctgaagcatttcaccaaatcgcatttgcggatgttgtgatattgaacaaaattgatttagtaaaagacgatcttgaggatttggaaaggcaaattcatgatgtcaatgcgcttgttacagtgatgcggtctgtgcggtgccaggttgacttaaatacaatatttgatcgacaggcatacggtgtgaagaattcatcacaactacaggagcttctggagtacagtaaatcagcaccacctaatagtcgccatgataacagtatttccaccttgtgcatttatgaacaggatccagttaacttggctaaggtggaatcctggcttgaagatcttctttgggagaagaagtctaacatggatatatatcgctgcaaagggattttaaatatccatgattcgaaccaacttcatacattacaggcagtgagggaagtctatgaggttgtgccggctcgagaatggtcggagacacaatctcgcatgaacaagatagttttcataggccgtgatttggatatcagtacccttcaagattcatttagtcgctgcaagcactgattatcgaatgatttgcactcaccttgtacctctgtcattggatacttcatggaggctcacacagcctgaactgggattagggtgttctcgtatggttccccgaagttacattctgttgaacaatcttcagttgaggcgaagcaggttgcagttccgagatcaagagacgacttcaactgctgctgtgaggctatgtgccacgggagcacctccctgatacactagaaaggcattatgctgagcatttgtatacgttcagtatagtgcatgcaaccgtgttaggttttgcagagggaaaatgtatccaatcgtaggagaatgtgatctgaatatggtgcagaaagacctaaatcgaaatgaacggaagatgcctgtggaactttttggttcttttttggggcgatacggaagcagctatagctccctttccctatgtaaggattttggttctagtgatacccaagctgatggttttgtgcatcggttgatgcagacaggggcatactggactggagaccattaattaagaagtatgcctctgttttgccttcgtttctatttgggcagtagggactagaatactatacgtcgaacactatgtgagtacgtaggttcgtttttataataaactatagaaattatataacacaactagttgttgaaatctgagatgggcctagagcccatatgacaatttc

SEQ ID NO: 1251 - DNA, 2171 bp, Panicum virgatum
agaaaacacacaaaaaaattataaaattaatgaaaagaaagcgcagtcacacgtagccgctctcgagttttccctccctgtcggctctctgcgccgccgccatggaggacaacgacgactgccctcccctcgccgtcgagctcccgccgcaggttccatctcctccggcgccagctcctccggatgcgtcgccagttggcgttaccgtcatcaccggctacctcggggccggcaagtccacgttagtcaactacattttgaatgaacaacatggaaagagaatcgccgtgatactaaacgagtttggagaagagattggggttgaaagggcgatgatcaatgagggtcaaggtggtgcacttgttgaggaatgggtggagctggcaaatggatgcgtctgttgctctgtaaaacacagcctggttcaagcacttgagcagcttgtgcagagaaaggatagaatggatcatatattacttgaaacaacaggtttggctgatcctgcaccacttgtctctgttctttggctagacgaccaactggaatcatcaattagactggattctattattacggtcattgatgcaaaaaatttcagggttcagattgatgagcacaaaaactcctcctcattccctgaagcatttcatcaaattgcatttgcggatgttgtgatattgaacaaaattgacctagtgaaggacaacgttgaggatttggaaaaacatattcatgatgtgaatgctctggttacagtggtgcggtctgtccggtgccaggttgacttgaatgaaatatttaacaggcaagcatatggtgccaagaattcttctcatctgcaagaactgctggactatagtaaatcaataccacctaaccgccgtcatgataatagtatttccaccttgtgcatctacgaacaggatccggttaacttggctaaggtggaatcgtggctcgaagatcttctttgggaaaagaaatctagtatggatatatatcgttgtaaagggattttacatatccatgactcagatcaagttcatacattacaggcagtgagggaagtctacgaagttatgccggctcgaaaatggtccgagacagagtctcgcatgaacaagatagtcttcataggccgcaatttggatatcaatgctctccaagattcattttctggttgcaagggctgataacgattatcctgtttctcttgcacaatgttagttgccattttttctgcgatgtaaattgtcctttgtattggcagttcttgttcacattttctattttgaggacatcacgtgccattatggatagtttttctttggggcattctgctgccatcaccatgagttgctatgttcactaactggcttggattatgttgaaatagtctcaattttacacttatgtgttataggtatctacgccagtttaacttgcctctacacacacaggtacctctgtgtaatgctgaactgaattggcacatatgggtctaaactcatcagtttaagtgctccatatgtatatttcgccagtggagaatcttcatagtggggaaacaactcattattccaagattaagagaaggattgaactggtcgtggtgccgtaatagcatgttagtgcttctccaacggcaccacggtagagttttttctgctgagctgctttctgctcaattgagaatgcaactggtgtgcgttgtggatgaggcatgtatcttattatgagctgcactttgtggaaggagttaacttcgaggtgtatgcaagctgatcgaagacacgctgaatacaaggacagtggcgtaaattttgcatgaggtaggaactgagatacattgggttaattttgttttgtgaattgttggcctctcttggatctggtctggcatctgtattctgctcaacttcacggaagaggcagcgcagctaagataaactactgctgcttgcggagtgatttcccgtcataaactgctgatcactggagctcacagtgcatgtggctaagttaagtaggataccgaagagtatcacattttttttgtcctacgcgcagatcctaggaactattgatggaaacacaatggattggctgcacaagaactacaatgtaaacctttcatacccatacatgtccatagatggttctgaacttct

SEQ ID NO: 1252 - DNA, 1627 bp, Sorghum bicolor
gctgatcggacggcgaaccgttttgagggagagctgagagaagaaaaaagcacagtttacacgcgtagcagctctcgagcttttccctcgctcccgtctccctgcgctcttcgccgccgccatggaggacgatgatgactgccctcctctcgccgtcgagctgccgccgcaggtgccgtcccctccggcgcaagctccctcggacgcctcgccagttggcgtcaccgtcatcactggctacctcggggccggcaagtcgacgttagtcaattacattttgaatgagcaacatgggaagagaattgccgtgatactaaatgagttcggggaggaaattggggttgagagggcgatgatcaacgaggggcaaggtggtgcacttgtcgaggaatgggtggaactggccaatggatgtgtctgttgctctgtaaaacacagtctggttcaagcacttgagcagcttgtgcaaagaaaggatagaatggatcatatattacttgagacaacaggattggccgatcctgctccacttgtttccgttctttggctagatgatcaattggagtcatcaattagactggattctattattacggttattgatgcaaaaaacttcagggttcagattgatgagcacaaaaactcttcctcattccctgaagcatttcatcaaattgcatttgcggatgttgtgatattgaacaaaattgacctagtggaagacaatcttgaggatttggaaaaacatattcatgatgtgaatgctctggttacagtggtgcggtctgtccgttgccaggttgacttgaatgaagtatttaaccggcaagcatatggtgtgaaggattcatctcatctgcaagaactgctcgactatagtaaatcagtgccacctagtcgccgtcatgataacaatatttccaccttgtgcatctatgagcaggattctgttaacttggctaaggtggagtcttggcttgaagatcttctttgggaaaagaaatctagcatggacatatatcgctgtaaagggattttatatatccatgattcagaccaagttcatacactacaggcagtgagggaagtttatgaagttgtgccggctcgaaaatggtctgagacagagtctcgcatgaacaagatagttgtcataggccgcaatttggacatcaatgttcttcaagattcttttagtgtctgcaagagctgattatgagtatctgtttgccttgcacaatgttagttgcccatgtttctgtgaggtacctctgtgcaagtgaatactgaactggaggagaatcttcagatatcaggtgctccatatatatacttcgttagtggagaaactttagtagggctagcagctcactatgccatgagtaaggggtagccatacaggtcaactggtttcatggctgtattatcatgtcaagtgcttttccgacgcaccatggtaaaatttttctgcagagcttgtttcttcggttttgtcgaagaggcatctgtccaattacgggacgttctccggtgaagtattccagttttgcttgtatgatcagaaagacgatcacctttttttacatgaaatagaaactgcgatgcgttaggcgaattttgctcggtg

SEQ ID NO: 1253 - DNA, 1618 bp, Cenchrus ciliaris
cgagcttccccctccctcttggagtctcggctctgcgccgccgccatggaggaggacgacgactgccctcccctcgccgtcgagctcccgccgcgggcgccgtctcctccggcgccaggttcctcagaagcctctccagttggcgtcaccgtcatcaccggctacctcggggccggcaagtccacgttagtcaactacattttgaacgagcaacacgggaagagaatcgccgtgatactaaacgagtttggagaagaaattggggttgaaagggcgatgatcaacgatgggcaaggtggtgcactcgttgaggaatgggtggagctggcaaatggatgtgtctgttgctctgtaaaacacagtttggttcaagcacttgagcagcttgtgcagagaaaggataaaatggatcatatcttacttgagacaacaggattagccgatcctgcaccacttgtctctgttctttggctagacgaccaattggaatcatcaataagactggattctattattacggtcattgatgcaaaaaacttcagggttcagattgatgagcacaaaaactcttcctcattccctgaaacatttcaccaaattgcatttgcggatgttgttatattgaacaaaattgacctagtgaaagacaatctcgaggatttggaaaaacatattcatgatgcgaatgccctggttacagtggtgcggtctgtccggtgccaggttgacttgaatgaaatatttaacaggcaagcatatggtgccaagaattcatctcatctgcaagaactgctggactatagtaaaacaataccacctaatcgtcgtcatgataacagtatttccaccttaagtatttatgaacaggatccagttaacttggctaaggtggaatcatggcttgaagatctcctttgggaaaagaattttagtatggatatatatcgctgtaaagggattttacacatccatgactcagatcaagttcatacattacaggcagtgagggaagtctacgaagttgtgccggctcgaaaatggtctgagacggagtctcgcatgaacaagatagttgtcataggtcgcaatttggatatcaatgttctacaagattcatttagtggttgcaagggctgacaatgattatcttgttcactttgcacaatgtctatttttctgcaaggttgccctgcaatcaaatgctgaactgacggggtcaatatgggcctaacctcaacagttcaggtgctccatatatgttgtactgtcactggggaatcttcatcggaattcactattccaagattaagcgaagactcaggtggtcttgttgcagtaataccaatgttagtgcttctctaacacatcatgttagtgtgtttctgctgggcttcattatgatcagttgagaaaagctgatgtactttgggcatgaggcatgtatcctattatgagatacactttgtggaaggatttacaattcgaggattatgccattgccaactgattgaaaacattgaatagaagggcaatggcggaaatcttgcatgaggtagtaactgatacatcaggtgaattttgcttggtgaattggtggcctcttttggggcgtcttgta

SEQ ID NO: 1254 - DNA, 1563 bp, Saccharum officinarum
aaaaaaaacagcgtttagcagctctcgagctttccctcgctcccgtctctctgtgctcttcgccgctgccatggaggtcgacgatgactgcccccctctcgccgtcgagctcccgccgcgggtgccgtcccctccggcgcaagctccctcagacgcctcgccagttggcgtcaccgtcatcaccggctacctcggggccggcaagtcgacgttagtcaactacattttgaatgagcaacatgggaagagaattgccgtgatactaaacgagtttggagaggaaattggggtcgagagggcgatgatcaatgagggacaaggtggtgcacttgttgaggaatgggtggagctggccaatggatgtgtctgttgctctgtaaaacacagtctggttcaagcacttgagcagcttgtgcagagaaaggatagaatggatcatatattacttgagacaacaggattggccgatcctgctccacttgtttctgttctttggctagacgatcaattggagtcctcaattagactggattctattattacggttattgatgcaaaaaacttcaaggttcaaattgatgagcacaaagactcttcctcattccctgaagcatttcatcaaattgcatttgcggatgttgtgatattgaacaaaattgacctagtggaagacaatcttgaggatttggaaaacacattcatgatgtgaatgctctggttacagtggtgcggtctgtccgttgccaggttgacttgaatgaagtatttaaccggcaagcatatggcgccaagaattcatctcatctgcaagaactgctggactatagtaaatcagtgccacctagtcgccgtcatgataacagtatttccaccttgtgcatctatgagcaggattctgttaacttggctaaggtggagtcttggctcgaagatcttctttgggaaaagaaatctagtatggacatatatcgctgtaaagggattttatatatccatgattcagaccaagttcatacattacaggcagtgagggaagtctatgaagttgtgccggctcggaaatggtctgaggcagagtctcacatgaacaagatagttgtcataggccgcaatttggatatcaatgttcttcaagattcttttagtggttgcaagagctgataatgagcatctgtttgccttgcacaatgttagttgcccatttttctgtgaggtaatttttttcgaacgtttctgtgaggtaaattgccctttgtattagaggttgccattctcattttccactttgggggcatcacatgccattatggatagctttgctgtttgtggcattgagctgccattatcatgagttgctatgttaacaatgcttgtatactgtttaaaacgattcaactctttgtgtgtttgtacatcagtttaattttcttgcctgtagtatgcacgcaggcacgcaggtacctctgtgtaagtgaatactgaactggaggagaatcttctgtcggggaatatagatatcaggtgcttcatacatacacttcggtagtggagaatctttagtag

SEQ ID NO: 1255 - DNA, 1770 bp, Zea mays
agctcttgagctttctctcgctcctgagtgcagtctctctctctgcgccctgcgctctgcgccgccgccatggaggacgacgatgactgccctcctctcgccgttgagctccctccgcgggtgccgtcccctccagagcaatctccctcagacgcctcgccagttggcatcaccgtcatcaccggctacctcggggctggcaagtcgacgctagtcaactacattctgaatgagcaacatgggaagagaattgccgtgatactaaatgagtttggagaggaaattggggtcgagagggcgatgatcaatgaggggcaaggtggtgcacttatcgaggaatgggtggagctggccaatggatgtgtctgttgctctgtaaaacacagtctggttcaagcacttgagcagcttgtgcagagaaaggatagaatggatcatatattacttgagacaacagggttggccgatcctgctccacttgtttctgttctttggctagacgatcaattggagtcgtcaattgtgctggattctattattacggttattgatgcaaaaaacttcagggttcagattgacgagcacaaaaactcttcctcattccctgaagcatttcatcaaattgcatttgcggatgttgtgatattgaacaaaattgacctagtggaagacagtcttgaggatctggaaaaacatattcgtgatgtgaatgctctggttacagtggtgcggtccgtccgttgccaggttgacttgaatgaagtatttaaccggcaagcatatggtgccaagaattcatctcatctgcaagaactgctggactatagtaaatcagtgccacctagtcgccgtcatgataacagtatttccaccttgtgcatctatgaacaggattctgttaacttggctaaggtggagtcttggcttgaagatcttctttgggaaaagaaatctattatggacatatatcgctgtaaagggattttatatatccatgattcagaccaagttcatacattacaggcagtgagggaggtctatgaagttgtgccggctcgaaaatggtctgagacagagtctcgcatgaacaagatagttgtcataggccgcaatctggatatcaatgtacttcaagattcttttagtggttgcaagagctgataatgagtatctgtttgccttgcacaatgttagttggccatttttctgtgaggtacctctgtgcaagtgaatactgaattggaggagaatcttaggtagggaatatagataacaggcgctccatatataaacttcgttattaggtgctgtatggactatggttcacatatttgtaacttgaacggtaaccgataatgttaaaacatgtttgtttaagtccaaccgtaatcagataccacactactagaaactgatatcatcctaaatcattattgttgcaatttacgttagtggagaatctttagcgggcagggctagcaactcacaatgtgaagagtgggcgtagccgaacacctcaagactgatttcatggctgtattacatgccaagtgcttttccgacgcaatttgacaattttttttgtagaacctgtttcttcggttttgtggaagaggcatctgtccaattacgggtcgcactctgggaaagaatttcagttttgcttgtatgatcaggaacacattttttttcacaggtacggtacggtgatggaaaattgaaatttgggcgaagtaggaactgtgatgtgttaggcgaattttcctcggt

SEQ ID NO: 1256 - DNA, 3380 bp, Brachypodium distachyon
agttatcatctgcgggaaaaccaaaacctacacaactctcaacacttgagctttcccttttcgcgtctctcgtcggcggccatggaagacgacgaagactgccctcccctcgccgtcgagctcccggcgcagacgacttctcctccggttaccgctccctcttctgcctctgcaccagtcggcgtcaccgtcatcaccggctacctcggtgccggcaagtccacgttagtcaactatattttgagtgctcaacatgggaagagaatagccgtaatactgaacgagttcggagaggaaattggagtagaaagagcaatgatcaatgaggggcaaggtggtgcccttgttgaggagtgggtggagctagcaaatggatgtgtttgttgcaccgtaaaacacagcctggtacaagcacttgagcagcttgtgcagagtaaggagagaatggatcacatattattggagacaactggtttggctgatcctgcaccacttgtctccattctttggctggatgatcaattggagtcatcaatcagactagactctatcattacggttatcgatgcaaaaaacttcaggcagcaaattgatgaacatacaaactcttcctcattccctgaagcatttcatcaaattgcatttgcggatgttgtgatattgaacaaaattgatttagtaaaagatgatctcgaggatctggaaaagcaaattcatgatgtcaacgctcttgttacagtggtgcgatctgtccgctgccaggttgacttaaatacaatatttgatcgacaggcatatggtaccaagaattcatcgcaactgcaggagcttctggagtacagtaaatcagtaccacctaatagtcgtcatgataacagtatttccaccttgtgcatttctgaacaggatccagttcacctggctaaggtagaatcatggcttgaagatcttctttgggaaaagaagtctactatggatatatatcgttgcaaaggaattttacatatccataactcaaaccaacttcatacattacaggacatagttacgaaactacccttcaacgttccgttttctcgtttccattccgcccttccgatctcaagccgccgtctccccctccccgccactcctcgcacccccactaaaaccctaacccacaacacaatggctgcggcggcggccgcctcctcgctcctcctccgtcgccaccaccgaacccccgcccgtctccccatcatcctccgcgccgcaatctcctcaacccgcgcgctaccccagcagcccgagctctccccgcccccaaccgagcctgccgccgcctccacctccccgctgcccccgaaccccagctccggcagccccttctatggcgagaactggcgcaaccccgccgcctccagcccggcctcctccctcctccccgccgtcgtctccgccagccccttcacgcaccaccgcatggccgccttctccgccaccctcggcgccgccgagctcaaggagaccttcgcggagtggatgacggagcagcgctgggacgagatgaagcagctcttcgagttctgggtgcgctcgctcgacgcctccactggcaagcccaaccgccccgacgtcgacctcttcaaccactacctccgcgccaacttcatgtcgggcgccctgccgcacgaaatgctcgatctcgccgaccagatgcgcgagttcgagatctcccccaacacggcctcgcacaacctcatcctcaagagcatggtccgagcccgtgaggtcgaaggcgctgagaagctcgttgaacggatgctgctaacaggaactgtaccagatgatgaatcctacaatttggttgtagacctgcttattaaacagaaccgtgttgattcggctttgaaatatttggatttgatgcttaaatcaggctacatgatatcttcgactgtgtttgctgactgtgtgcgagaatgtataagatctggaaggttggacacgttggcatcagtcattgagaagtgcaaggcaacagacaaaaacaaagtcttatgtccacaatgggcctggtgcattggcatagcagaagctgcatttgaagctaacaatagcaagctagctatgtttgccttggaatttctcgcgagatggatggctcgtggggagcgtgcttcaccccctattcacctttcagttgatgaaggtttggtgctgtcagctttaagtgctgctggtagaacctgtagcaccgacctcttgaatgctgcttggtcaatattacgcaagtccttgcgccagaaaagggcacccacgccagaggcttatcttgcaaagatttatgcgcattcatcaattggtcaacttcaacgagcttttgggactcttcgtgaatttgaaaatgcctatgggaactctgagaatattgatatagagctcttctcaccatttatgtccttgcaaccacttgttgttgcttgctgcaaggacggcttcactacactggattcggtttatgtgcaattggagaatctgagttctgcggatccaccatacaaatctgttgctgctcttaactgtgttatagtgggctgtgcaaacatttgggatcttgagcgagcatatgaaacttttgaggcattgaaggaaaagtttggacttacacctgacatacattcatacaatgccctgttgtatgcatttgggaagctgaaaaagacagaagaagcttgtaatgtattccagcatttagtaagccttgacgttaaaccaaattcaacgacatactccctacttgtcgacgctcatcttgtcaaccgagatccaaaagctgctcttgctgtcattgatgagatggttgacgtaggcttcactccttcaaaggagacgcttaagaaggtccgaagacgttgctcccgtgaatcagactttgacagtgatgagaaactgcaatccctgtgtaaacagttgaattgccgaatgggcggtgaaggccgcagggagttgctctataacatagaatacagtgctgagtattgaagcattgattttcatgatgccggtgttctttccaatcctagtaggcacttgtactgtttgccggtactcagaagagcatagaggctgtagtttgtaaattacactcctttgtatcagctttcctaattattcttcattatcccaagctatcttttttttgccggaaagaccggacaagatttatgttaggatttcagaataagatcctaatatacatttgtttctctgctccaagcacaatctttcttccaccctcagtggatgttacttcggattatcataatggtttggcacagctcttgtattctcacgacgtttgtcaatccagttgactccgtaattattggggaaaaaaa

SEQ ID NO: 1257 - DNA, 1131 bp, Leymus cinereus x Leymus triticoides
  misc_feature (4)..(7): n is a, c, g, or t
  misc_feature (152)..(152): n is a, c, g, or t
  misc_feature (223)..(223): n is a, c, g, or t
  misc_feature (234)..(234): n is a, c, g, or t
  misc_feature (251)..(251): n is a, c, g, or t
  misc_feature (298)..(298): n is a, c, g, or t
  misc_feature (337)..(337): n is a, c, g, or t
  misc_feature (343)..(343): n is a, c, g, or t
  misc_feature (490)..(490): n is a, c, g, or t
  misc_feature (541)..(541): n is a, c, g, or t
  misc_feature (759)..(759): n is a, c, g, or t
  misc_feature (781)..(781): n is a, c, g, or t
  misc_feature (862)..(862): n is a, c, g, or t
  misc_feature (878)..(878): n is a, c, g, or t
  misc_feature (880)..(880): n is a, c, g, or t
  misc_feature (889)..(889): n is a, c, g, or t
  misc_feature (919)..(919): n is a, c, g, or t
  misc_feature (927)..(927): n is a, c, g, or t
  misc_feature (929)..(929): n is a, c, g, or t
  misc_feature (943)..(943): n is a, c, g, or t
  misc_feature (950)..(952): n is a, c, g, or t
  misc_feature (954)..(955): n is a, c, g, or t
  misc_feature (980)..(980): n is a, c, g, or t
  misc_feature (988)..(988): n is a, c, g, or t
  misc_feature (1005)..(1006): n is a, c, g, or t
acannnnctaaacgagccgccagtcacgcgtccgctgtcctctccttctcccccaatttatttcgtgccgctgcggtgctgtcgcctccgcctggtccggttcccaatcccaatcccaatcccaatcccaatctcatcgccaagcaatcacnctagccctccccaccagcgcgacctcggcagcatggctagcccgcagtgctgcgcgaacccaccgacgctnaaccccgccgncggcgagggcaaggtcntcgacagcttcggcgggatcaaggcgtacgtcgccggcgcccaagantccaaggccgccgtcgtcctcatctccgacgtctacggntttgangcgccgaatctgaggaagatagccgataaagttgcttcgtctggatattttgttgtggtgccagatttcttacatggggatccatatgtacctgaagacgctgacagaccaatagcagtgtggataaaggagcatacccagggaaangcatttgaagaggcaaaacctgttattgctgctctaaaggaacaaggagcntctagtgttggggctgcaggttattgctggggtgcaaaggtagttgcagagttagcgaaagcgaatgagatccaggcagccgttatgtcgcatccttcttttgttactgttgatgatataaaagaggtgaaatgccccattgctatacttggagctgaaactgacgtaatgtccccaccagaattggtcaaggagttcgagcaggttctatcctctanctcagggattgctcactttgtnaagatcttccctggggtttctcatggatggaccgtgagatacaaaagcgaagacgcggctgctgtgaagagcgccgaggangccctggcggacatgntngactggttnaacaagaacctcaagtgaacctaatgaatnagcggccntncttttgtaataagntagtgtnnntnntcacgagtcatcacgcgagcatccngggtttangttatggtgttactgtnncctatcggacatgcgtctttgtctgtcgcaggcgtgctggcatgtgtgtgattgctcattccggggtctgcttgtgctgaacactgaactattgcactgaaataaaatgtgggatttgcagttta

SEQ ID NO: 1258 - DNA, 1038 bp, Secale cereale
ccaatcccaatcccaatctcatcgccaagcaatcatcactcaacagcatggcgagcccgcagtgctgcgcgaacccaccgacgctcaaccccgccgccggcgagggcaaggtcgtggacagcttcggcggcatcaaggcgtacgtcgccggcgcccaagagtccaaggccgccgtcgtcctcatctccgacgtctacgggtttgaagcgccgaatctgaggaagatagccgacaaagttgcttcgtctggatattttgttgtcgtgccagattttttacatggggatccatttgtacctgaagacgctgacagaccaatagcagtgtggataaaggagcataccccgggaaaagcatttgaagaggcaaaaccagttattgctgctctaaaggaacaaggagcgtctagcgttggggctgcaggttattgctggggtgcaaaggtagttgcagagttagggaaagctaatgatatccaggcagccgttatgtcgcacccttcatttgttactgttgatgacatagaagaggtgaaatgccccatcgctatacttggagctgaaactgacgtaatgtccccaccagaattggtcaagaagttcgagcaggttctatcctctaactcagggattgctcactttgtcaagatcttccctggggtttctcatggatggaccgtgagatacaaaagcgaagacgcagctgctgtgaagagcgccgaagaagccctggcggacatggttgactggtttaacaagaacctcaagtaaatttgattatttagcggccatccttttgtaataagctagtgtcactcttcaggagtcatcacacgagcatccacggtttatgttatggtcttagctataggcctataggacatgcatctttgtctaccgcaggtctgctggtatgtgtgtgattgctcatttcggagtttgcttgtgctgaagactgaactattgcactcaaataaaatgtggtatttgcagtttttgtgagctaaaaaaaaaaaaaaaaaaaaaaaaaaaaaaaaaa

SEQ ID NO: 1259 - DNA, 1132 bp, Triticum aestivum
cttcgaccagacgcgaacagattcgaaacgagccgccagtcacgcgtccgctgtccttctccccccatttatttcgtgccgctgcggtgctgtcgcctggccccgttcccaatcccaatccaatctcatcgccaagcaattactccagcactccagccctccccaccagcgtgacctcggcagtatggcgagcccgcagtgctgcgcgaacccaccggcgctcaatcccgccgccggcgagggcaaggtcgtggacagcttcggcgggatcaaggcgtacgtcgccggcgccaaagagtcgaaggccgccgtcgtcctcatctccgacgtctacgggtttgaagcgccgaatctgaggaagatagccgataaagttgcttcgtctggatattttgttgtggtgccagatttcttacatggggatccatttgtacctgaagacgctgacagaccaatagcagtgtggataaaggagcataccccgggaaaagcatttgaagaggcaaaacctgttattgctgctctaaaggaacaaggagcgtctagcgttggggctgcaggttattgctggggtgcaaaggtagttgcagagttagcgaaagctaatgagatccaggcagccgttatgtcgcacccttcatttgttactgtcaatgatatagaagaggtgaaatgccccatcgctatacttggagctgaaactgacgtaatgtccccaccagaattggtcaagaagttcgagcaggttctatcctctaactcagggattgctcactttgtcaagatattccctggggtttctcatggatggaccgtgagatacaaaagcgaagacgcagctgctgtgaagagcgccgaggaagccctggcggacatgattgactggttcaacaagaacctcaagtgaacctaatgaattggcggccatccttttgtaataagccagtgtcactcttcaggagtcaccacgcgagcatccacggtttatgttatggtcttagctatagcctatagggcatgcgtctttgtctgctgcaggtctgctggtatgtgtgtgcttgctcattttggggtctgcttgtgctgaacactgaaactattgcactcagataaaatgtggtatttgcagttt

SEQ ID NO: 1260 - DNA, 1093 bp, Triticum aestivum
ggttcccaatctcatcgccaagcaatcactctagccctccccaccagcgtgacctcggcagtatggcgagcccgcagtgctgcgcgaacccgccgacgctcaaccccgccgccggcgagggcaaggtcgtggacagctttggcgggatcaaggcgtacgtcgccggcgcccaagagtccaaggccgccgtcgttctcatctccgacgtctacgggtttgatgcgccgaatctgaggaagatagccgataaagttgcttcgtctggatattttgttgtggtgccagatttcttacatggggatccatttgtacctgaagacgctgacagaccaatagcagtgtggataaaggagcataccccgggaaaagcatttgaagaggcaaaacctgttattgctgctctaaaggaacaaggagcgtctagtgttggggctgcaggttattgctggggtgcaaaggtagttgcagagttagcaaaagctaatgagatccaggcagccgttatgtcgcacccttcatttgttactgttgatgatataaaagaggtgaaatgccccatcgctatacttggagctgaaactgacaaaacatccccaccagaattggtcaagcagttcgagcaggttctagcctcttctaactctgggattgctaactttgtcaagatcttccctggggtttctcatggatggaccgtgagatacaaaagcgaagacgcagctgctgtgaagagcgctgaggaagccctggtggacatggttgactggtttaacaagaacctcaagtgaacctaatgaattagcggccatccttttgtaataagccagtgtcactcttcaggagtcatcacgcgagcatccacggtttatgttatggtctcttagctatagcctatagggcatgcttctttgtctgccgcaggtctgctggtatgtgtgtgattgctcatttcggggtctgcttgtgctgaacactgaactattgcactcaaataaaatgtggtatttgcagttctgtgagctggctacttcccttggtttacctttttcttttgtttggttggttgggaatagaaagcagatcgtaacaaaac

SEQ ID NO: 1261 - DNA, 1020 bp, Pseudoroegneria spicata
atcccaatctcatcgccaagcaatcactctagccctccccaccagcgcgacctcggcagcatggcgagcccgcagtgctgcgcgaacccaccgacgctcaaccccgccgctggcgagggcaaggtcgtcgacagcttcggcgggatcaaggcctacgtcgccggcgcccaagagtccaaggccgccgtcctcctcatctccgacgtctacggttttgaagcgccgaatctgaggaagatagccgataaagttgcttcgtctggatattttgttgtggtgccagatttcttacatggggatccatatgtacctgaagacactgacagaccaatagcagtgtggataaaggagcataccccgggaaaagcatttgaagaggcaaaacctgttattgctgctctaaaggaacaaggagtgtctagcgttggggctgcaggttattgctggggtgcaaaggttgttgcagagttagcgaaatctaatgagatccaggcagccgttatgtcgcacccttcatttgttactgttgatgatataaaagaggtgaaatgccccattgctatacttggagctgaaactgacgtaatgtccccaccagaattggtcaagaagttcgaacaggttctatcctctaactcagggattgctcactttgtcaagatcttccctggggtttctcatggatggaccgtgagatacaaaagcgaagacgcagctgctgtgaagagcgccgaggaagccctggcggacatggttgactggttcaacaagagcctcaagtgaacctaatgaattagcggccctccttttgtaataagccagtgtcactcttcacgagtcacgagtcatcacacgagcatccagggtctatgttatggtgttagctatagcctatagggcttgcatctttgtctgccgcaggcctgcttgtatgtgtttgattgctcttttcgggggtctccttgtgctgaacactgaactattgcactgaaataaagtgtggtattgcagtgtgaaaga

SEQ ID NO: 1262 - DNA, 861 bp, Secale cereale
ggcccggttccaatcccaatcccaatctcatcgccaagcaaccatcactctagccctccccgccagcgcgacctcggcaacatggcgagcccgcagtgctgcgcgaacccaccgacgctccaccccgctgccggcgagggcaaggttgtcgacagctttggcggcatcaaggcgtacgtcgccggcgcccaagagtccaaggccgccgtagtcctcatctccgacgtctacgggtttgaagcgccgaatctgaggaagatagccgacaaagttgcttcgtctggatattttgttgtcgtgccagatttcttacatggggatccatttgtgcctgaagacgctgacagaccaatagcagtgtggataaaggagcataccccggggaaagcatttgaagaggcaaaaccagttattgctgctctaaaggaacaaggagcgtctagcgttggggctgcaggttattgctggggtgcaaaggtagttgcagagttagggaaagctaatgatatccaggcagccgttatgtcgcacccttcatttgttactgttgatgacatagaagaggtgaaatgccccatcgctatacttggagctgaaactgacgtaatgtccccaccagaattggtcaagaagttcgagcaggttctatcctctaactcagggattgctcactttgtcaagatcttccctggggtttctcatggatggaccgtgagatacaaaagcgaagacgcagctgctgtgaagagcgccgaagaagccctggcggacatggttgactggtttaacaagaacctcaagtaaatttgattatttagcggccatccttttgtaataagctagtgtcactctccaggagtc

SEQ ID NO: 1263 - DNA, 876 bp, Triticum aestivum
ccgcagtgctgcgcgaacccaccgacgctcaaccccgccgccggcgagggcaaggtcgtggacagctttggcgggatcaaggcgtacgtcgccggcgcccaagagtccaaggccgccgtcgttctcatctccgacgtctacggttttgaagcgccgaatctgaggaagatagccgataaagttgcttcgtctggatattttgttgtggtgccagatttcttacatggggatccatttgtacctgaagacgctgacagaccaatagcagtgtggataaaggagcataccccgggaaaagcatttgaagaggcaaaacctgttattgctgctctaaaggaacaaggagcgtctagtgttggggctgcaggttattgctggggtgcaaaggtagttgcagagctagggaaagctaatgagatccaggcagccgttatgtcgcacccttcatttgttactgtcaatgatataaaagaggtgaaatgccccatctctatacttggagctgaaactgacgtaatgtccccaccagaattggtcaaggagttcgagcaggttctatcctctaactcagggattgctcactttgtcaagatcttccctggggtttctcatggatggaccgtgagatacaaaagcgaagacgcagctgctgtgaagagcgccgaggaagccctggcggacatgattgactggttcaacaagaacctcaagtaaacctaatgaattagcggccatccttttgtaataagccagtgtcactcttcaggagtcatcacgcgagcacccacggtttatgttatggtcttagctatatagcctatagcgcatgcatctttgtctgccgcaggtctgctggtatgtgtgtgattgctcgta

SEQ ID NO: 1264 - DNA, 1202 bp, Triticum aestivum
cgaacagattcgaaacgagccgccagtcacgcgtccgctgtccttctccccccatttatttcgtgccgctgcggtgctgtcgcctggcccggttcccaatcccaatccaaatctcatcgccaagcaatcatcactctagccctttgccctccccacccgcagcagcatggcgagcccgcagtgctgcgcgaaaccaccggcgctcaaccccgccgccggcgagggcaaggtcgtggacagcttcggcgggatcaaggcgtacgtcgccggcgcccaggactccaaggccgccgtcgtcctcatctccgacgtctacggttttgaagcgccgaatctgaggaagatagccgataaagttgcttcgtctggatattttgttgtcgtgccagatttcttacatggggatccatttgtacctgaaaacgctgaccgaccaatagcagtgtggataaaggagcataccccgggaaaagcatttgaagaggcaaaacctgttattgctgctctaaaggaacaaggagcgtctagtgttggggctgcaggttattgctggggtgcaaaggtagttgcagagctagggaaagctaatgagatccaggcagctgttatgtcgcacccttcatttgttactgttgatgatataaaagaggtgaaatgccccatctctatacttggagctgaaaccgacgtaatgtccccaccagaattggtcaaggagttcgagcaggttctatcctctaactcagggattgctcactttgtcaagatcttccctggggtttctcatggatggaccgtgagatacaaaagcgaagacgcagctgctgtgaagagcgccgaggaagccctggcggacatggttgactggtttaacaagaacctcaagtaaacctaatgaattagcggccatccttttgtaataagccagtgtcactcttcaggagtcatcacgcgagcacccacggtttatgttatggtcttagctatatagcctatagcgcatgcatctttgtctgccgcaggtctgctggtatgtgtgtgattgctcgtatcggggtctgcttgtgctgaacattgaactactgcactcaaataaaatgtggtatttgcagtttgtgagctggcacctccctggttactttcttttttgtttggtgttggggatgaaaggacagatcgttacaacccggtttattccttac

SEQ ID NO: 1265 - DNA, 782 bp, Triticum aestivum
aagcaatcactctagccctccccaccacgcgtgacctccggcagtatggcgagcccgccagtgctgcgcggacccgccgacgctcaaccccgcccgccggccgagggcgaaggtcggtggacagctttggtcggggatcaaggcgtacgtcgccggcgcccaagagtccaaggccgccgtcgttctcatctccgacgtctacggttttgaagcgccgaatctgaggaagatagccgataaagttgcttcgtctggatattttgttgtggtgccagatttcttacatggggatccatttgtacctgaagacgctgacagaccaatagcagtgtggataaaggagcataccccgggaaaagcatttgaagaggcaaaacctgttattgctgctctaaaggaacaaggagcgtctagtgttggggctgcaggttattgctggggtgcaaaggtagttgcagagttagcaaaagctaatgagatccaggcagccgttatgtcgcacccttcatttgttactgttgatgatataaaagaggtgaaatgccccatcgctatacttggagctgaaactgacaaaacatccccaccagaattggtcaagcagttcgagcaggttctagcctcttctaactctgggattgctaactttgtcaagatcttccctggggtttctcatggatggaccgtgagatacaaaagcgaagacgcagctgctgtgaagagcgctgaggaagcctggtggacatggttgactggtttaacaagaacctcaagtgaaccta

SEQ ID NO: 1266 - DNA, 1013 bp, Avena sativa
gggtttccttccaaatttcagtcccacctcccaactcccaagcaccacccaccggcgcaacctaggcagtatggctagcccgcagtgctgcgcgaacccaccgacgccgagccccgccggcggggagggcaaggtcgtcgacagcttcggcgggatcaaggcgtacgtcgccggcggccaggactcaaaggccgccgtcgtccttatctccgatatcttcgggtttgaagcgccgaatctgaggaaggtagccgataaagtcgcttcgtctggatactttgttgtggtgccagatttcttacatggggacccttacaaacctgaagacgctgatagaccaatacaagtgtggatcaaggagcatgccccgctcaaagcatttgaagaggcaaaaccagttattgctgctctgaaggaacaaggagtgtctagtgttggcgctgcaggttattgctggggcgcaaaggtagtagcagagttagcgaaagctaatgagatcgaggcagctgttatgtcacacccttcatttgttactgttgatgatatcaaagaggttaaatgtcccatcgctgtacttggagccgaaactgacagaacgtccccgccagaattggtcaagcagtttgaacaggttctatcctctaactcagagattggtcactttgtcaagattttccctggggtttctcatggatggactgtcagatacgacagcgacgacgcagctgctgtgaagagcgctgaggaagccttgacggacatgactaactggtttaacaagaaccttaagtgaacctacactggtagccctccatttaataataagcatcctcactcttcagcagtcatcatgcaagaatcctgggtttacggtaatggtatttgcgctgcatctttgtctggcactggcgtttccctggtgttggtatgcatgtgattgttcgcttggggttctgcttgtgctgaacactgtacacactgaaataaaatttgctatgtgaagttctgttagc

SEQ ID NO: 1267 - DNA, 944 bp, Avena sativa
ctcccaagcaccacccaccggcgcaacctaggcagtatggctagcccgcagtgctgcgcgaacccaccgacgccgagccccgccggcggggagggcaaggtcgtcgacagcttcggcgggatcaaggcgtacgtcgccggcggccaggactcaaaggccgccgtcgtccttatctccgatatcttcgggtttgaagcgccgaatctgaggaaggtagccgataaagtcgcttcgtctggatactttgttgtggtgccagatttcttacatggggacccttacaaacctgaagacgctgatagaccaatacaagtgtggataaaggagcatgccccgcaaaaggcatttgaagaggcaaaaccagttattgctgctctgaaggaacaaggggtgtctagtgttggcgctgcaggttattgctggggtgcaaaggtagtagcagagttagcgaaagctaatgagatccaggcagctgttatgtcacacccttcatttgttaccgttgatgatatcaaagaggttaaatgtcccatcgctgtactcggagctgaaactgacagaacgtccccaccagaattggtcaggcagttcgagcaggttctatctactaactcagagattgctcactttatcaagattttccctggggtttctcatggatggactgtcagatacggcagcgacgacgcagctgctgtgaagagcgctgaggaagccctgacggacatgactgactggtttaacaaaaaccttaagtgaacctgaagtggtagccctccatttaataataagccatcctcactcttcagcagtcatcatgcaagaatcctgggtttacggtaatggtatttgcgctacatctttgtctggcgctggcgtgctggtgtaggtatgcatgtgattgttcgcttggggttctgcttgtgctgaacactgtacacact

SEQ ID NO: 1268 - DNA, 1143 bp, Hordeum vulgare
tcgataccgccaagtaaacaaaaaagtctccactgcacgagcagattcggaacgactcgccgtcaaagcgttccgctgtcctcgggtcgctgcgctgccgtcgcctggtcctcctcctcctcctcagctcagtcggctggtctcgtatccctcccagccccagtccccaggaaccagcggcctcggcactcggcaggatggctaccccgcagtgctgcgcggacccgccgacgctcaaccccgccggcggcgagggcaaggtcgtggacagcttcggcgggatcacggcgtacgtctccggcgcccgagagtccaaggccgccgtcgtcctcatctccgacgtcttcgggtttgaagcgccgaatctgaggaagatagccgataaagtcgcttcgtctggatatttagttgtggtgccagatttcttacatggggatccatatgtacctgaaaacgccgacagaccaatacaagtgtggttaaaggagcatgccccgggaaaagcatttgaagaggcaaaacctgttattgctgctctcaaagaacaaggagtatctactgttggggctgcaggttattgctggggtgcaaaggtggttgctgagctagcgaaagctaatgagatccatgcagctgttatgtcacacccttcttttgttactgttgaagatatcaaagaggtgaaatgccccatagctgtacttggagctgaaattgacaaaacatccccaccagaattggtcaagcagttcgagcaggttctgtcctctaactcagggattgctcactttgtcaagatattccctggggtttctcatggatggactgtgagatacaaaagtgaagacgcaggtgctgtgaagagtgctgaggaagccctgtcacatatgatcgactggtttagcaagaacctacagtgaatctgaattagcggtcctttgtccttaatacgccagtgtcactcttcaccagtcatcatgtaatcatccagggtttatgttatagggcctgcatctttggttgtacagatctgtcctgtgctagcatgcattgtgtgattactcatatcggtctctgcttgtgctgaacacattacgataatactattgcactgaaataaaaatgcgatatttgttgtttcga

SEQ ID NO: 1269 - DNA, 1061 bp, Secale cereale
gacttgttcgtctagttctaaagtcgtttcgttccttcccgttcgcttgcgctgccgtcgcctggtcctcctcctcagctcacctccgtcggcttgtccggttctcaaccccagtccccaggcaccagcagcctcggcaggatggctaccccgcagtgctgcgcggacccgccgacgctcaaccccgccggcggcgagggcaaggtcgtcgacagcctcggcgggatcgcggcgtacgtcgccggctccaccgagtccaaggccgcagtcgtcctcatctccgacgtcttcgggtttgaagcgcccaatctgaggaagatagccgataaagttgcttcgtctggatattttgttgtggtgccagatttcttacatggggatccatatgtacctgaaaacgctgacagaccgatacaagtgtggctaaaagaacatgccccgggaaaagcatttgaacaggcaaaacctgttattgctgctctaaaagaacaaggagtgtctactgttggggctgcaggttattgctggggtgcaaaggtagttgcagagttagcgaaagctaatgagatccaggcagctgttatgtcgcacccttcttttgttactgttgacgatatcaaagaggtgaaatgccccatcgctgtacttggagctgaaattgacaaaacatccccaccagaattggtcaagcagttcgagcagattctatcctctaacacagggattgctcactttgtcaagattttccctggggtttctcatggatggactgtgagatacaaaagtgaagatgcaggtgcagcgaagagcgccgaggaagccctgtcagacatggttgactggtttaacaagaacctaaagtgaacctgagttagtagtcctcttttcgtaataagacagtgtcactcttcaccagtcatcatgcaaacatccagggtttatgctattgtcctagctatagggcctgtattaatggtcgcgcaggtgtctgtcgtgtgctagtatacattgtgtgcttgcttatagcggtgtctgcttgtactgaacacataactataata

SEQ ID NO: 1270 - DNA, 1138 bp, Secale cereale
gactgtaataaacaaccagaagcctcgagccttccgattcgaaacaagtcgcagtcaaagcgttcgtcctcccgtcgctgcgctgccgtcgcctggtcctcctcctcactcacctccgtcggctggtccggttctcaaccccagtccccaggcaccagcagcctcggcaggatggctagcccgcagtgctgcgcggacccgccgacgctcaaccccgccggcggcgagggcaaggtcgtcgacagcctcggcgggatcgcggcgtacgtcgccggctccaccgagtccaaggccgcagtcgtcctcatctccgacgtcttcgggtttgaagcgcccaatctgaggaagatagccgataaagttgcttcgtctggatattttgttgtggtgccagatttcttacatggggatccatatgtacctgaaaacgctgacagaccgatacaagtgtggctaaaagaacatgccccgggaaaatcatttgaagaggcaaaacctgttattgctgctctaaaagaacaaggagtgtctactgttggggctgcaggttattgctggggtgcaaaggtagttgcagagttagcgaaagctaacgagatccaggcagctgttatgtcgcacccttcttttgttactgttgacgatatcaaagaggtgaaatgccccatcgctgtacttggagctgaaattgacaaaacatccccaccagaattggtcaagcagtttgagcagattctatcctctaacacagggattgctcactttgtcaagattttccctggggtttctcatggatggactgtgagatacaaaagtgaagatgcaggtgccgcgaagagcgccgaggaagccctgtcagacatggttgactggtttaacaagaagctaaagtgaacctgaattagtagtccttttttcgtaataagactgtcactcttcaccagtcatcatgcaaacatccagggtttatgctattgtcctagctatagggcctgtatcaatggtcgtgcaggtgtctgtcgtgtgctagtaatagtattcattgtgtgcttgcttatagcggtgtctgcttgtactgaacacataactataatattattgcactgaaataaaatgcgatatgtttaaataaaaaagt

SEQ ID NO: 1271 - DNA, 1070 bp, Avena sativa
caccaccatttatctcgcctcgctgcgttgctgtcgcctgctcctctcctcctccatcggctggtttccaatcccacctccaaagcaccactagccccccacccaccagcgcaggctctgccaggatggctagcccgcagtgctgcgcgaacccgccgacgctcagccccgccgccggggagggcaaggtcgtcgacagcttcggcggactcagggcgtacctcgccggcgcccaagagtccaaggccgccgtcgtactcatctccgatgtctacgggtttgaagcgcctaatctgaggaacatagcagataaagttgcttcgtccggatactttgttgtggtgccagatttcttacatggggatccattcgtacctgcagacgctgacagaccattacaagtgtggataaaggagcatgccccggagaagggatttgaagaggcaaaaccagttattgctgctcttaaggaacaaggagtctctgttgttggggctgcaggttattgctggggtgcaaaggtagttgcagagttagcaaaagctaatgagatccaggcagctgttatgtcgcacccttcttttgttactgttgatgatatcaaagaggtgaaatgccccatcgctatacttggagctgaaactgacgtgatgtcgccaccagaattggtcaagcagttcaagcaggttctatcctctaacgcagggattggttcctttgtcaagattttcccgggggtttctcatggttggactgtgagatacgacagcaacgacgcagctgccgtgaagaacgctgaggaagccctggcggacatgatcgaatggtttaacaagaacctcaaatgaacctgaagtagcagccctccttttctaataagtcctttggtcactcttcatagtcattatgcaagcatcctgggcttatgtatggtattagctgtagggtctgcatctttgtctggcacaggtgtactggtattggtatgtatgtgatttgctcatttgggggtctgtttgtgctgaacactgaattattgcactccaataaaatttggcatttgcagtttt

SEQ ID NO: 1272 - DNA, 1067 bp, Avena sativa
gccccaccaccatttatctcgcctcgctgcgttgctgtcgcctgctcctctcctcctccatcggctggtttccaatcccacctccaaagcaccactagctccccacccaccagcgcaggctctgtcaggatggctagcccgcagtgctgcgcgaacccgccgacgctcagccccgccgccggggagggcaaggtcgtcgacagcttcggcggactcagggcgtacctcgccggcgcccaagagtccaaggccgccgtcgtcctcatctccgatgtctacgggtttgaagcgcctaatctgaggaacatagcagataaagttgcttcgtccggatactttgttgtggtgccagatttcttacatggggatccattcgtgccagcagacgctgatagaccaatacaagtgtggataaaggagcatgccccggacaagggatttgaagaggcaaaaccagttattgctgctctaaaggaacaaggagtgtccgttgttggggctgcaggttattgctggggtgcaaaggtggttggagagttagcaaaagctaatgagatccaggcagcggttatgttgcacccttcttttgttactgttgatgatatcaaagaggtgaaatgccccatcgctatacttggagctgaaactgacgtcatgtcgccaccagaattggtcaagcagttcaagcaggtcctatcctctaactcagggattggttcctttgttaagatattccctggggtttctcatggttggactgtgagatacgacagcaacgacgcagctgctgtgaagaacgctgaggaagccctggcagacatgattgaatggtttaacaagaacctcaaatgaacctgaagtagcagccctcctttttaataagccatttgtcactttacatagtcatcatgcaagcatcctgggcttatggtatggtattagctgtagggcctgcattgttgtctggcgcaggtttactggtatttgtatgtatatgtgatttggtcctttgggtgtccttttgtgctgaacactgaattattgcactcgaataaaatttggcattt

SEQ ID NO: 1273 - DNA, 1033 bp, Triticum aestivum
ccccaaccaccaggcaccagcagcagcctcggcaggatggctagcccgcagtgctgcgcggacccgccgacgctcgaccccgccggcggggagggcagggtcgtcgacagcttcggcgggatcacggcgtacgtcgccggcgcccgagagtccaaggccgctgtcatcctcgtctccgatatcttcgggtttgaagcaccgaatctgaggaagataaccgataaagttgcttcgtctggatattttgttgtggtgccagatttcttacatggggatccatatgtacctgaaaacgctgacaggccgatacaagtgtggttaaaagaacatgctccgggaaaagcatttgaagaggcaaaacctgttattgctgctctaaaagaacaaggagtatctactgttggggctgcaggttattgttggggtgcaaagggagttgcagagttagcgaaagctaatgagatacaggcagctgttatgtcacacccttcttttgttactgttgacgatatcgaagaggtgaaatgccccatcgctatacttggagctgaaactgacaaaacatccccaccagaattggtcaagcagttcgagcaggttctatcctcttctaactctgggattgctcactttgtcaagattttccctggggtttctcatggatggactgtgagatacaaaagtgaagacgcaggtgctgtgaagagtgccgaggaagccctgtcagacatgatcgactggtttaacaagaacctaaagtgaacctgaattagcgtccttttttcttaataggccagtgtcactcttcaccagtcatcacgcaatcatccagggtttatgttatggtccgcatcgttggtcgtctgcaggtgtctgtcctgtgcagtatgtactgtgtgcttgctcatatcagtctctgcttgtgctgaacacattactataatactatagcactgaaataaaatgcgatatttgtagttttgagagttggaccacttgtctcgttgtctttatgtaacttgtgtggtgattg

SEQ ID NO: 1274 - DNA, 1036 bp, Secale cereale
tggtcctcctcctcagctcatctccgtcggcttgtccggttctcaaccccagtccccaggcaccagcagcctcggcaggatggctagctcgcagtgctgcgcggacccgccgacgctcaaccccgccggcggcgagggcagggtcgtcgacagcctcggcgggatcgcggcgtacgtcgccggctccaccgagtccaaggccgcagtcgtcctcatctctgacgtcttcgggtttgaagcgcccaatctgaggaagatagccgataaagttgcttcgtctggatattttgttgtggtgccagatttcttacatggggatccatatgtacctgaaaacgctgacagaccgatacaagtgtggctaaaagaacatgccccgggaaaagcatttgaacaggcaaaacctgttattgctgctctaaaagaacaaggagtgtctactgttggggctgcaggttattgctggggtgcaaaggtagttgcagagttagcgaaagctaatgagatccaggcagctgttatgtcgcacccttcttttgttactgttgacgatatcaaagaggtgaaatgccccatcgctgtacttggagctgaaattgacagaacatccccaccaaaattggtcaagcagttcgagcagattctatcctctaacacagggattgctcactttgtcaagattttccctggggtttctcatggatggactgtgagatacaaaagtgaagatgcaggtgccgcgaagagcgccgaggaagccctgtcagacatggttgactggtttaacaagaacctaaagtgaacctgaattagtagtctttttttcgtaataagacagtgtcagtcttcaccagtcatcatgcaaacatccagggtttatgctattgtcctagctatagggcctgtatcaatggtcgtgtaggtgtctgtcgtgtgctagtattcattgtgtgcttgcttatagcggtgtatgcttgtactgaacacataactataatattattgcactgaaataaaatgcgatatgtgtatctaa

SEQ ID NO: 1275 - DNA, 1216 bp, Triticum aestivum
ttcccagccccaaacccccggccaccagcagcctcggcaggatggctagcccgcagtgctgcgcggacccgccgacgctcaaccccgccggcggggagggcagggtcgtcgacagcctcggcggggtcacggcatacgtcgccggcgtccgagagtccaacgccgccgtcgtcctcatctccgacatctttgggtttgaagcgccgattctgaggaagatagccgataaagttgcttcgtcgggatattttgttgtggtgccagatttcttacatggggatccatttgtacctgaaaatgctgacagaccaatacaagtgtggatcaaggaacatcccctgggaaaagcatttgaagaggcaaaacctgttattgctgctctaaaagaacaaggagtgtctactgttggggctgcaggttattgctggggtgcaaaggtagttgcagagttagcgaaagctaatgagatccaggcagctgttatgtcgcacccttctgctgttactgttgacgatatcaaagaggtgaaatgccccatcgcggtacttggagctgaaaatgacaaaacatccccaccagaattggtcaaacagtttgagcaggttctatcctctaacacagggattgctcactttgtcaagattttccctggggtttctcatggatgggctgtgagatacaaaagtgaagatgcaggtgctgtgaagagcgccgaggaagccctgtcagacatgattgactggtttaacaagaacctaaagtgaacctgaattagcggtccttttttcgtaataagccagtgtcactcttcaccagtcatcatgcaaacatccagggtttatgctattgtcctagctatagggcctgtatcaatggtcgtgcaggtgtctttcatgtgctagtatacattgtgtgcttgctcatagcggtctctgcttgtattgaacacattactataatattattgcagtgaaataaaatgtgatatttgtagttttgagagttggtccacttgtctgtctgtctttatataatttgtgtggtgattattgttctctcatttttcgttattataaaatgattggctctgcccacacaaagctgcaggccgctgccgtcatctccaacacctccggtaaggcaactggtcgatctccaacacctgcagctttccagactctggtgcctatagagtatgtataccgagtaacactga

SEQ ID NO: 1276 - DNA, 1179 bp, Secale cereale
aaaactacaaataccgcattttatttcagtgcaataatattatagtaatgtgttcagtacaagcagaatccgctatgagcaagcacacaatgtatactagtactccctctataaactaatataagagcgtttagatcactaatgtagtgatctaaacgcttttatattagtttaaccgtggggtgtacatgacacctgcacgaccattgatacaatccctatagctaggacaatagcataaaccctggatgtttgcatgatgactggtgaagagtgacactggcttattacgaaaaaaggaccgctaattcaggttcactttaggttcttgttaaaccagtcaatcatgtctgacagggcttcctcggcgctcttcacagcacctgcatcttcacttttgtatctcacagcccatccatgagaaaccccagggaaaatcttgacaaagtgagcaatccctgtgttggaggatagaacctgctcgaactgtttgaccaattctggtggggatgttttgtcattttcagctccaagtacagcgatggggcatttcacctctttgatatcgtcaactgtaacagcagaagggtgcgacataacagctgcctggatctcattagctttcgctaactctgcaactacctttgcaccccagcaataacctgcagccccaacagtagacactccttgttcttttagagcagcaataacaggttttgcctcttcaaatgcttttcccaggggatgttccttgatccacacttgtattggtctgtcagcgttttcaggtacaaatggatccccatgtaagaaatctggcaccacaacaaaatatcccgacgaagcaactttatcggctatcttcctcagaatcggcgcttcaaacccgaagatgtcggagacgaggacgacggcggccttggactctcgggtgccggcgacgtacgccgcgatcccgccgaggctgtcgaccaccctgccctccccgccggcggggtcgagcgtcggcgggtccgcgcagcactgcgggctagccatcctgccgaggctgctggtgcctgggggttggggctgggaaccagacaggccgacggaggtgagctgaggaggaggaggcccaggcgacggcagcgcagcgaccggaggacagcggaagtctttgactacgagttgtttcga

SEQ ID NO: 1277 - DNA, 979 bp, Lolium multiflorum
tgcaggtacccgggattcggccattacggccgggggcccgagtcctcctcctccgtcgcctggtttacaaattccgatcccaccttccaagcactactcaccctccagcgcaacctgagcaatatggctagcccgcagtgctgcgcgaacccgccatcgctgagccccgccggcggggagggcaaggtcgtcgacagctttggcgggatcagggcctacgtcgccggcgcccaagactccaaggccgccgtcgtcctcatcgccgatgtcttcggatttgaagcgccgaaactgaggaagatagccgataaagttgcttcgttcggatactttgtcgtggtgccagacttgttacatggggatccatatgtacctgaagacgctgatagaacaatacaagtgtggctaaaggagcataacccgatcaaggcatttgaactggcaaaaccagttattgctgctctaaaggaacaaggagtgtctagtgttggggctgcaggttattgctggggtgcaaaggttgtagcagagttagcgaaagctaatgagatccaggcagctgttatgtcacatccttcttttgttaccgttgatgatatcaaagaggttaaatgccccatcgctgtacttggagctgaattgacagaacgtccccaccagaattggtcaagcagttcgagcaggttctatcctctaattcagagattggctcctttgttaagatttttcctggggtttctcatggatgggctgtcagatacgatagcgatgacgcggctgctgtgaagaacgccgaggaagccctgacagacatgactgactggtttaacaaaaacctcaagtgaacctgaagtagtaaaacctcaagtgaacctgaagtagtcgccctccatttataataagccattctcactcttcgccagccatcatgcatgcaagaattaatcctgggtttatggtatggtatttgccctgcatc

SEQ ID NO: 1278 - DNA, 1015 bp, Avena sativa
ctggtttccaatcccacctcccaagcaccactagcatccacccagcagcgcatcctctgtcaggatggctagcccgcagtgctgcgcgtcccgccgacgctcagccccgccgccggggagggcaaggtcgtcgacagcttcggcggactcagggcgtacctcgccggcgcccaagagtccaaggccgccgtcgtcctcatctccgatgtctacgggtttgaagcgcctaatctgagaaatatagcagataaagttgcttcgtctggatactttgttgtggtgccagatttcttacatggggatccattcgtgcccgcagacgctgacagaccaatacaagtgtggttaaatgagcattccccgaacaaggggtttgaagaggcaaaaccggttattgctgctctaaaggaacaaggagtctctgttgttggggctgcaggttattgctggggtgcaaaggtagttgcagagttggcaaaagctaatgagatccaggcagctgttatgtcacacccttcttttgttacagttgatgatatcaaagaggtgaaatgccccattgctatacttggagctgaaactgacgtaatgtcgccaccagaattggtcaagcagttcgagcaggttctatcctctaacgcagggattggttcctctgtcaagattttccctggggtttctcatggatggactgtgagatacgacagcaacgacgcagctgctgtgaagaacgctgaggaagccctggcggacatgattgaatggtttaacaagaacctcaaatgaacctgaagtagcagccctccttttttaataagtcatttgtcacttttcagtcatcatgcaagcatcctgggcttatggtatggtattagctgtagggcctgcatcgttgtctggcgcaggtttactggtatttgtatgtactgtatgtgatttgctcctttgggtgtctgcttgtgctgaacgctgaattattgaactcgaataaaatttggcatttgcagttttgaga

SEQ ID NO: 1279 - DNA, 1365 bp, Brachypodium distachyon
ggaacctcctcctctttccccacttggacgagaacagattcgaaacaatttcgccctcaagcgtccgctgtccttctccccccatttacctcgtgtcgctgcgttgttgtcgcctggtcctcctgtctgctttccaatctcaacttcccaagcacaccactagcccccatccgcgcaaccaggagaggaggagacaggcggcttgactatggcaagcccacagtgctgcgcgaacccgccgacgctgaaccctgccggcggggagggcaaggtcgtcgacagcttcggcgggatcagggcgtacgtcgccggcgcccaagagtccaaggcagccgtcatcctcgtctccgacgttttcgggtttgaagcgccgaatctgaggaagatagctgacaaagtagctttgtctggatactttgtcgtggtgccagatttcattcatggggatccatatgtgcctgaaagtgttgataaaccaatagcagtgtggataaaggagcatgccccggaaaaagcatttgaagaggcaaaaccagttattgctgctctaaagaaacaaggagcctctagcgttggggctgcaggttattgctggggtgccaaggtagttgtagagttagcgaaagctaatgagatccaggcagccgttatgttgcacccttcttttgtaactgttgatgatatcaaagaggtgaaatgccccatcgctatacttggagctgaaattgacaaaatgtccccaccagaagtggtcaagcagttcgagcaggttctatcctccaactcaggggttggtcactttgtgaagattttccctggagttgctcacggatggactgtgagatacaacagcgacgatgcctctgctgtgaagagcgccgaggaagccctggccgacatgactagctggtttgaccagaacctcaagtgaatctgaagcagcagccctcttataataagctattgccttcggcagtcatcatgcaagcatccggggtttatgttatggaattagatataggatctgtatcttctgcgcaggcttgctagcagtatgacatcctcattttggagtttccttatgctgaacgtagcactactgcactgaaataaaatgtgatatttgctggtttcgacaactgatacgcctctaactactcaggtgattgggttcgtcccttttacgatatcataatgattgacttcgtttgcacaaaagcagcaaggggatgtacaattgtagagaaggtttcttctctaccgtgccgcaccatcctatgattgcgctagcatataggggttggtatatgtgatattgggattggagtttgcaaatatctttagtaaaggggcaaagcaaaccag

SEQ ID NO: 1280 - DNA, 942 bp, Avena sativa
atggctagcccgcagtgctgcgcggacccaccggcgctcaaccccgccggcggcgagggcaaggtcgtcgacggcttcggcggggtcccggcgtacgtcgccggcgcccgagagtccaaggccgccgtcgtcctcatctccgacgtcttcgggtttgaggctccgattctgaggaagatagccgataaagttgcttcgtctggatattttgttgtggtgccagatttcctacatggggatccatatgtacctgaaaacgctgacagaccaatacaagcgtggttaaaagaacatgccccgggaaaagcatttgaagatgcaaaacctgttattgctgctctaaaagaacaaggagtgtctactgttggggctgcaggctattgctggggtgcaaaggtagttgcagagttagcgaaagctaatgagatccaggcagctgttatgtcacacccgtcttttgttactgttgatgacatcaaagaggtgaaatgccccatcgctatacttggagctgaaactgacaaaacatccccaccagaattggtcaaccagttcgagcaggttctgtcatctaactcagcgattgctcactttgtcaagattttccctggggtttcccatggatggactgtgagatacgacagcgaagacgcagctgctgtgaagtgcgctgaggaagccctggcagacatgactagctggtttgacaaaaacctcaagtgaacgaaatgaagtagcagtccaccttcggtaacaaaatattgtcactcgtcaccagtcaatacgaactttatgctatggtattagctataggtcctgcatctttgtctggtgcaggcgtactagtattggtatgtatgtggttgttggtccggggttctgcttctccggaacactgaactgaaccattgtgctgaaataaaatgtgatatttgattttca

SEQ ID NO: 1281 - DNA, 1254 bp, Oryza sativa
aaccccccaaacctccggattccggaacttgtccaccacaccacctcgttgctcgcatctcttcctgatcccccccgttggattcgattcggggcgtaaaatttcctgctctgcaatccgtcgcaatcaagcggccgctttccgaggccccgggctcccttcccttcgcatttatcctcgctgagactcgagaaacaccgcgaccaggagaaatttcagcaggagcaggcgatggcgagcccgcagtgctgcgcgaacccaccgacgctgaacccggccggcggggaggggaaggtggtggagagcttcggcgggatcaaggcgtacgtcgccggcgccgcggagtccaaggccgccgtcgtcctcatctccgatgtcttcgggtttgaagcgccgaacctgaggaagatagccgacaaagttgcctcgtctggatactttgttgtggtgccagatttcttacatggggatcctttagtacctgaaagtactgagaaaccgtttcaaatgtggataaaagaacatggcccggacaaagcatttgaagaggcgaaaccaattattgccgctctgaaggagaaaggagtgtctagtattggggctgtaggttattgctggggtgcaaaggtggtggtagagttagtgaaagctcatgagatccaggctgctgtgatgtgtcacccctcttttgtgactgttgatgatatgaaagaggtcaaatgcccaattgctatacttggagctgaaattgatcgtatgtccccaccagaagtggtgaagcagttcgagcaggttctttcttcaaagtcagggattggccactttgtcaagatcttccctggggttgaacatggatggactgtgagatacaagaatgatgatgcagctgctgtcaagagcgccgaggaagccctggcggacatgattgactggtttaataagaacctgaagtgaatttgacatatccgctgtccacgatcggtttgtgtattgctcatgtttcatcgcaagcatcctgaatttacggttgagtagccttcccattatgtttgtgctagtagtgtatatgctttgcttgtgttaggaatttgctttgtgtcaacctgaacttccacttctgtaataaaaatggatgggcgagcatcttctcggtttggtggtcacgactgacgagaacatatcattttgttacatcgaacttttgaaactttgcacataacctggtcatctggcttttctagcaccatcgatttg

SEQ ID NO: 1282 - DNA, 1059 bp, Panicum virgatum
cctccgtccgttgctgccgtctcgtgtctcgtcccttccgcgcgcatctagccttgccgccaaccgccaccaccgcagccggggagagagagagagagcggagcacgagggcgggggggacggatggcgagcccccagtgctgcgagaacccgccgacgctgaacccggccggcggggcgggcaaggtcgtggacagcttcggcgggctcaaggcctacgtcgccggccccgaggactccaaggccgccgtcgtcctcgtcgccgacgtcttcgggtttgaagcgccgaatctgaggaagatagccgacaaggttgctctgtcaggatactttgttgtggtaccagatttcttccatggggatccttacgtacctgagaatactgagaggcccattcctgagtggctaaagtcgcatactccggaaaaagggtttgaagatgcaaaaccagttattgctgctctaaaggagaagggagtgtctgctgttggagctgcaggttattgctggggtgctaaggttgttgtggagttggcaaaagctaaggagatccaggctgctgtaatgttgcacccttcgtttgtttcagttgacgatatcaaagaggtcaaatgccctatttctgtactgggagctgagattgacaaaacgtccccgccagaattagtcaagcaatttgagcaggttctttctgccaactcaggggttggtcacttcgtcaagattttccctggtgtgtctcatggatggagcgtgaggtacagcgaagatgatgcagctgccgtgaagagtgccgaggaagccctggcggacatgatcgactggttcaacaagaacctgaaatgaactatgtagttgcatcctgccttgtaatgaagcacattctagtgcggtcgtcattggagtattgtgggattatcagctatcttagggccttcttcgtcaggtcgttgtagttctcacggtctgtgcttgtacacgtttgccgtagactggttgtgctcattccgtaataaaaagaggtaaattgtgtccaaaacaaatgtttttttggatttt

SEQ ID NO: 1283 - DNA, 909 bp, Panicum virgatum
cggatggcgagcccccagtgctgcgagaacccgccgacgctgaacccggccggcggggcgggcaaggtcgtggacagcttcggcgggctcaaggcctacgtcgccggccccgaggactccaaggccgccgtcgtcctcgtcgccgacgtcttcgggtttgaagcgccgaatctgaggaagatagccgacaaggttgctctgtcaggatactttgttgtggtaccagatttcttccatggggatccttacgtacctgagaatactgagaggcccattcctgagtggctaaagtcgcatactccggaaaaagggtttgaagatgcaaaaccagttattgctgctctaaaggagaagggagtgtctgctgttggagctgcaggttattgctggggtgctaaggttgttgtggagttggcaaaagctaaggagatccaggctgctgtaatgttgcacccttcgtttgtttcagttgacgatatcaaagaggtcaaatgccctatttctgtactgggagctgagattgacaaaacgtccccgccagaattagtcaagcaatttgagcaggttctttctgccaactcaggggttggtcacttcgtcaagattttccctggtgtgtctcatggatggagcgtgaggtacagcgaagatgatgcagctgccgtgaagagtgccgaggaagccctggcggacatgatcgactggttcaacaagaacctgaaatgaactatgtagttgcatcctgccttgtaatgaagcacattctagtgcggtcgtcattggagtattgtgggattatcagctatcttagggccttcttcgtcaggtcgttgtagttctcacggtctgtgcttgtacacgtttgccgtagactggttgtgctcattccgtaataaaaagaggtaaatt

SEQ ID NO: 1284 - DNA, 1295 bp, Panicum virgatum
cccacgcagtctcgaacctaccccctttcccggccggccggccggtcgtccccctccgttcgttctccacgcagtttggaatctcgaaccgccggtggccgtcgctgtcgctcgatcaaaacccccacgcgaccacggcgctctccggtctctgcctgtcccccatttaatacccgtgctccgtccgttaatgccgtctcgagtctcgtcccttcttcgcgcatctagcctcaaccgccagccaaccgccagtccgccaccaccgcagcccgggagagagagagagcagagcacgagggcgggggcggatggcgagctcccagtgctgcgagaacccgccgacgctgaacccggccggcggggcgggcaaggtcgtggacagcttcggcgggctcaaggcctacgtcgccggccccgaggactccaaggccgccgtcgtcctcgtcgccgacgtcttcgggtttgaagcgccgaatctgaggaagatagccgacaaggttgctctgtcaggatactttgttgtggtaccagatttcttccgtggggatccttacgcgccagagaatactgagaggcccattcctgagtggctaaagtcgcatactccggaaaaagggtttgaagatgcaaaacccgttattgctgctctaaaggagaagggagtgtctgctgttggagctgcaggttattgctggggtgcaaaggttgttgttgagttggcaaaagctaaggagatccaggctgctgtactgttgcacccgtcgtttgtttctgttgatgatatcaaagaggtcaaatgcccgatttctgtactgggagctgagattgacaaaatgtccccgccagaattagtcaagcaatttgagcaggttctttctgccaattcaggggttggtcacttcgtcaagattttccctggtgtgtctcatggatggagcgtgaggtacagcgaagatgatgcggctgccgtgaagagtgctgaggaagccctggcggacatgatcgactggttcaacaagaacctgaaatgaactctggagtggcactctgccttgtaataaagcacatcctagtgcgcttgtcgtcggagtattgtgggattatcagctgtgttagtgttagggcctgcttcgtcaggtcattgtagttctcacggtctatgtgcttgtacacgttcgccgtagactggttgtgctcaatccgtaataaaaaggtaaattacgaggacgatatgtgtccataacaaatacttctttggatatttatcgaaaaaatatatttcatgcttgagagca

SEQ ID NO: 1285 - DNA, 787 bp, Brachypodium distachyon
tcagctcctcggcctctttccaatcccaaccccggcaggcaggagataggcgtgaggagcgaggatggcgagtccgcagtgctgcgcgaacccgccgacgctgaaccccgccggcggagagggcaaggtcgtcgacagcttcggcgggaccagggcgtacgtcgccggcgctgaagagtccaaggccgccgtcatcctcatctccgacatcttcgggtttgaagcgccgaaactgaggaagatagccgacaaagttgcttcgtgtgggtactttgttattgtacctgatttcttgcatggggaaccatttgcacatgaaaacgctgatagaccgtttccagtgtggatagaggcgcatgccccgggaaaagcatatgaagaggcaaaaccaattattgctgctctaaaggaacacgggatgtctactgttggggctgcaggttattgttggggtgcaaaggttgttgcagagttggcaaaagctcatgagatccaggcagctgttatgttgcacccttcttttgttacaattgatgatataaaagaggtgaaatgccccaccgctattcttggggcggacattgacaaaatgtccccaccagaattggtcaagcagttcaaggaggttctatcatctaactcagggattggtcactttgtcaagatttaccctggggttgctcatggatggactgtgagatacaacagcgatgatgctgctgctgtcaagagcgcccgggaagccctagcagatatgaccgattggtataacaagaacctcaagtga

SEQ ID NO: 1286 - DNA, 2676 bp, Secale cereale
gactgcttctccgattgatttcgttccatcatcatctcatctcacagccaaaagaccgcgacgcccggctcccgtccccgtcgcgatttgattcgtctccccacctcccgttccgctgccccatgcctcccgcccgccccctgcgcgccgactcctcttgaccccgtccccggcgacgacgccatggccgtcgattccgacagaggggagggggatttggagattgggctggcgtcgccggggtcggagggaggaggggtttcgcccgtcgccccaggccgccgggcgctcgagtcctgcctctccgggaagcgcctcgaccagtcgccgtcgccgtcgcgggcggtcaggcgccccgcgctagtcatgtccagctccgggaagcgcctcgaccagtcgccgtcgccctcgcgcccggtgctggctatgtcccactccagcaaccgcctggaccagccgcccggccgcccggtgctggccatgtcccgctccagcaaccggctcgaccactcgccgtcgtcgtcgtccccgactccggccaagggcccggcgctcgtcatgtccggctccagcaagcggctggagcagtcgctcgcgtccccgtccccgtcgcccaaggccggcgccgcggcgccgcccgtgctggtgctctccaactccggcaagcggatggaccaggcgggccggaagaagtacgtcaagcaggtcacgggccggcacaacgacacggagctccacctcgccgcgcagcgcggggacctcgacgccgtgcgccagatcatcgccgaaatcgacgcgcagatgaccggcaccggggaggagttcgacagcgaggtggcggagatccgcgccgccgtgctcaacgagcccaacgaggtcggggagaccgcgctgctcatcgcagctgagaaagggttcatcgacgtcgtcgtcgagctgctcaagcactctgacaaggagagccttgcggggaagaacaaatcaggattcgatgctctgcacgtcgctgcaaaggaaggccaccaagatattgtcaaggtactcctggaccatgatccatcccttgggaaaacgtttggccaatcaaatgtgactcctctgataactgcggcgatcagagggcacctcgaagtagtgaaccttttgctggaacgagtttctgggttggttgaactgtcaaaggcaaatggaaagaatgcattgcatttcgctgcccgtcaggggcatgttgaaatagttaagtctttgctagtcagtgaagctcagcttgctcggaagactgataagaaaggacagaccgctttgcatatggcggttaaaggaacgagtgctgcggttgttagagcactcgtgaatgctgatccggccatagttatgcttcctgacaaaaatggcaacttagctttgcatgttgctaccaggaagaaaagatcagagattgtgaatgagcttctgcttcttccggacatgaatgtgaatgcgctgactagggatcgcaagactgcattcgacatagcagagggtcttccgctatcagaggagtctgcggatataaaggattgtttatcccgtgctggtgcagtaagagcaaatgatctgaatcagcctcgggatgagctgagaaaaacagtgactgagatcaagaaggacgtacacactcaacttgagcaagccagaaaaaccaacaaaaatgtgcatggcatagcaaaggagctgaggaagctccacagggaaggcatcaacaatgcaacaaactctgtcacagttgtggctgtgctcttcgccacagttgcatttgctgcgatattcacggtgccaggcggtaacgacgaccatggtgtagcaatagttgtgcatgcggtatccttcaaggtcttcttcatcttcaatgccatcgccttgttcacatcattagcagtagtggtggtccagataacacttgttaggggcgagacgaaagcagagaggcgagttgtggaggtgatcaacaagttgatgtggctagcttctgtatgcaccacggtggcattcatatcctcctcttacatagtggtgggtcggcacttcaagtgggcggcgctgctggtgactctcattgggggggtgatcatggccagtgtgctcggcacgatgacatactatgtggtgaagtccaagcgcacgcggtccattaggaagaaggtgaagtcaacaaggcggagcggctcaaactcatggaaccacaactccgagtcagattccgagatagaccggatatacgccatatgagggtgatctccggtcttctacggatcctcagtctttttggcggcgccacacgacacgggtgtaaaaagaaaggtgggatggcactcagtatgaacagctttgatcctccaggtgccataggttttaccgtatacattccaataagctggtgttcctggatcggcaggaggagccaggaggcgacggtcgtgttgtatacatcttctacagatagattgtcttcgtcagaatatgcatgcagcctgtgctgtgctccctatgcatggctggctggctggccttcataaaatttctcagcctttttctctaccttttgttaatatgctgtggtagctgaatggtatgtgtacttagcactctgtaccttgtactatttcatctgatagctgagaaagttctagaagcttc

SEQ ID NO: 1287 - DNA, 2392 bp, Triticum aestivum
ctccgggaagcgcctcgaccagtcgcccgcggcgtcgccgtcgccctcgcgcccggtgctggtcatgtcccactccagcaaacgcctggaccagccgcccggccgccccgtgctggccatgtcccgctccagcaaccgcctcgaccactcgccggcgtcgtcctcgtccccgacgcccgcgaagggcccggcgctcgtcatgtccggctccagcaagcggctggaacagtcgctcgcgtccccgtccccgtcgcccaaggccggggccgcggcgccgcccgtgctggtgctctccaactccggcaagcggatggaccaggcgggccggaagaagtacgtcaagcaggtcacgggccggcacaacgacacggagctccacctcgccgcgcagcgcggggacctcgacgccgtgcgccagatcatcgccgaaatcgacgcgcagatgaccggcaccggcgaggagttcgacagcgaggtggcggagatccgcgccgccgtgctcaacgagcccaacgaggtcggggagaccgcgctgctcatcgccgctgagaaagggttcatcgacgtcgtcgtcgagctgctcaagcactctgacaaggagagccttgcgaggaagaacaaatcaggattcgatgctctgcacgtcgctgcaaaggaaggccaccgagatattgtgaaggtactcctggaccatgatccatcccttgggaagacgtttggccaatcaaatgtgactcctctgataactgcggcgattagaggccacctcgaggtagtgaaccttttgctggagcgagtttctgggttggttgaactatcaaaggcaaacggaaagaatgcattgcatttcgctgcccgtcaggggcatgttgaaatagttaagtctttgctagtcagtgaagctcagcttgctcggaagactgataagaaaggacagaccgctttgcatatggcggttaaaggaacaagcgctgcagttgttagagcactcgtgaatgctgatccggccatagttatgctacctgacaaaaatggcaacttagctttgcatgttgccaccaggaagaaaagatcagagattgtgaatgagcttctgcttcttccggacatgaacgtgaatgcactgactagggatcgcaagactgcattcgacatagcagagggtcttccattatcagaggagtctgcggatataaaggattgtttatcccgtgctggtgcagtgagagcaaatgatctgaaccagcctcgggatgagctgagaaaaacagtgactgagatcaagaaggacgtacacactcaacttgagcaagccagaaaaaccaacaaaaatgtgcatggcatagcaaaggagctgaggaagctccacagggagggcatcaacaatgcaacaaactctgtcacagttgtggctgtgctcttcgccacagttgcatttgctgcgatattcacggtgccaggcggcaacgacgaccatggtgtagcaattgttgtgcatgcggtatccttcaaggtgttcttcatcttcaatgccatcgccttgttcacatcattagcagtagtggtggtccagataacacttgttaggggcgagaccaaagcagagaggcgagttgtggaggtgatcaacaagttgatgtggctggcttctgtatgcaccacggtggcattcatatcctcctcttacatagtggtgggtcggcacttcaagtgggcggcgctgctggtgaccctcatcggcggggtgatcatggccagtgtgctcggcacgatgacatactatgtggtgaagtccaagcgcacgcggtcgattaggaagaaggtgaagtcaacaaggcggagcggctcaaactcatggaaccacaactcggagtcagattccgagatagaccggatatacgccatatgagggtgatctccggtcttctatggatcctcagtgttttcggcggcgccagacgacacggatgtaaaaagaaaggtgggatggcactcaatatgaacagctttcaccctccaggtgccaagggttttaccgtatacattccaataagctggtgttcctggatcggcaggaggagccaggacgcgacggtcgtgttgtatacatcttctacagatagattgtgatcatcagaatatgcatgcagcctgtgctgtgctccctatgcatggctggctggctggccttcataaaatttctctcagcctttttctgtaccttttgttaatatgctgtggtagcagaatggtcggtatgtgtacttagcactctgtaccttgtatttcatctgatagctgagaaggttctagaagcttctagtgaagcctggcgaatgctccttgttcctctctttttgggcacgtgagaactgtaagatttttccatgat

SEQ ID NO: 1288 - DNA, 3280 bp, Brachypodium distachyon
aaccggagtgccgaagccacataaaccagaccgagacccagccgggaactggagaggccaagcaaacggcgcttctccgatttcattccattccatcacacaagacacaaccaagcgaccgcgacgcccacggcacccctccctcgccctctctcccgtcctgttcgcgattcgattcgcctccccacctcccgttccgccgccgccccatgcctcctgcccgccccatctgcgccggctcttgaccccgccgacgacgccatggctgtcgatcccgccagaggtatgtatcgcttgtatgattggttttgttttggtttgatcggacgttttggtgatcgctgtggttgatttcctgtgccgggtgcaggggagggggatttggagattgggctggcgtcgccggagtcggacggaggggtttcgccggtggtgggcccaggccggcaggcgctcgaccagtcgtcgccgcgggcggtgaggcgccccgggctagtgatgtccaactccggaaagcggctggaccagtcgccgttgtcgtctccgtcgcgtccggtgctgctgatgtcccactccagcaaccggctggagtaccaggcgccggggcggccggcgctggtgatgtcccgctccagcaaccggctggaccagtcgcccgcgtcgtccccgacgccgacaaagggcccggcgctcgtcatgtccggctcgagcaagcggttggagcagtcactagcgtccccgtccccgtcgccaaaggccggggccgcggcgccgcctgtgctggtgctttccaactcgggcaagcggatggaccaggccgggcggaagaagtacgtcaagcaggtgacgggccggcaaaacgacacggagctccaccttgccgcgcagcgcggggaccttgacgccgtgcggcagatcatcgccgaaatcgacgcccagatgaccggcaccggggaagagttcgacagcgaggtggcggagatccgtgctgccgtggtcaacgagaccaacgaggtggaggagaccgcgctgctcatcgccgccgagaaagggttccttgacatcgtcatcgagctgctcaagcactctgacaaggagagccttgctcggaagaacaaatccggatttgatgctctgcatgtcgctgcaaaggaaggccgccgagatgttgtgaaggtactcctggaccatgatccttcccttgggaaaacgtttggccaatccaatgtgactcctctgataactgcggcgattagaggccacatcgaggtagtgaaccttctgctcgagcgagtttctgggttggttgagctatcaaaggcaaatggaaagaacgccttgcatttcgctgcccgtcaggggcatgttgaaatagttcagtctttgttagacagtgatcctcagcttgctcggaggactgataagaaaggccagacagctttgcacatggcagtgaaaggaacaagcgctggggttgttagagcactcgtgaatgctgatccagccatagtcatgctacctgacagaaatggcaacttagctttgcatgttgccacaaggaagaaaagatctgagattgtaaatgtgctactgcttcttccggacatgaacgtgaatgcactgactagggatcgcaagactgcatttgacattgcagagggccttccgctgtcagaggagtctgcagagataaaggactgtttatcccgtgctggtgcagtgagagcaaatgatctgaatcagcctcgggacgagctcagaaaaactgtgactgagatcaagaaggacgtgcatactcaacttgagcaagccagaaaaactaacaaaaatgtccatggcatagcaaaggagctgaggaagctccaccgggaaggcatcaacaatgcaacaaactctgtcactgttgtggctgtgctcttcgctacagtcgcatttgctgcaatatttacagtgccaggcggtaacgatgatcatggcgtagcaatagccgtgcatgcagtatccttcaaggtctttttcctcttcaatgccgtcgccttgttcacatcattagcagtagtggtagtccagataacacttgttaggggtgagaccaaagcagagaggcgggttgtggaggttatcaacaagttgatgtggctggcttctgtatgcaccacagtggcattcatatcctcctcttacatcgtggtgggccggcacttcaggtgggcggcgcttctggtaaccctcatcggcggggtgatcatgaccggcgtgctcggtacaatgacatactatgtggttaaatccaagcgcacacgtttgatcaggaagaaggtaaaatcaaggcggagtggctcacactcatggcagcacaactcggagttctcggactcggagatagaccggatatacgccatatgaagctgactatggtcgatggatcctcagttttgtttggcagtgatacgacacgaatgtataaaagaaattggatgccactcagtataaacagattgaccctctgtggtgccaggggtttactgtatagtacattccaataagctggtgtgaactgccattttccactctctggatgagcaggagccgacggtcttgttgtatactactgaagatagattggtcatcagaattatgcctgagcctgtgctgtgctccctatgcatggctggccttcatcagatttctctcagctttttcttcccacttatgttaatatctgtggtagcagaataatgtgtacttagccttgtgttccgtgcacatcctgttgtgcggcatgcacaatgttgttgtatggtagctgagaatgttctagaaacttatgctagtccttgagtccaggcactgagaggagacattgaggccaggattcctttgctatttcttctcagggcacgtgagactgagaactgcaagaaaaatcttccatgattccttttgttctacaggacaggacaaacctggagtggcagcagcacgctgccaagtcgccgcgacggagacgggcgatcaagttgtcgattgagcttgaccttgtgggtgtgaacccgcgcgcttgagaaccggacggtaaaggtgaaacgtcacgcaagattacggtggttctgccgcgtgctccagggcaagataaccgtggactcggttgacttgtgatgcggggtcgcactccacgactctacattattggttgatcaaagaactctttagttgcttgcagtactagagtaattgcgacatgccggccagaattggctgcgtgccatgttgtaccagt

SEQ ID NO: 1289 - DNA, 2603 bp, Avena sativa
gcctgcctgcctcgacacccgtctcctccctccgcgattcgattcgatcgtctccctcccccacccctccgttcctcgctgccccatgccgccacaccccgcccgcgcagacccctcttgacccccgcctcccgccgacgccatggccgtcgattccgacagaggggagggggatttggagattgggttggcgtcgccgcggtcggagggaggggtttcgccggtcgccccgggccggcgggcgctggagtcctgcctctccgggaagcgcctcgaccagtcgccgtcgccctcgcgcccggtcaggcgccccgggctagtcatgtccagctccgggaagcggctcgaccagtcgtcgccggcctcgccctcgcgcccggtcctggtcatgtcccactccagcaaccgcctggaccagccttcccccgggcggcccgtgctggtcatgtcccgctccagcaaccgcctggaccagccgtcgtcgccagcgtcgtccccgtccccgacgccgaccaagggcccggcgctggtcatgtccggctccagcaagcggatggaccactccccgtccccgtcgcccaaggcggtgccgcccgtgctggtgctctccaactccggcaagcggatggaccaggcgggccggaagaagtacgtcaagcaggtcaccggccgccacaacgacactgagctccacctggcagcgcagcgcggggacctcgacgccgtgcgccagatcatcgcggaaatcgacgcgcagatgaccggcaccggggaggagttcgacagcgaggtggcggagatccgcgccgccgtcgtcaacgagggcaacgagatggacgagaccgcgctgctcatcgccgccgagaaaggcttcatcgacatcgtcatcgagctgctcaagcactctgacaaggacagccttgccaggaagaacaaatcagggttcgatgctctgcacgtagctgcaaaggaaggccaccgagatatcgtgaaggtactcctggaccatgatccatcccttgggaaaacgtttggccaatcaaatgtgactcctctgataacagcagcgaccagaggccacctcgaagtagtgaaccttctgctggagcgggtttctggcctggttgatctatcaaaggcgaatggaaagaatgcattgcatttttctgcccgtcaggggcatgttgaaatagttaaggctttgctagaatgcgaccgtcagcttgctcggaggactgataagaaaggacagactgccttgcatatggcagtcaaaggaacaagcgctggggttgttaaagccctggtgaacgctgatccggcgatagttatgctacctgacaggaatggcaacttagctttgcatgtcgccaccaggaagaaacgatcagagattgtaaatgagcttctgcttcttccggacatgaacgtgaatgcgctgaccagggatcgcaagactgcgttcgacatagcagagggccttcctctatcagaggagtctgcagatataaaagactgtttatcccgtgctggtgcagtgagagcaaatgatctgaaccagcctcgggatgagctcaggaaaacagtaaccgagatcaagaaggacgtacacactcaacttgagcaagccagaaaaaccaacaaaaaatgtatatggaatagcaaaggagctgaggaagctccacagggaaggcatcaacaacgcgacaaactccgtcacggttgtggccgtgctctttgccacggtcgcatttgccgcgatcttcacggtgccaggcggtaacgaccagaatggtgtggcgatagttgtgcacgcggtatccttcaaggtcttcttcatcttcaacgccatcgccttgttcacgtcattggcggtagtggtggtccagataacacttgttcggggcgagaccaaagcagagaggcgagtcgtggaggtgatcaacaagctgatgtggctggcttccgtatgcaccacggtggcattcatatcctcgtcttacatagtggtgggtcggcacttcaagtgggcggcgcttctggtgacgctcatcggcggggtgatcatggccggcgtgcttggcacgatgacgtactacgtagtgaaatccaagcgcacgcgcaagatcaggaagaaggtgaagtcgacgaggcggagcggctcgaactcttggcagcacaactcggagtcggactcggagatagaccggatatacgccatctgagaagctgtttgtttccggtctatggatccagagttttttttgggcagcgatacgacacaccgatgtaaaaaatgaaagggatgccgccactggctatgaagagcttgaccctggaggtgctaggggtttattgtgtacattcgaataagctcccgttcctggattagcagtaggagccaggagccggcgggtcttgttgtatagtgtatactactactaccggagatagattggtcatcagatcagaatacgcatatgaagcctgtgctgtgctctctgtgcatggctggctaatagaagtactgtgcctgtggtagcggaatgatatgtgtgtacttggcgccctgttcttgcttgataatatagccgagaaggttc

SEQ ID NO: 1290 - DNA, 2777 bp, Panicum virgatum
acgagtaatagattaacacgtccgtaatattacacgagatggatttgtttatgtaaaaaggggcatgtgatcctgacagacacttgcagaaacagggagataattattcagcttggaaagcgccaaatggccatatgcaacgcataccggcaggtggcctggcgcgccaggcccagccacataaacaacagtggaagcggaaacccaacctcctccgtcacacacccacacagcagcgcagcggagaagaccgcgacgcgaccccacaccacccccaagccgagcgcgagcgcgatccctcccgtccgtgttgccctcctgcctcctcctcctccaccccgtcgcttccgtgccatccgcggctcgcctccccacctcccattcccggcgcccgatgcctcccgcccgcccgtagccgcccgacaacgaccgccatggccgccgattccgtcaaaggggtggccgacctggagatcgggctggcgtcgccggggtcggagggcgcgccgtcgccggcgtccagcgccggcgcctccggggagcggcccgaccagtccccggcgcgggcggccaagcgccccggcctcgtcatgtccttctccgggaagcgcctggaccagtcgccgtcgcgcccggtgctcgtcatgtcccactccagcaaccgcctcgaccagtcgcccgcgcgcccggtgctcgtcatgtcgcgctccagcaaccggctcgaccagtcctccccggcgtcgtcgccgtcgctggcgcccgccagggggcccgtgctcgtcatgtccggctccagcaatcggctcgacagctcgcagccgtcgccgtcgccgtcgccgacggccgcggccgccgcggcgccggtgctggtgctctccaactccggcaagcggatggaccaggctgggcggaagaagtacgtcaagcaggtgacgggccgccacaacgacacggagctccacctcgccgcgcagcgcggggacctcgaggccgtgcgccagatcatcgcagagatcgacgcgcagatgaccggcaccggcgaggagttcgacagcgaggtcgctgagatccgcgctgccatagtgaacgaaaccaacgagatggaggagactgctctgctcatcgccgccgagaaggggtttcttgacatcgtcgttgagctgctcaaacactccgacaaggacagcctcacaaggaagaacaagtctggattcgatgctctgcacgtcgctgcaaaagagggccaccgagatattgtgaaggtacttctggaccatgatccatccctcgggaagacgtttggccaatcaaatgtgactcctctcataactgcggccattagaggccacactgaggtggtcaacctgctgctagagcgtgtctctgggttggttgaattatcaaaagcgaatggaaagaatgccttgcacttcgctgcccggcaggggcatgttgaaattgtgaaggctttgctagatgctgaccctcagcttgctcggaggactgataagaaaggccagactgctctacacatggcagtgaaaggaactagtgctgaagttgttcaagggcttgtgaatgctgatccggctatagtcatgctacctgatagaaatggcaatttagctttgcatgttgcaaccagaaagaaaagatcggagattgtaaatgtgcttctgcttcttccagatatgaacgtgaatgcgttgactagggatcggaagactgcatttgatatagcagagggcctgccactatcagaggagtctcaagaaataaaggagtgcttatcccgtgctggtgcagtgagagcaaatgatctgaatcagcctagagacgagctcagaaaaacagtgaccgagataaaaaaggatgtacatactcagcttgagcaggccaaaaaaaccaacaaaaatgtctatggtatcgcaaaggagctaaggaaactccacagggaaggcatcaataatgcaacaaattcagtcactgttgtggccgtgctcttcgccacggtggcatttgctgcaatctttacagtgcctggcggtaatgatgaccatggtgtagcgatagctgtgcacgctgcagcctttaaggtcttcttcatcttcaatgccattgccctcttcacctcgctagcagttgtggtggttcagataacacttgttaggggtgagaccaaagcagagaggcgggttgtcgagatcatcaacaagctaatgtggctggcttcggtatgcacgacggttgcattcatatcctcctcgtacattgtggtggggcggcacttccggtgggcggcgcttctggtgaccttgatcggcggggtgatcatgaccggtgtgcttgggacaatgacttactacgtggtgaaatccaagcgcacacgtaaaatcaggaagaaggtgaaatcaacaaggaggagcggctcaaactcatggcagcacaactcggagttctcagactcggagatcgacaggatatacgccatatgagtccagtaccagctgattcctccaaaccatttggcagtgatacaacacgaatgtaattatgaacatcgatcacgaccctttagatgggggttaactttgtacattccaataagctggtgtaaaactgtcattccccttgttcctgaattagcaggaggcgatggtcttggttgtatactaatacagatagattggtcatcagaatatatattatatgcgcagccagtgttgtgctccttatgcatggcctttattaaattcatctcagccgttagtcaattt

SEQ ID NO: 1291 - DNA, 2600 bp, Setaria italica
tccttcatcacagacgcacacacagcagagaagaccgcgacgcgagcccaccccacccaagccgagcgcgatccctcccgtccgtgttgccctcccccctcctcctcttccaccccgtcgcttccgtgccatccgcggctcgcctccccacctcccattcccgccgccccatgcctcccgcccgcccgtagcccgcccgacgacgaccgccatggccgctgattccggcaaaggggtggccgacctggagatcgggctggcgtcgccggggtcggagggggcgccgtcgccggcgtccagcgcgggcgcctccggggagcggccggaccactccccggcgcgggcggccaagcgccccggcctcgtcatgtccttctcagggaagcggctggaccagtcgccggccgcgtcgccgtcgcggccgttgctcgtcatgtcccactccagcaaccgcctcgactcgtcgcccgcgcgcccggtgctcgtcatgtcgcgctccagcaaccggctggaccagtcctccccggcgtcgtcgccggcgaccgcgaggggccccgtgctggtcatgtccggctccagcaatcggctcgacagctcgcagccgtcgccgtcgccgtccccgtcgccgacggccgcggcggcggtgctggtgctctccaactccgggaagcggatggaccaggcggggcggaagaagtacgtcaagcaggtgacgggccgccacaacgacacggagctccaccttgccgcgcagcgcggggacctcgaggccgtgcgccagatcatcgcggagatcgacgcgcagatgaccggcaccggcgaggagttcgacagcgaggtcgctgagatccgcgccgccatagtgaacgagaccaacgaggtggaggagactgctctgctcatcgccgccgagaaggggtttcttgacatcgtcgttgagctgcttaagcactccgacaaggagagcctcacaaggaagaacaagtccggattcgatgctctgcacgtcgctgcgaaagagggccaccgagatattgtgaaggtacttctggaccatgatccatccctcgggaaaacgtttggccaatcaaatgtgactcctctcataacggcggccattagaggccacactgaggtggtcaacctgctgctagatcgagtctctgggttggttgagctatcaaaagcaaatggaaagaatgccttgcacttcgctgcgcggcaggggcatgttgaaattgtgaaggctttgttagatgctgacacccagcttgctcggaggactgataagaaaggccagactgctctacacatggcggtgaaaggaaccagtgctgaggttgttcaggcgcttgtgaatgctgatccggccatagtcatgctacctgacagaaatggcaacttagccttgcatgttgcaaccagaaagaaaagatcagagattgtaaatgtgcttctgcttcttccagatatgaatgtgaatgcattgactagggatcggaagactgcatttgacatagcagagggcctgccactatcagaggagtctcaagaaataaaggagtgtttagcccgtgctggtgcagtcagggcaaatgatctgaatcagcctagagatgagctcagaaaaacagtgaccgagatcaaaaaggatgtgcatactcagcttgagcaggccagaaaaaccaacaaaaatgtctatggtatcgcaaaggagctaaggaaactccatagggaaggcatcaacaatgcaacgaattcggtcactgttgtggctgtgctcttcgctacggtggcatttgctgcaatctttacagtgcctggcggtaacgatgaccatggtgtagcggtagctgtgcatgcggcagccttcaaagtcttcttcattttcaacgccattgccctcttcacctcgttagcagttgtggtggtccagataacagtggttaggggtgagaccaaagcagagaggcgtgttgtcgaggtcatcaacaagctgatgtggctggcttcagtgtgcacgacagtcgcattcatatcctcctcgtacattgttgtggggcggcacttccaatgggctgcgcttcttgtgaccctgattggcggggtgatcatggccggtgtgcttgggacaatgacatactacgtggtgaagtccaagcgcacgcgtaaaatcaggaagaaggtgaaatcaaccaggaggagcggctcaaactcatggcagcataactcggagttctcagattccgagatcgaccggatatatgccatttgagtccggtaccatctggttcctccaaaccttttggcagtgatacaacacgaatgtaattatgaacatcaatcacgaccctttagatactaggggttaactttgtacattctaataagctggtgtaaaactgccattccccttgttcctggatcagcaggaggcgatggtcttggttctatactactacagatagattggttatcagaatatatattatatatatacacgcagcctgtgctgtgctccttatgcatggccttcatcaatttcatctcaacagttagtcaattcaaatgacagtagcatgatatatttggataccctt

SEQ ID NO: 1292 - DNA, 2939 bp, Panicum virgatum
aagccgagcgcgatccctcccgtccgtgttgccctctgcctcctcctcctcctccaccccgtcgcttccgtgccatccgcggctcgcctccccacctcccattcccggcgcccgatgcctcccgcccgcccgtagccgcccgacgacgaccgccatggccgccgatcccgccaaaggtgcccgcctcttccttagccctcccctcggttgctctggttcgattcgtgccccgttgatcgatcgctcagggatcgcgactctcgggtttgttgcgcgcaggggtggccgacctggagatcgggctggcgtcgccgggctcggagggggcgccgtcgccggcctccagcgcgggcgcctccggggagcggcccgaccagtccccggcgcgggcggccaagcgccccggcctcgtcatgtccttctccgggaagcgcctggaccagtcgcctgccgcgtcgccgtcgcgcccggtgctcgtcatgtcccactccagcaaccgcctcgaccagtcgcccgcgcgcccggtgctcgtcatgtcgcgctccagcaaccggctggaccagtcctccccggcgtcgtcgccgtcgctggcgcccgccagggggcccgtgctcgtcatgtccggctccagcaatcggttcgacagctcgcagccgtcgccgtcgccgtcgccgacggccgcggccgccgcggcgccggtgctggtgctctccaactccggcaagcggatggaccaggcggggcggaagaagtacgtcaagcaggtgacgggccgccacaacgacacggagctccacctcgccgcgcagcgcggggacctcgaggccgtgcgccagatcatcgcagagatcgacgcgcagatgaccggcaccggcgaggagttcgatagcgaagtcgctgagatccgcgccgccatagtgaacgagaccaacgagatggaggagactgctctgctcatcgccgccgggaaggggtttcttgacatcgtcgttgaactgctcaaacactccgacaaggacagcctcacaaggaagaacaagtccgaattcgatgctctgcacgtcgctgcaaaagagggtcaccgagatattgtgaaggtacttctggaccatgatccatccctcgggaagacgtttggccaatcaaatgtgactcctctcataactgcggccattagaggccacactgaggtggtcaacctgctgctagagcgtgtctctgggttggttgaattatcaaaagcgaatggaaagaatgccttacacttcgctgcccggcaggggcatgttgaaattgtgaaggctttgctagatgctgaccctcagcttgctcggaggactgataagaaaggccagactgctctacacatggcagtgaaaggaactagtgctgaagttgttcaagggcttgtgaatgctgatcctgctatagtcatgctacctgatagaaatggcaatttagctttgcatgttgcaaccagaaagaaaagatcagagatcgtaaatgtacttctgcttcttccagatatgaacgtgaatgcattgactagggatcggaagactgcatttgacatagcagagggcctgccgctatcagaggagtctcaagaaataaaggagtgcttatcccgtgctggtgcagtgagagcaaatgatctgaatcagcctagagacgagctcagaaaaacagtgacagagatcaaaaaggatgtacatactcagcttgagcaggccagaaaaaccaacaaaaatgtctatggtatcgcaaaggagctaaggaaactccacagggaaggcatcaataatgcaacaaattcagtcactgttgtggccgtgctcttcgccacagtggcatttgctgcaatctttacagtgcctggcggtaacgatgaccatggtgtagcaatagctgtgcacgcggcagccttcaaggtcttcttcatcttcaatgccattgccctcttcacctcattagcggttgtggtggttcagataacactggttaggggtgagaccaaagcagagaggcgggttgtcgagatcatcaacaagctgatgtggctggcttcagtatgcacgacagtcgcattcatatcctcctcgtacattgtggtggggcggcacttccggtgggcggcgcttctggtgaccttgatcggcggggtgatcatgaccggtgtgcttgggacaatgacttactacgtggtgaagtccaagcgcacgcgaaaaatcaggaagaaggtgaaatcaacaaggaggagcggctcaaactcatggcagcagaactcggagttctcagactcagagatcgaccggatatacgccatatgagtccagtaccagctgattcctccaaatcttttggcagtgatacaacacgaatgtaattatgaacatcgatcacaacccttgagatgggggttaactttgtacattccaataagctggtgtaaaactgccattccccttgttcctgaattagcaggaggcgatggtcttggttgtttactactacagatagattggtcatcagaatatatattatatacgcagccagtgttgtgcttcttatgcatggcctttattaaattcatctcaaccgttagtcaatttaaatgacagtagcatgatatattcggataccctgcttttgatattctgtcctcagagacgcatccatggagaggagacaggagaacggaagatccttttttccagtcgttttccacgacaggtgagaggtgagaaattcgctgttctggtattctgttgcttagtgtttttttctctgtaggacaggacaccctggagctggagtgcacttggaagtcatggcgatggagacgggcaatcaggaggaggtatgtactgagacgagagcctggcctcaacttgatcgccgttcgtgtcactgcagtgtctggattctgaaaaccgcat

SEQ ID NO: 1293 - DNA, 2528 bp, Zea mays
aggccgacaccgagcgcgagccctccagtccgtggtgctcttcgcgctccgccttcctcctcttccaccccgtcgcttccgtgccatccgcggttcggctccccacctcccattctcgccgccccatgcctccggctcgcccgtagccgcccgacgacgaccgctatggccgccgattccggcaaagggatggctgacctggagatagggctggcgtcgccgggctcggagcgggcgccgtcgccggcgtcgagcgcgggcgcctacggggagcggcccgaccagtcgccgccgcgggttgccaagcgcccaggcctcgtcatgtccttctccgggaagcggctggaccagtcgccggccgggtcgccgtcgccgtcgccgtcgtcgtcgcgcccggtgctggtcatgtcccactccagcaaccgcctcgaccagtcgcccgcgcgcccggtgctcgtcatgtcccggtccagcaaccggctggaccagtcctcaccggcgtcgtcgccggcggccgtgaagggccccgcgctggtcatgtcaggctccagcaatcgtctcgacagctcgcacccgtcgccgtcgccgacggcagcggccgccgctgcgcccttgctggtgctctccaactccggcaagcggatggaccaggccgggcggaagaagtacgtcaagcaggtgacgggccgccacaacgacacggagctccacctcgccgcgcagcgcggggacctcgaggccgtacgccagatcatcgccgagattgacgcgcagatgaccggcaccggcgaggagttcgacagcgacgtcgccgagatccgcgccgcgatagtgaacgaagccaacgagatggaggcgaccgcgctgctcatcgccgcggagaaggggtttcttgacatcgtcgtcgagctgctcaagcactccgacaaggacagcctcaccaggaagaacaagtccggattcgatgctctgcacgtcgctgcaaaggagggccacagagatatcgtgaaggtacttctggaccatgatccatcccttgggaaaacgtttggccaatcgaatgtgactcctctcataactgcggcgatcagaggccacatcgaggtggtgaacctactgctggagcgagtttctgggttggtcgagttatcaaaagcgaacggaaagaatgccctgcacttcgctgcccggcaggggcatgtggaaatcgtggaggctttgctacatgccgatacccagcttgctcggaggactgacaagaaaggccagaccgctctacacatggcagtaaaaggaactagccctgaagtcgttcaagcgcttgtgaacgccgatccggccatagtcatgctgcctgacagaaacggcaacctagctttgcacgttgcaaccagaaagaaaagatcagagattgtaaatgtgcttctgctccttccggatatgaacgtgaatgcgttgaccagggatcggaagaccgcgttcgacatagccgagggccttcccctgtcagaggagtctcaagaaatcaaggagtgcctgtcccgtgccggtgcggtcagagcaaacgatctgaaccagcctcgggacgagctgaggaaaacagtgacagagataaagaaggacgtgcatacccagctggagcaggcgaggaaaaccaacaagaacgtgtacggcatcgccaaggagctgaggaagctccacagggaaggcatcaacaacgcgacgaactcggtgaccgtcgtggcggtgctgttcgcgacggtggcgttcgcggcgatcttcacggtgcccggcggcaacgccaacgacggcgtggcggtggccgtgcacgcgacggccttcaaggtgttcttcatcttcaacgccgtcgcgctgttcacgtcgctggcggtggtggtggtccagataacgctggtccggggcgagaccaaggcggagcggcgggtggtggagatcatcaacaagctcatgtggctggcgtcggtgtgcacgacggtcgcgttcatctcgtcgtcctacatcgtggtggggcgccacttcaggtgggcggcgctcctggtgaccctgatcggcggggtgatcatggccggcgtgctcggcaccatgacgtactacgtggtgaagtccaagcgcacgcgcaagatcaggaagaaggtgaagtcgacgaggaggagcggctccagctcgtggcagcacaactcggagttctcggactcggagatcgaccgtatctacgccatatgaagccggcgcagtgcagctggttcctccagacagacagacccttttggcagcggcacgaaaaggtagacatggatcacgacccttgagatgctagtgggggctggttgactttgtacattccaataagctgggtgtaaaaactgccattccccttgttcgtgaatcggcgggaggcgacggtgctgggctgtatactgctacagatagatttctcatcagattatatagtatggagtatactattattgtcgttgttatatatatgcagcatgtgctgtgctcct

SEQ ID NO: 1294 - DNA, 2647 bp, Zea mays
tcccccgtcacaaacacacacactgcggagaggaccgcaacgcgagcccaccccaggccgaacgccgagagcgatccctcccgtccgtgttgccctttgcgctccgccttcctcctcttccaccccgtcacttccgtgccatccgcggctcgcctccccaccccccattcccgccgccccatgcctccggctcgaccgtagccgcccgacgacgaccgccatggccgccgattccggcagcgggatggccggcctggagatcgggccggcgtcgccgggctcggagggggcgccatcgccggcgtcgagcgtgggcgcctccgtggagcggcccgagcagtcgtcgccgcgggtgaccaagcgcccaggcctcgtcatgtccttctccgggaagcggctggaccagtcgccggccgggtcgccgtcgccgtcgccgtcgctgtcgcgcccggtgctggtcatgtcccactccagcaaccgcctcgaccagtcgcccgcgcgcccggtgctcgtcatgtcccgctccagcaaccggctggaccagtcctccccggcgtcgtcgccggcgccagtgaaggcgcccgtgctggtcatgtcaggctccagcaatcggcttgacagctcgcatccgtcgccgtcgccgtcgccgtcgccgaccgccgcggccgccgctgcgccggttctggtgctctccaactccggcaagcggatggaccaggtggggcggaagaagtacgtcaagcaggtgacgggccgccacaacgatacggagctccacctcgccgcgcagcgcggggacctcgaggccgtgcgccagatcatcgccgagattgacgcccaaatgaccggcaccggcgaggagtttgacaacgaggtcgccgagatccgcgccgctatagtgaacgaggccaacgagatggaggcgaccgcgctgctcatcgccgccgagaaggggtttcttgacatcgtcgtcgagctgctcaagcactccgacaaggacagcctcaccaggaagaacaagtccggattcgatgctctgcacgtcgctgcaaaagagggccacagagatattgtcaaggtacttctggaccatgatccatcccttgggaaaacgtttggccaatcgaatgtgactcctctcataactgcggcgattagaggccacactgaggtggtgaacctactgctggagcgagtttctgggttggttgagttatcaaaagcgaatggaaagaatgccttgcactttgctgcccggcaggggcatgtggaaatcgtgaaggctttgctagatgctgatacccagcttgctcggaggactgataagaaaggccagactgctctacacatggcagtaaaaggtactaacccggaagttgttcaagcgcttgtgaatgccgatccggcaatagtcatgctacctgacagaaatggcaacttagctctgcatgttgcaaccagaaagaaaagatcagagattgtaaacgtgcttctgcttctcccggatatgaacgtgaatgcgttgactagggaccggaagaccgcattcgacatcgccgagggcctcccactatcagaggagtcccaagaaataaaggagtgcttgtcccgcgctggcgcggtcagagcaaatgagctgaatcagcctcgggatgagctcagaaaaacagttacagagatcaagaaggacgtgcatactcagcttgagcaggcgagaaaaaccaacaagaatgtctacggcatcgcgaaggagctaaggaaactccacagggagggcatcaacaacgcgacgaattcagtcacggtcgtggcggtgctcttcgccacagtggcgttcgccgcaatcttcacggtgcccggcggcaacaccgacgacggcgtagcggtggccgtgcacgcgacatccttcaaggtgttcttcatcttcaacgccgtcgccctcttcacgtcgctagcggtggtggtggtccagataacggtggtcaggggcgagaccaaggcggagaggcgggtggtgggggtcatcaacaagctgatgtggctggcctcggtgtgcacgacggtcgcgttcatatcctcctcgtacatcgtggtggggcggcacttcaagtgggcggcgctcctggtgaccctgatcggcggggtgatcatggccggcgtgctcggcacgatgacgtactacgtggtgaagtccaagcgcgtgcgcaagatcaggaagaaggtgaagtcgacgaggaggagcggctcgaactcgtggcaccacaactcggagctctcggattcggaggtcgaccgcatctacgccatatgagggggccggtgcagctggttccttccttcagaccgtctggccgtgatgcagcacggatgcatactgtaaacatcgaatcacggcccttgagatggagatgcgctagggggtggttaactctgtacattccaataagctggtgtaaactgccattccccttgttcatggatcgggcgggaggcgactgtcttggctgtatactactcacagatagatttgtcatcaggttatatatagtgtattatatatgtgcagcctgctgtgtgctccttgtgcgtgaccttcatcagattcatgtcaggccgctgctgagttcgaatggcagctgcatgacat

SEQ ID NO: 1295 - DNA, 3122 bp, Sorghum bicolor
cagccacataaacaacagcggaagccgggaaacccaacccaaccaaaccaaaagtaccaaacgccgttgcgctcccattccctcatcacgcctcacacacacacatacacatacactgcagagaagaccgcgacgcgagcccaccccacaccgagcgccgagcgcgatccctcccgtccgtgtcgccccctctgcgctccgccttcctcttccaccccgtcgcttccgtgccatccgcggctcgcctccccacctcctattcccgccgccccatgcctccggcccgcccgtaggccgcccgacgacgaccgccatggccgccgattccggcaaagggatggccgacctggagatcgggccggcgtcgccggtctcggagggggcgccgtcgccggcgtcgagcgcgggcgcctccggggagcggcccgaccagtcgccgtcgctgctggccaagcgcccaggcctcgtcatgtccttctccgggaagcggctggaccagtcgccgggcgggtcgccgtcgcagtcgcgcccggtgctcgtcatgtcccactccagcaaccgcctcgaccagtcgcccgcgcgcccggtgctcgtcatgtcccgctccagcaataggctggaccagtcctccccggcgtcatcgccggcacgcgtgagggggcccgtgctcgtcatgtccggctccagcaatcgtctggagagctcgtcgccgtcgccgtcgccgacggccgcggccgccgccgcgccggtgctggtgctctccaactccggcaagcggatggaccaggcgggccggaagaagtacgtcaagcaggtgacgggccgccacaacgacacggagctccacctcgccgcgcagcgcggggacctcgaggccgtgcgccagatcatcgccgagatcgacgcgcagatgaccggcaccggcgaggagttcgacagcgaggtcgccgagatccgcgccgcgatagtaaacgagtccaacgagatggaggcgaccgcgctgctcatcgccgccgagaaggggtttcttgacatcgtcgtcgagctgctcaaacactccgacaaggacagcctcaccaggaagaacaagtccggattcgatcctctgcacgtcgctgcaagagagggccacagagatattgtcaaggtacttctggatcatgatccatcccttgggaaaacgtttggccaatccaaagtgactcctctcataactgcggcgattagaggccacactgcggtggtgaacctgctgctggagcgagtttgtggtttggttgagttatcgaaagcaaatggaaagaatgccttgcactttgctgctcggcaggggcatgtggaagtcgtgaaggctttgctagatgctgatacccagcttgctcggaggactgataagaaaggccagactgctctacacatggcagtaaaaggaactaaccctttagttgttcaagcacttgtgaatgccgatccggcaattgtgatgctacctgacagaaatggcaacttagctttgcatgttgcaaccagaaagaaaagatcagagattgtaaatgtgcttctgcttcttccagatatgaacgtgaatgcattgactagggatcggaagactgcatttgacatagccgagggccttccactgtcagaggagtctcaagaaataaaggagtgtttagcccgtgctggtgcagtcagagcaaatgatctgaatcagcctcgggatgaactcagaaaaacagtgacagagataaaaaaggatgtacatactcagcttgagcaggccagaaaaaccaacaaaaatgtctatggtatcgcaaaggagttaaggaaactccacagggaaggcatcaacaatgcaacaaattcagtcactgttgtggcggtgctctttgccacagtggcatttgctgcaatctttacagtgcctggcggtaacaccaacgatggtgtagcagtagctgtgcacgcaacagccttcaaggtcttcttcatcttcaacgccattgcccttttcacatcgttagcagtagtggtggtccagataacactggttaggggtgagaccaaagcagagaggcgggtgatcgagatcatcaacaagctgatgtggctggcttcagtatgcacgacagttgcgttcatatcatcctcttacattgtagtggggcggcgcttgaagtgggcggctcttctagtaaccctgataggtggggtgatcatggctggtgtgcttggtacaatgacatactacgtggtgaagtctaagcgcacacgtaaaatcaggaggaaggtgaagtcaacaaggaggagcggctcaaactcatggcagcacaattcggagttctcggattcagagatcgaccgtatttatgccatttgaagccggtacagctggttccttcaaaccttttggcagtgatacaacacgaatgtatattataagcatcaatcacaacccttgagatgctagggggttaactttgtacattcaaataagctggtgtaaactgccattccccttgttcatgaatcagcgggaggcgacggtcttggttgtatactacttacagatagatttgtcatcagattatatagtatattatatattcagcatattgtgtcctccttgtgcatggctttgatcagaatcatgtcagccgctactcagttcaaatgacagttgcatgatatatttggatacccttgttttgatattctgatctcgttgacgcgtccatggagaagagacagcagcgaggggatacccttttccagtcgttttccacagcacgtgagagcgagaggtgagaaatttgccgttctgatattcggttgctaggtgttctttctctctgtatataggacaggacaccctggggctggagtgcacttggaatttggaagccatgtggtgatggagacgggcaatcaggaggcggcatcgtctagccatgtagggtaggggagaggagagcttggcggcatcttgatcgccgttcgtctcgctccagcaacgtctggattctggaaacctcatgcgtggagcaactccaacctccaaatccctaaattaagcctttaaatttttatttacatgctatgataaaaaaagtaggagttca

SEQ ID NO: 1296 - DNA, 2825 bp, Secale cereale
gactctgaaagcaaacggaggggaggtcgcttctccgattgatttcgttccatcatcatctcatctcatctcacacagccaaaagaccgcgacgcccggctcccgtccccgtcgcgatttgattcgtctccccacctcccgttccgctgccccatgccgcctcccgcccgcccgcccctgcgcgccgactcctcttgaccccgtccccggcgacgacgccatggccgtcgattccgacagaggggagggggatttggagattgggctggcgtcgccggggtcggagggaggaggggtttcgcccgtcgccccaggccgccgggcgctcgagtcctgcctctccgggaagcgcctcgaccagtcgccgtcgccgtcgcgggcggtcaggcgccccgcgctagtcatgtccagctccgggaagcgcctcgaccagtcgccgtcgccctcgcgcccggtgctggccatgtcccactccagcaaccgcctggaccagccgcccggccgcccggtgctggccatgtcccgctccagcaaccggctcgaccactcgccgtcgtcgtcgtccccgacgccggccaagggcccggcgctcgtcatgtccggctccagcaagcggctggagcagtcgctcgcgtccccgtcccgtcgcccaaggccggggccgcggcgccgcccgtgctggtgctctccaactccggcaagcggatggaccaggcgggccggaagaagtacgtcaagcaggtcacgggccggcacaacgacacggagctccacctcgccgcgcagcgcggggacctcgacgccgtgcgccagatcatcgccgaaatcgacgcgcagatgaccggcaccggggaggagttcgacagcgaggtggcggagatccgcgccgccgtgctcaacgagcccaacgaggtcggggagaccgcgctgctcatcgcagctgagaaagggttcatcgacgtcgtcgtcgagctgctcaagcactctgacaaggagagccttgcgggaaagaacaaatcaggattcgatgctctgcacgtcgctgcaaaggaaggccaccaagatattgtgaaggtactcctggaccatgatccatcccttgggaaaacgtttggccaatcaaatgtgactcctctgataactgcggcgatcagaggacacctcgaggtagtgaaccttttgctggagcgagtttctgggttggttgaactatcaaaggcaaatggaaagaatgcattgcatttcgctgcccgtcaggggcatgttgaaatagttaagtctttgctagtcagtgaagctcagcttgctcggaagactgataagaaaggacagaccgctttgcatatggcggttaaaggaacaagcgctgcggttgttagagcactcgtgaatgctgatccggccatagttatgctacctgacaaaaatggcaacttagctttgcatgttgccaccaggaagaaaagatcagagattgtcaatgagcttctgcttcttccggacatgaacgtgaatgcgctgaccagggatcgcaagactgcattcgacattgcagagggtcttccgctatcagaggagtctgcggatataaaggattgtttatcccgtgctggtgcagtgagagcaaatgatctgaatcagcctcgggatgagctgagaaaaacagtgactgagatcaagaaggacgtacacactcaacttgagcaagccagaaaaaccaacaaaaatgtgcatggcatagcaaaggagctgaggaagctccacagggaaggcatcaacaatgcaacaaactctgtcacagttgtggctgtgctcttcgccacagttgcatttgctgcgatattcacggtgccaggcggtaatgacgaccatggtgtagcaatagttgtgcatgcagtatccttcaaggtcttcttcatcttcaatgccatcgccttgttcacatcattagcagtagtggtggtccagataacacttgttaggggcgagacgaaagcagagaggcgagttgtggaggtgatcaacaagttgatgtggctagcttctgtatgcaccacggtggcattcatatcctcctcttacatagtggtgggtcggcacttcaagtgggcggcgctgctggtgactctcattgggggggtgatcatggccagtgtgctcggcacgatgacatactatgtggtgaagtccaagcgcacgcggtccattaggaagaaggtgaagtcaacaaggcggagcggctcaaactcatggaaccacaactcggagtcagattccgagatagaccggatatacgccatatgagggtgatctccggtcttctacggatcctcagtctttttggcggcaccacacgacacgggtgtaaaaagaaaggtgggatggcactcagtatgaacagctttgatcctccaggtgccatgggttttaccgtatacattccaataagctggtgttcctggatcggcaggaggagccaggaggcgacggtcgtgttgtatacatcttctatagatagattgtcttcgtcagaatatgcatgcagcctgtgctgtgctccctatgcatggctggctggctggcctttataaaatttctcagcctttttctctaccttttgttaatatgctgtggtagctgaatggtatgtgtacttagcactctgtaccttgtactatttcatctgatagctgagaaagttctagaagcttctagcgaagcctggaacaaaaaaaaaaaacaaaaaacaaaaaaataaaaaaaacaaaaaaacaaaaaaaaaagaaaaacgagacaacgacgaacaacgaacgaagtaaggagag

SEQ ID NO: 1297 - DNA, 2181 bp, Triticum aestivum
gccggagatagcggccgagcactccacctcgagccagtgagtggcggcgggagggggaggcgagaagagttggtggaggaggaggaggaggagctgtgggctgtggctggaggaggcggctagcagctagccaatgccgcaggggtagggaggggatacatggggggagggaacggcatcgtcgacggcttccgccgcttgttccaccgccgcacgccctccggctccgtgctcggcagctccaaccagtcctccgccggcgaggactcctccgacgccgaggccgccgaggacctggatctcgtgggcctccgccccatccgcgtccccaagcgcaagatgccgctccccgtcgagagccacaagaagaacataatggagaaagaattcttcacagagtatggagaggcaagccagtaccaaatccaggaagttgttggcaaggggagttatggagtagttgctgctgcaatagatacccgcaccggcgagcgggttgcgattaagaagatcaacgatgtgtttgagcacgtctcggatgccacacgcatcctccgcgaggtcaagctccttcggctgctacgtcatccagacgtggtggagatcaagcacataatgctccccccttctcggagggagttccaagatatatatgttgttttcgagctgatggagtcagatctccatcaggtcatcagagcgaatgatgacctcacagctgagcattaccagtttttcctttaccagcttctccgcgctctcaagtacatccatggggctaatgtatttcatcgcgatctgaagcccaagaatatactggccaacgcagactgcaaactgaaaatttgtgactttggacttgcgcgtgtatcatttaatgatgctccttcagctatattttggacggattatgtagcaacaaggtggtacagagcccctgaattatgtggctcctttttctcgaaatacactcctgctattgatatttggagtattggatgcatatttgccgagcttctcactggacggccactctttcctgggaagaatgttgtacaccagttagatataataacagatcttcttggaactccatcatcagaaaccttatctcggattcgaaatgagaaggccaggaggtacttaagttgcatgcggaaaaaacaccctgtacccttgactcagaaatttcctaatgccgatccattggcggttcgcctactgggtcgtttacttgcatttgatcctaaagaccggccttcagctgaagaggctttagcagacccatattttgcatctcttgccaatgtggagcgtgagccatcaaggcatccaatttcgaaactcgagtttgagtttgagagacgaaaggttacaaaagatgatgttagggaattgatctatcgagagattttggagtaccatccacagatgctggaggaatacatgaaaggtggagaccagattagcttcctctatccaagtggtgttgaccgctttaaacggcagtttgcacacctggaggagcattacagcaaaggagaacgaggttctccgctgcaaagaaagcatgcctctttaccaaggcagagggtaggtgcatcgaacgacggtaataatgagcagcatattagtgatcaggagatgagtgcagagcctgatgcccatggtgcagtgagccctcaaaagtcacaggatgcacccggtgttggccagaatggtctgagccccaccagcttgagctcgcggacctacctcaagagcgcgagcattagcgcttccaagtgcgtcgttgtcaacccgaataaacagccagagtatgacgacgcgatctctgaggaaacagaaggagccgtcgatggactatccgagaaggtctcaaagatgcatgcctagtgcagcaacgacgacggaagtcggcaccgcatttctcatttctgtcaggtacaccggatgctgatagctgatagcaaagcactgcaagttggagatggtttagcggagtgcatgttcctgtcaagcgtcgttgctgcacacaggagctggccctgcatggattgatgtatttttacactcaatgtaacactgggattagttcctacacctatcatctatgcatgattgtaacaacgaacagagcaagacatcttgacgctgtcatgtttcgctgtcgaaaattct

SEQ ID NO: 1298 - DNA, 2467 bp, Secale cereale
ttcgtcaacacacaccgtgtgtgagcgagcgtgtgctgtgacagcttgtatctgtcacccgcacggcagaaaaacgcagagccgagggccgaaaaaggagagaaaattccttccgcccccgctccgcccccaaatcgcgccgggcagtataagagcagaccccgccgtttcctcccgcatccaatccgtccgtcctctgcgccgacgacaccgccggggacagcgcggccggagggagtgagtgagctgccggggtctccttgagtggcggcgggaggaggaagagtagggggagctgtgggctgtggctggaggaggaggcggctagcagctagccaatgccgcaggggtagggaggggatacatgggaggagggaacggcatcgtcgacggcttccgccgcttgttccaccgccgcacgccctccggctccgtgctcgccagctccaaccagtcctccgccggcgaggacccctccgacgtcgaggccgtcgaggacctggatctcgtgggcctccgccccatccgcgtccccaagcgcaagatgccgctccccgtcgagagccacaagaagaacataatggagaaagaattcttcacagagtatggagaggcaagccagtaccaaatccaagaagttgttggcaaggggagttatggagtagttgctgctgcaatagatacccgcaccggcgagcgggtcgcgattaagaagatcaacgatgtgtttgagcacgtctcggatgccacgcgcatcctccgtgaggtcaagctcctccgtctgctccgtcatccagacgtagtagagatcaagcacataatgctccccccttctcggagggagttccaagatatatatgttgttttcgagctcatggagtcggatctccatcaggtcatcagagcgaatgatgacctcacggcggagcattaccagtttttcctttaccagcttctccgcgctctcaagtacatccatggggctaatgtatttcatcgcgatcttaagcccaagaatatactggccaacgcagactgcaaactgaaaatttgtgactttggacttgcgcgtgtatcatttaatgatgctccttcagctatattttggacggattatgtagcaacaaggtggtacagagcccctgaattatgtggctcttttttctcgaaatacactcctgctattgatatttggagtattggatgcatatttgccgagcttctcactggacgaccactttttcctgggaagaatgttgtacaccagttagatataataacagatcttcttggaactccatcatccgaaaccttatctcggattagaaatgaaaaggccaggagatacttaagctgcatgcggaaaaaacatcctgtccccttgactcagaaatttcctaatgctgatccgttggcggttcgcctactggggcgtttacttgcatttgatcctaaagaccggccttcagctgaggaggctttggcagacccatatttcgcatctcttgctaatgtggagcgtgagccttcaaggcatccaatttcgaaacttgagtttgagtttgagagacgaaaggtgacaaaagatgatgttagagaattgatctatcgagagattttggagtaccatccacaaatgctggaggaatacatgaaagggggagatcagattagcttcctctatccaagtggggttgaccgctttaagcggcagtttgcacatctggaggagcattacagcaaaggagaacgaggttctccgctgcaaagaaagcatgcctctttaccgaggcagagagtaggtgcgtcgaacgacggtaataatgaacagcatattagtgatcaggagatgagtgcagagcctgatgcccatggtacagagagccctcaaaaggcacaggatgcaccgggcgttggccagaatggtctgagccccaccagcttaagctcgcggacctacctcaagagcgcgagcattagcgcttccaagtgtgtcgttgtcaacccgaataaacagccagagtatgacgatgcaatctccgaggaagcggaaggggccgtcgacggactatccgagaaggtctccaagatgcacgcctagtgcaggggacgacgaacgaaagccgagctctgcaccgcatttctgtcatgtacaccggatgatgatagcagagcagcgctgtcctagggaagcagagcactgcgccgctctgcaagctggggatggtttagcgagtgcgtgttcctgccaagtgccaagcatcgttggtgtacctgcatggattgatgtatttttacactcaagctcgcaatgtaacaccgagatttgctctctagcatctaagtatacatgattgtaacgaacggaccaagacatctgatgaacacttgtcatgtttcctgtcggctgatgaacacttgttgagtttcatttcctttctttggtgataaatgtggcaattaagct

SEQ ID NO: 1299 - DNA, 2167 bp, Secale cereale
tgtggctggaggaggaggcggctagcagctagccaatgccgcaggggtagggaggggatacatgggaggagggaacggcatcgtcgacggcttccgccgcttgttccaccgccgcacgccctccggctccgtgctcgccagctccaaccagtcctccgccggcgaggacccctccgacgtcgaggccgtcgaggacctggatctcgtgggcctccgccccatccgcgtccccaagcgcaagatgccgctccccgtcgagagccacaagaagaacataacggagaaagaattcttcacagagtatggagaggcaagccagtaccaaatccaagaagttgttggcaaggggagttatggagtagttgctgctgcaatagatacccgcaccggcgagcgggttgcgattaagaagatcaacgatgtgtttgagcacgtctcggatgccacgcgcatcctccgtgaggtcaagctccttcggctgctacgtcatccagacgtggtagagatcaagcacataatgctccctccttctcggagggagttccaagatatatacgttgtttttgagctgatggagtcggatctccatcaggtcatcagagctaatgatgacctcacggcggagcattaccagtttttcctgtaccagcttctccgcgctctcaagtacatccatggggctaatgtatttcatcgcgatctgaagcccaagaatatactggccaacgcagactgcaaactgaaaatttgtgactttggacttgcgcgtgtatcatttaatgatgctccttcagctatattttggacggattatgtagcaacaaggtggtacagagcccctgaattatgtggctcctttttctcgaaatacactcctgctattgatatttggagtattggatgcatatttgccgagcttctcactggacgaccactttttcctgggaagaatgttgtacaccagttagatataataacagatcttcttggaactccatcatcagaaaccttatctcggattagaaatgaaaaggccaggagatacttaagttgcatgcgaaaaaagcatcctgtccccttgactcagaaatttcctaatgctgatccattggcggttcgcttactagggcgtttacttgcatttgatcctaaagaccggccttcagctgaagaggctttggcagacccatattttgcaagtcttgccaatgtggagcgtgagccttcaaggcatccaatttcgaaacttgagtttgagtttgagagacggaaggttacaaaagatgatgttagggagttgatctatcgagagattctggagtaccatccacagatgctggaggaatacatgaaaggtggtgaccagattagcttcctctatccaagtggtgttgaccgctttaaacggcagtttgcacacctggaggagcattacagcaaaggagaacgaggttccccgctgcaaagaaagcatgcctctttaccaaggcagagagtaggtgcgtcgaacgacggtaataatgaacagcatattagtgatcaggagatgagtgcagagcctgatgcccatggtacagagagccctcaaaaggcacaggatgcacccggcgttggccagaatggtctgagccccaccagcttaagctcgcggacctacctcaagagcgcgagcattagcgcttccaagtgtgtcgttgtcaacccgaataaacagccagagtatgacgatgcaatctccgaggaagcggaaggggccgtcgacggactatccgagaaggtctccaagatgcacgcctagtgcaggggacgacgaacgaaagtcgagctctgcaccgcatttctgtcatgtacaccggatgatgatagcagagcagcgctgtcctagggaagcagagcactgcgccgctctgcaagctggggatggtttagcgagtgcgtgttcctgccaagtgcccagcatcgttggtgtaccctgcatggattgatgtatttttacactcaagctcgcaatgtaacaccgacatttgctctctagcatctaagtatacatgattgtaacgaacggaccaagacatctgatgaacacttgtcatgtttccttgtacgaactattaccttaatagtatatacaaagagtcgttgctgctctgcatactaaaactgaacg

SEQ ID NO: 1300 - DNA, 2609 bp, Triticum aestivum
gaggaggaggaggaggagctgtgggctgtggctggaggaggcggctagcagctagccaatgccgcaggggtagggaggggatacatggggggagggaacggcatcgtcgacggcttccgccgcttgttccaccgccgcacgccctccggctccgtgctcggcagttccaaccagtcctccgccggcgaggactcctccgacgtcgaggccgccgagggcctggatctcgtgggcctccgctccatccgcgtccccaagcgcaagatgccgctccccgtcgagagccacaagaagaacataatggagaaagaattcttcacagagtatggagaggcaagccagtaccaaatccaagaagttgttggcaaggggagttatggagtagttgctgctgcaatagatacccgcaccggcgagcgggttgcgattaagaagatcaacgatgtgtttgagcacgtctcggatgccacgcgcatcctccgcgaggtcaagctccttcggctgctacgtcatccagacgtggtggagatcaagcacataatgctccctccttctcggagggagttccaagatatatatgttgttttcgagctcatggagtcggatctccatcaggtcatcagagctaatgatgacctcacggcggagcattaccagtttttcctttaccagcttctccgcgctctcaagtacatccatggagctaatgtatttcatcgcgatctgaagcccaagaatatactggccaacgcagactgcaaactgaaaatttgtgactttggacttgcgcgtgtatcatttaatgatgctccttcagctatattttggacggactatgtagcaacaaggtggtatagagcccctgaattatgtggctcctttttctcgaaatacactcctgctattgatatttggagtattggatgcatatttgctgagcttctcactggacggccactctttcctgggaagaatgtcgtacaccagttagatataataacagatcttcttggaactccatcatcagaaaccttatctcggattcgaaatgagaaggccaggaggtacttaagttgcatgcgaaaaaacaccctgtacccttgactcagaaatttcctaatgctgatccattggcggttcgcctactgggtcgtttacttgcatttgaccctaaagaccggccttcagctgaagaggctttagcagacccatattttgcatctcttgccaatgtggagcgtgagccttcaaggcatccaatttcgaaacttgagtttgagtttgagagacgaaaggtgacaaaagatgatgttagggaattgatctatcgagagattttggagtaccatccacagatgctggaggaatacatgaaaggtggagaccagattagcttcctctatccaagtggtgttgaccgctttaaacggcagtttgcacacctggaggagcattacagcaaaggagaacgaggttccccgctgcaaagaaagcatgcttctctaccaaggcagagagtaggtgcatcaaacgacggtaataatgaacagcatattagtgatcaggagatgagtgcagagcctgatgcccatggcacagtgagccctcaaaagtcacaggatgcagccggtgttggccagaatggtctgagccctaccagcttgagctcgcggacctacctcaagagcgcgagcattagtgcttccaagtgcgtcgttgtcaacccgaataaacagccagagtatgacgacgcgatctctgaggaaacggaaggggccgtcgacggactatccgagaaggtctccaagatgcatgcctagtgcagcaacaacgacggaagtcggcaccacatttctcatttctgtcaggtacaccggatgctgatagcaaagcagtgcactgcaagttggagatggtttagcgagtgcatgttcctgtcaagcgtcgttgctgcacgcaggggctggccctgcatggattgatgtatttttacactcaagctcgcaatgtaacaccgagatttgttgttctctagcatctactactatacgtgattgcaacgaacggaccaagacatctgatgaacacttgtcatgtttccctgtcgaacatccttaatatatcaagaagcgttgctgctctgcatctatatcaacaagaagtgctgagtttcatttcctttctttcgtgtttggataaatgtggcaatcaagctgaaccctgagtacagatttagaaacatctagtagtgtatttctcaaattgaatgatgtttccccgtcatttgtagcctagtttcagcatcgaggacgacggcatttgccaaggaagttgccgcctcttggtgcgtgattcttccgagactgatgatgacgggggacgaccagaccagtctcagttcctcccggacgtgtgcgatatggcaatgcaattgttctacggtctacaacatacacaagacaagtccaatggattctccagctgtgatcattcatctatttattgcaggtctcgttgtactgtactccccaatttgtctcgactcttggatcagttacttggtagtagtacatcggtgagttctctgaagcacctccacccgccgccgg

SEQ ID NO: 1301 - DNA, 2014 bp, Secale cereale
acggcttccgccgcttgttccaccgccgcacgccctccggctccgtgctcgccagctccaaccagtcctccgccggcgaggacccctccgacgtcgaggccgtcgaggacctggatctcgtgggcctccgccccatccgcgtccccaagcgcaagatgccgctccccgtcgagagccacaagaagaacataatggagaaagaattcttcacagagtatggagaggcaagccagtaccagatccaagaagttgttggcaaggggagttatggagtagttgctgctgcaatagatacccgcaccggcgagcgggttgcgattaagaagatcaacgatgtgtttgagcatgtctcggatgccacgcgcatcctccgtgaggtcaagctccttcggctgctacgtcatccagatgtggtagagatcaagcacataatgctccctccttctcggagggagttccaagatatatacgttgtttttgagctcatggagtcggatctccatcaggtcatcagagctaatgatgatctcacggcggagcattaccagtttttcctttaccagcttctccgcgctctcaagtacatccatggggctaatgtatttcatcgcgatcttaagcccaagaatatactggccaacgcagactgcaaactgaaaatttgtgactttggacttgcgcgtgtatcatttaatgatgctccttcagctatattttggacggattatgtagcaacaaggtggtacagagcccctgaattatgtggctcctttttctcgaagtacactcctgctattgatatttggagtattggatgcatatttgccgagcttctcactggacggccactttttcctgggaagaatgttgtacaccagttagatataataacagatcttcttggaactccatcatcagaaaccttatctcggattagaaatgaaaaggccaggagatacttaagctgcatgcgaaaaaaacatcctgtccccttgactcagaaattccctaatgctgatccattggcggttcgcctactggggcgtttactagcatttgatcctaaagaccggccttcagctgaagaggctttggcagacccatatttcgcatctcttgctaatgtggagcgtgagccttcaaggcatccaatttcaaaacttgagtttgagtttgagagacgaaaggtgacaaaagatgatgttagagaattgatctatcgagagattttggagtaccatccacaaatgctggaggaatacatgaaagggggagatcagattagcttcctctatccaagtggggttgaccgctttaagcggcagtttgcacacctggaggagcattacagcaaaggagaacgaggttctccgctgcaaagaaagcatgcctctttaccgaggcagagagtaggtgcatcgaacgacggtaataatgaacagcatattagtgatcaggagatgagtgcagagcctgatgcccatggttcagtgagccctcagaagtcacaggatgcacccggcgttggccagaatggtctgagccccaccagcttaagctcgcggacctacctcaagagcgcgagcattagcgcttccaagtgtgtcgttgtcaacccgaataaacagccagagtatgacgatgcaatctccgaggaagcggaaggggccgtcgacggattatccgagaaggtctccaagatgcacgcctagtgcaggggacgacgaacgaaagtcgagctctgcaccgcatttctgtcatgtacaccggatgatgatagcagagcagcgctgtcctagggaagcagagcactgcgccgctctgcaagctggggatggtttagcgagtgcgtgttcctgccaagtgcccagcatcgttggtgtaccctgcatggattgatgtatttttacactcaagctcgcaatgtaacaccgacatttgctctctagcatctaagtatacatgattgtaacgaacggaccaagacatctgatgaacacttgtcatgtttcct

SEQ ID NO: 1302 - DNA, 2017 bp, Triticum aestivum
cacgccctccggctccgtgctcggcagctccaaccagtcttccgccggcgaggactcctccgacgtcgaggccgtcgaggacctggatctcgtgggcctccgccccatccgcgtccccaagcgcaagatgccgctccccgtcgagagccacaagaagaacataatggagaaagaattcttcacagagtatggagaggcaagccagtaccaaatccaagaagttgttggcaaggggagttatggagtagttgctgctgcaatagatacccgcaccggcgagcgggttgcgattaagaagatcaacgatgtgtttgagcacgtctcggatgccacacgcatcctccgcgaggtcaagctccttcggctgctacgtcatccagacgtggtggagatcaagcacataatgctccccccttctcggagggagttccaagatatatatgttgttttcgagctcatggagtcggatctccatcaggtcatcagagctaatgatgacctcacggcggagcattaccagtttttcctttaccagcttctccgtgctctcaagtacatccatggcgctaatgtatttcatcgcgatctgaagcccaagaatatactggccaacgcagactgcaaactgaaaatttgtgactttggacttgcgcgtgtatcatttaatgatgctccttcagctatattttggacggattatgtagcaacaaggtggtacagggcccctgaattatgtggctcctttttctcgaaatacactcctgctattgatatttggagtattggatgcatatttgccgagcttctcactggacggccactctttcctgggaagaatgtcgtacaccagttagatataataacagatcttcttggaactccatcatcagaaaccttatctcggattcgaaatgagaaggccaggaggtacttaagttgcatgcgaaaaaaacaccctgtacccttgactcagaaatttcctaatgctgatccattggcggttcgcctactgggtcgtttacttgcatttgatcctaaagaccgtccttcagctgaagaggctttagcagacccatattttgcatctcttgccaatgtggagcgcgagccttcaaggcatccaatttcgaaacttgagtttgagtttgagagacgaaaggtgacaaaagatgatgttagggaattgatttatcgagagattttggagtaccatccacagatgctggaggaatacatgaaaggtggagaccagattagcttcctctatccaagtggtgttgaccgctttaaacggcagtttgcacacctggaggagcattacagcaaaggagaacgaggttccccgctgcaaagaaagcatgcctctttaccaaggcagagagtaggtgcgtcgaacgacggtaataatgaacagcatattagtgatcaggagatgagtgcagagcctgatgcccatggcgcagtgagccctcaaaagtcacaggatgcacccagtgttggcccgaatggtctgagcccaactagcttaagctcgcggacctacctcaagagcgcgagcattagtgcttccaagtgtgtcgttgtcaacccgaataaacagccagagtatgacgatgcaatctctgaggaaacggaaggggccgtcgatggactatccgagaaggtctccaagatgcacgcctagtgcagggacgccgatgaaagtcgagctcggcgccgcatttctgtcaggtacgccggatgctgatagcatagcagtgcactcctaaggaagcagagcgctgcaagttggagattggtttagccgagtgcatgttcctgccaagcatcgttgctgtacccaggagctggccctgtctgtctttgatgtatttttacattcaagctcacaacgtaacactgcgatttgctctctgtcatctatgccggattgtaacgaacagagcaatgcatctaaacactgtcctgtttgtgtcgaacattcttaatcttaatatatcaagaagcgttactgctc

SEQ ID NO: 1303 - DNA, 1916 bp, Secale cereale
gggcctccgcccccatccgcgtccccaagcgcaagatgccgctccccgtcgagagccacaagaagaacataatggagaaagaattcttcacagagtatggagaggcaagccagtaccaaatccaagaagttgttggcaaggggagttatggagtagttgctgctgcaatagatacccgcaccggcgagcgggttgcgattaagaagatcaacgatgtgtttgagcacgtctcggatgccacgcgcatcctccgtgaggtcaagctccttcggctgctacgtcatccagacgtggtagagatcaagcacataatgctccctccttctcggagggagttccaagatatatacgttgtttttgagctgatggagtcggatctccatcaggtcatcagagctaatgatgacctcacggcggagcattaccagtttttcctgtaccagcttctccgcgctctcaagtacatccatggggctaatgtatttcatcgcgatctgaagcccaagaatatactggccaacgcagactgcaaactgaaaatttgtgactttggacttgcgcgtgtatcatttaatgatgctccttcagctatattttggacggattatgtagcaacaaggtggtacagagcccctgaattatgtggctcctttttctcgaaatacactcctgctattgatatttggagtattggatgcatatttgccgagcttctcactggacgaccactttttcctgggaagaatgttgtacaccagttagatataataacagatcttcttggaactccatcatcagaaaccttatctcggattagaaatgaaaaggccaggagatacttaagttgcatgcgaaaaaagcatcctgtccccttgactcagaaatttcctaatgctgatccattggcggttcgcttactagggcgtttacttgcatttgatcctaaagaccggccttcagctgaagaggctttggcagacccatattttgcaagtcttgccaatgtggagcgtgagccttcaaggcatccaatttcgaaacttgagtttgagtttgagagacggaaggttacaaaagatgatgttagggagttgatctatcgagagattctggagtaccatccacagatgctggaggaatacatgaaaggtggtgaccagattagcttcctctatccaagtggtgttgaccgctttaaacggcagtttgcacacctggaggagcattacagcaaaggagaacgaggttccccgctgcaaagaaagcatgcctctttaccaaggcagagagtaggtgcgtcgaacgacggtaataatgaacagcatattagtgatcaggagatgagtgcagagcctgatgcccatggtacagagagccctcaaaaggcacaggatgcacccggcgttggccagaatggtctgagccccaccagcttaagctcgcggacctacctcaagagcgcgagcattagcgcttccaagtgtgtcgttgtcaacccgaataaacagccagagtatgacgatgcaatctccgaggaagcggaaggggccgtcgacggactatccgagaaggtctccaagatgcacgcctagtgcaggggacgacgaacgaaagccgagctctgcaccgcatttctgtcatgtacaccggatgatgatagcagagcagcgctgtcctagggaagcagagcactgcgccgctctgcaagctggggatggtttagcgagtgcgtgttcctgccaagtgccaagcatcgttggtgtaccctgcatggattgatgtatttttacactcaagctcgcaatgtaacaccgacatttgctctctagcatctaagtatacatgattgtaacgaacggaccaagacatctgatgaacacttgtcatgtttccttgtcgaacatccttaatagtat

SEQ ID NO: 1304 - DNA, 2554 bp, Brachypodium distachyon
ggcagtaaaagaataactgaaaaggaagcttgggagaaagggaaggagaaaaaacatctctcgcccaaaaatcccaaatcgtcccgggtataagaccccgtcgtttccgcccttccgtgctgcatccgtccatttttgattcccacaagagtagttgtagaccggcggggacggacagcgcggcggcgtggcggagaggactgctcgagtaggctattggtggtagtgagggacgagaggagtagcaggaggaagctgtagctggagagagggaggcgaggtaagctgagctgagcaagccagccagccaatgccgccgagggcgcaggggtagggagggggatatggtgggagggggcggcatcgtcgacggcttccgccgcttgttccaccgccgcacgccgtcaggctccgggcccagctccaaccagtcgtccgccggcgaggagtcctcggacatcgacgccgtcgtcgaggacctggatctcgttggcctccgtgccatccgcgtccccaagcgcaagatgccgctccccgtcgagagccacaagaagaacatattggagaaggagttcttcacagagtatggagaggcaagccagtaccagatccaagaagtcattggcaaagggagttatggagtagttgctgctgcagtagatacccgcaccggtgagcgggttgcgattaagaagatcaatgatgtgtttgagcatgtctcagatgccacacgcatcctgcgtgaggtcaagctccttcggctgctccgtcatccagacgtagttgagatcaagcatataatgctccccccttctcgcagggagttccaagatatttatgttgttttcgagctcatggagtcggatctccatcaggtcatcagagcgaatgatgacctcacaccggagcattaccagtttttcctgtaccaacttctccgtgctctcaagtacatccatgcggctaatgtatttcatcgggatctaaaaccgaaaaatatactggccaactcagactgcaaattaaaaatttgtgactttggacttgcacgtgtatcattcaatgatgctcctacagctatattttggacggattatgtagcaacaaggtggtaccgagcacctgaattatgtggctcctttttctccaaatacactcctgctattgatatttggagtattgggtgcatattcgccgagcttctcactggaaggccactatttcctgggaaaaatgttgtacaccaattagatattataacagatcttcttggaactccatcatcagaaaccttatctcggattcgaaatgaaaaggccaggagatacctgagttgcatgcgaaaaaagcatcctgtccccttgactcagaaatttcctaacgttgatcctttggctcttcgcctactagggcgtttacttgcatttgatcctaaagaccggccttcagccgaagaggctttggccgatccatattttgccgttcttgctaatgtggaacgtgagccttcaagaaatccaatttcgaaactcgagtttgagtttgagagacggaaggtgacaaaagatgatgttagagaattgatttaccgagagattctggagtatcacccacagatgctgcaggagtacatgcaaggtggagaacagcttagcttcctctatccaagtggggttgatcgcttcaaacgacagtttgcacacctggaagaaaattacagcaaaggagaaagaggttctccgctgcaaagaaagcatgcatctttaccaaggcagagggtaggtgcttcgaatgataataatgaccaacatgctagtgatcaagagaggggtgcagattctattgcccctgctacgggaaaccctccaggttcacaagatgcagggcagcagcatgtatctggtggccagaatggtgtgggttccaccaacataagtccacggagctaccagaagagcgcaagcattagtgcttctaagtgtgtcgttgtcaacgcgaataaaaacccagagtatgacgatgatatctctgaggagatggaaggggccgttgatggactctctgaaaaggtctccaggatgcacccctagtgcagcagcgcaaacaatgtggacgatggtggccgatctcaatcttaggtgctacatttctgccaggtaaaaccagatgctggtatcaaagatgacggcctaggaatggtgtagaacgctcaacgctgcactgagctttgcactgcaacaagcagctggagatgattagccctttattattcggagtgcatgaatgactgggtttgcttttctactcaaggtcagatgtaggtcatgtaacattgagattagtcagtggaggaatgaaatcttcgtttccaatgggatgtaaaatctatgcttgagttctgtaagttttaaggacagggctgccatctgaacacttaaagcatcctgtttatgtatcgagaaaacagaaaaagaagtattactgctgctattctgttttgttctgcaaaaacaaaatattcagttttggttggtagcaatgagttgggaacatg

SEQ ID NO: 1305 - DNA, 2564 bp, Panicum virgatum
ataataattattaaataaaaataaaaatactacagtattttatagattcatttttatgcatctgaacaagcccaagatcctgctccttgccatcaagcccatcgctgtctcctttccattccgttctgcatccgtcaatccaatcccccagccgacgacttcgtcatcccttcagcgggagcagcacgccggggggcaagcgtccggagcagcgagtgacagcagccgcggaagatgggggggggggggggtgggaggaagcttggaggcgggcagtacatagctaggcgggtgggcgggcagccaatgccgtcgggcgcgcagggctaggaggatgggcggagggggcacgatcgtcgacggcttccgccgcttgttccaccgccgcaacggctccacctccaactcccaccagtcgtccgtcgccggcgagggggaggaaggctcgcccgatctcgaggtcatcgaggacccggatctcgtcggcctccgcgccatccgcgtgcccaagcgcaagatgccgctgcccgtggagagccacaagaagaactcagtggaaatggagttcttcacagaatatggagaggcaagccagtaccagattcaagaagtcattggtaaagggagttatggagtagttgctgcagcagtagatacccgcacaggtgagcgggttgctatcaagaagatcaatgatgtgtttgagcatgtctcggatgccacacgcatactgcgagagatcaagcttcttcagttgcttcgtcaccctgacatagttgagatcaagcacatcatgctccctccttctaggagggagtttcaagatatctatgttgtgtttgagctcatggagtcggatctccatcaagtgatcaaggcgaatgatgaccttacccctgagcatcaccagtttttcctgtaccaacttcttcgtgctctcaagtacatacatgctgctaacgtatttcatcgtgatctaaagcccaagaatatactggctaactcggactgcaaactgaaaatctgtgactttggacttgcccgtgcatcatttaatgatgccccgtcagctatattttggacggattatgtggcaacaaggtggtaccgggcacctgaattgtgtggttcctttttctccaaatacactcctgcaattgatatttggagtattgggtgcatatttgctgaacttctcactggaaggccattgtttcctgggaagaacgttgtacaccaattagatctcatcacagatcttcttggaactccatcatccgagaccttatctcggattcgaaatgagaaggccaggagatacttgagctgcatgaggaaaaaatatcccgtgccgtttactcagaaatttcgaaatgctgatcctttggctcttcgtctgctagagcgtttgcttgcatttgatcctaaagatcggccttcagcagaagaggctctggctaatccatacttcgcaagccttgctaatgtggaacttgagccctcaagacaaccaatttcaaaacttgaattcgaatttgaaagaaggaagctggcaaaagatgatgttagagagttgatctaccgggagattttggaatatcatccacagatgctggaggagtacatgaaaggtggagaacaaattagcttcctctacccaagtggagttgaccgcttcaaacggcagtttgcacaccttgaggagcattacagcaaaggtgaaagaggttctccactgcagagaaagcatgcttctttaccaagggaaagagtggctgcgtcgaaggatggtaataatgaacaacatattggtgatcaggagagaagtgcagattctgttgcccacactactgtgagccctacaaggtcagaagatgtcggccaggatggctcgaaatccacaagcttaagctcccgaagctacctgaagagtgcaagcattagtgcttccaagtgtgtcgtcgttgcagataaacacccagaggatgatgaaatcccagaggaaatggaaggtgttgtcgatggattgtctgaaaaggtctctaggatgcactcctaggctccattgaccgtggggtgacaacaatctcgttgcaagatttctgttctgtcaggtaaactgtatgccgaccatatagaagacagccagggaaagcaaaacactgcattgaaaatctggagtttgggcgttacgaggaagacgcaggggcatttttcaccctgtttgtaccagcatgggccctgcatggatacatgaagaatccctgcgatgtaacactagttaggcccatggtggaattggaaatctaatgaacaatgaatcgtggtcagctgactcaccatgaggatatttcttttccaacggagtctggagttttacaatggctctgccatatgaattgtcagcagcgtatcattttctttccctttatctctgtatgtacgctttgcctttcaacacacaagaacaaggtcaagaagtatgctgctacaatatttatgccttcatggaccaaattggttattctgctaaacatgagtacacgaactgagtgacatacaac

SEQ ID NO: 1306 - DNA, 2524 bp, Panicum virgatum
gcacattatcagggggataaaaaggaaaaaaagaatccgtcgtcctccaatcccaactggcatagatcctgctcctttgccatcaaccccatcgctgtctcctttccattccgccctgcatccgtcaatccaatcccccacggtgccgacgacttcgtcgtcccttcagcgggagcagcacgccgtggggagcgagcaagcgtccggagcagcagcgagtgacagcagccgcggaagaagtgggggagagcttggaggcgcgcagtacatagctaggcgggcgggtgggcagccaatgccgtggggcgcgcagggctaggaggatgggcggagggggcacgatcgtcgacggcttccgccgcttgttccaccgccgcaacggctccacctccaactcccaccagtcgtccgtcgccggcgagggggaggaaggctcgtccgatctcgaggtcatcgaggacccggatctcgtcggcctccgcgccatccgcgtgcccaagcgcaagatgccgctgcccgttgaaagccacaggaagaactcagtggaaatggagttcttcacagaatatggagaggcaagccagtaccagattcaagaagtcattggtaaagggagttatggagtagttgctgcagcagtagatacccgcacaggtgagcgggttgctatcaagaagatcaatgatgtgtttgagcatgtctcggatgccacacgcatattgcgcgagatcaagctccttcggttgcttcgtcacccagacatagttgagatcaagcacatcatgctccctccttctaggagggaatttcaagatatctatgttgtctttgagctcatggagtcggatctccatcaagtgatcaaggcgaatgatgaccttacccctgagcatcaccagtttttcctgtaccaacttcttcgtgctctcaagtacatacatgccgctaacgtatttcatcgcgatctaaagcccaagaatatactagctaactcagactgcaaactgaaaatctgtgactttggacttgcccgtgcatcatttaatgatgccccgtcagctatattttggacggattatgtggcaacaaggtggtaccgggcacctgaattgtgtggttcctttttctccaaatacactcctgcaattgatatttggagtattgggtgcatatttgctgaacttctcactggaaggccactgtttcctgggaagaacgttgtacaccaattagatctcatcacagatcttcttggaactccatcatccgagaccttatctcggattcgaaatgagaaggccaggagatacttgagctgcatgaggaaaaaacaacctgtgccgtttactcagaaatttcgaaatgctgatcctttggctcttcgtctgctagagcgtttgcttgcgtttgatcctaaagatcgacctacagcagaagaggctctggctgatccatacttcgcaagccttgctaatgtggaacgtgagccctcaagacaaccaatttcaaaacttgaattcgaatttgaaagaaggaagctggcaaaagatgatgttagagagttgatctaccgagagattttggagtatcatccacagatgctggaggagtacatgaaaggtggagaacaaattagcttcctctacccaagtggagttgaccgcttcaaacggcagtttgcacaccttgaggagcattacagcaaaggtgaaagaggttctccactgcagagaaagcatgcttctttaccaagggaaagagtggctatgtcgaaggatggtaataatgaacaacatattggcgaacaggagagaagtgcagattctgttgcccgcactactgtgagcccaccaaggtcagaagatgttggccaggatggcttgaaatccacaagcttaagctcccgaagctacctgaagagtgcaagcattagtgcttccaagtgtgttgtcattgcagataaacacccagaggatgatgaaatccctgaggaaatggaaggtgttgtcgatggattgtctgaaaaggtctctaggatgcactcctaggctccaatgaccgtgggctgacagcaatctcgtcgcaagatttctgtcaggtaaactgtatgccgatgataagacagccagggaaagcaaaacactgcattgaaaatctggactttgggcgttacttgaagaagaggaagacgcaggggcgtttttcaccctgtttgtactagcatgggcccagcatggatccatgaagaatccctgcaatgtaacactagttagccatggtggaaatctaatgaacaatggatcgtggtcagcttactcaccatgaggatgtttctttttccaacggagtctggagttttacaacggccatgccatatgaattgtcagcagcgtctcattttctttccctttatctctgtatgtacgctttgcctttcaagacacaagtacaaggtcaagaagtatgattacagcatgctgctgcaatatttgtgccttcatgggaccaaattggttattctgct

SEQ ID NO: 1307 - DNA, 2481 bp, Setaria italica
gcacgttatcagggtcagggggataaaaaggaaaaaaagaattcgtccatccaatcccgactccttgccatcaacccccatcgctgtctcctttccattccgttctgcttccgtcaatccaatcccccaccgcgtcgacgacttgggcgcggcccccttccgcggaatcagcacgtcggtcaggggactaggcaaccgtccgtgaggtggagcagcgagtgacagcagcgaggaagaagcggggaagaagagagcttggaggcgggcggggcgggcagtacatagctagaggggtcggcgggcagccaatgccgtggggcgcgcagggctaggaggatgggcggagggggcacgatcgtcgacggcttccgccgcttgttccaccgccgcaacggctccacctccaactccaaccagtcgtccgtagccggcgagggggaggagggctcgcccgatctcgaggtcatcgaggacccggatctcgtcggcctccgcgccatccgcgtgcccaagcgcaagatgccgctgcccgtcgagagccacaggaagaactcagtggaaatggagttcttcacagagtatggagaggcaagccagtaccagatccaagaagtcattggtaaagggagttatggagtagttgctgcagcagtagatacccgcacaggtgagcgggttgcaatcaagaagatcaatgatgtgtttgagcacgtttcggatgccacacgcatactgcgggagatcaagctccttcggttactccatcacccagacatagttgagatcaagcacatcatgctccctccttcccggagggagttccaagatatctatgttgtttttgagcttatggagtcggatctccatcaagttattaaggcaaatgatgacctcacccctgagcatcaccagtttttcctgtaccaacttcttcgtgctctcaagtacatacatgctgctaacgtatttcatcgtgatctaaagcccaagaatatattggcaaattcagactgcaaactgaaaatctgcgactttggacttgcccgtgcatcatttaatgatgccccgtcagctatattttggacggattatgtggcaacaagatggtaccgggcacctgaactgtgtggttcttttttctccaaatacactcctggaattgatatttggagtattgggtgcatatttgctgaacttctcactggaaggccactgtttcctgggaagaatgtcgtacaccaattagatctcatcacagatcttcttggaactccatcatctgagaccttatctcggattcgaaatgagaaggccaggagatatttgagctgcatgcggaaaaaacatgccgtgccatttactcacaaatttcgaaacgctgatcctttggctcttcgtctgctagagcgcttacttgcgtttgatcctaaagatcggcctacagcagaagaggctctggctgatccatactttgcaagccttgctaatgtggagcgtgagccctcaagacacccaatttcaaaacttgagtttgaatttgaaagaaggaagctggcaaaagatgatgttagagagttgatctatcgagagattttggagtatcatccacagatgctggatgagtacatgaaaggtggagaacagattagcttcctctacccaagtggcgttgatcggttcaaacggcagtttgcacaccttgaggagcattacagcaaaggagaaagaggttctccactgcagagaaagcatgcttctctaccaagggaaagagtggttgtatcaaaggatggaaataatgagcaacatattggtgaccaggagagaagtgcagattctgttgcccgcactactgtgagccctccaaggtcagaagatgttggccaggatggcgtgaaatccccaagcttaagctccaggagctacctgaagagtgcaagcattagtgcctccaagtgtgtcgttgtctcaaataaacacccagaggatgatgaaatccctgaggaaatggaaggcgttgtcgatggattgtctgaaaaagtctccagaatgcactcctaggctccaaagaccgcggcaacagcaatctcattacaagattctgttaggtaaactgtatgccgatgatattgaagacagtctgtgaaagcaaaacactgcaatgcaattctggactctgggcgttacttgaagagggatcgagggcaattttcatcctgtttgtaccagcatgggccctgcatggatccctgcgatgtaacattagttagtccatggaggaaatagaatgaacaatgaagcatggtgaggtgactcaccatgaggacatgttccttttccaacggaatctggagttttacaacggctctgccatatgaattgtcagcaccgtatcattttcttttcctttatctgtgaatgtacattttgcctttcaagacaaccacaaggtcaagaaacatgattacagcttgctgttac

SEQ ID NO: 1308 - DNA, 2402 bp, Pennisetum glaucum
gctttctcctttccgttccgttttgctaccgtcaatccaatccaattctcccccaccgcgccgacgacttgggtgcgccccttccgcggaatcagcacgtcaggcgaggcaagcaagcgtccgcgaggtgtagcagcgagtgacagcagcgaggaagaagcggggaagaagagagagcttggaggcgggcgggggcggggcagtacatagctagaggggtcggctggcagccaatgccgtggggagcgcagggctaggaggatgggcggagggggcacgatcgtgcacggcttccgccgcttgttccaccgccgcaacggctccacttccacctccaacccgtcgtccgtcaccggcgagggggaggagggctcgcccgatctcgaggtcatcgaggacccggatctcgtcggcctccgcgccatccgcgtgcccaagcgcaagatgccgctgcccatcgagagccacaagaagaactcggtggaaatggagttcttcacagagtatggagaggcaagccagtaccagatccaagaagtcattggtaaagggagttacggagtagttgctgcagcagtagatacccgcacaggtgagcgggttgcaatcaagaagatcaatgatgtgtttgagcacgtctcggatgccacacgcatactgcgggagatcaagctccttcggttgctccgtcacccagacatagttgagatcaagcacatcatgctccctccttcccggagggagttccaagatatctatgttgtctttgagcttatggagtcggatctccatcaagttattaaggcgaatgatgacctcacccctgagcatcaccagtttttcctgtaccaacttcttcgtgctctcaagtacatacatgctgctaacgtatttcatcgtgatctaaaacccaagaatatactggctaactcagactgtaaactgaaaatctgcgactttggccttgcccgtgcatcatttaatgatgccccatcagctatattttggacggattatgtggcaacaaggtggtaccgggcacctgaactgtgtggttcttttttctccaaatacactcctgcaattgatatttggagtattgggtgcatatttgctgaacttctcactggaaggccacttttccccgggaagaacgtcgtacaccaattagatatcataacagaccttcttggaactccatcatctgagaccttatctcggattcgaaatgagaaggccaggagatatttaagctgcatgcgcaaaaaacatgccgtgccatttactcacaaatttcgaaacgctgatcctttggctcttcgtctgctagagcgcttacttgcgtttgatcctaaagatcggcctacagcagaagaggctctggctgatccatactttgcaagccttgctaatgtggagcgtgagccctcaagacacccaatttcaaaacttgagtttgaatttgaaagaaggaagctggcaaaagatgatgttagagagttgatctatcgagagattctggagtatcatccacagatgctggatgagtacatgaaaggtggagaacaaattagcttcctctacccaagtggagttgatcgcttcaaacggcagtttgcacaccttgaggagcattacagcaaaggagaaagaggttctccactgcagagaaaacatgcttctctaccaagggaaagagtggttgtatcaaaggatggaagtaatgaacaacatatcggtgatcaggagagaagtgcagattccgttgcccgcactactgtgagccctccaaggtcagaagatgttggccaggatggcgtgaaatccccaagcttaagctccaggagctacctgaagagtgcaagcattagtgcctccaagtgtgttgttgtctcaaataaacacccagaggatgatgaaatccctgaggaaatggaaggcactgtcgatggattgtctgaaaaggtctccagaatgcactcctaggctccaaagaccgtggcaacagcaagctcattgcaaaattctgttaggtaaactgtatgccgatgatattgaagacagtctgtgaaagcaaaacaccgcaatgcaattctggactctaggcattacttgaagagggatcgagggcaattttcatcctgtttgtactagcatgggctctgcatggatccgtgaagaatacctgcgatgtaacattagttagtccatggaggaaatagaatgaacaatgaagcatggtcaggtgactcaccatgaggacatgttctttatccaacggagtctggagttttacaacggctctgccatatgaattgtcagcaccttatcattttcttttcctttatctgtgaatgtacattttgccgttcaagacaaccacaaaggtcaagaacatgatt

SEQ ID NO: 1309 - DNA, 2603 bp, Oryza sativa
atgaaatagggggagtacgcggcagacggggaggagaaaaaaaaatcggtcactaatcagaagtataagacgaggagatcctgctacttcttccccatcaccaccaccaccaccatcgctttcttcctcctcgccttctgcttctgcatccatccatccatccattactcgccgaagacttcgcgcggggagagaggaggcaagcttggtcgcgggaacgcgggaagaaaggtccgagcttggaaggagaagaagaagtagccaagaacgcgagagcttggaaggcgagctgcggtggtgtagctagccaatgccggcggggaactggtagggagggggatggggggagggggcacgctcgtcgacggattccgccgcctcttccaccgccgcacggcgtccggctccaaccagtcgtccaacgccggcgaggaggccgcctcctccgacctcgaggtcgccgacgacccggatctcgtcgccctccgctccatccgcatccgcgtgcccaagcgcaagatgcctctccccgtcgagagccacaagaagaacacagtggaaatggagttcttcactgagtatggagaagcaagccagtaccagatccaggaagtcattggcaaaggaagttatggagtagttgctgctgcagtagatacccgcacgggtgagcgggttgcaatcaagaagatcaatgatgtgtttgagcatgtatcagacgctacgcgcatattgcgtgagatcaagctccttcgtctgctccgtcacccagacatagttgagatcaaacacattatgcttcccccttctcgaagggagttccaagatatttatgttgtttttgagctcatggaatcagatctccatcaagtcatcagagcgaacgatgacctcaccccggagcactaccagtttttcctgtaccaacttctccgtgctctcaagtacatccatgcagctaatgtatttcatcgcgatctaaagcccaagaatatactggcaaactcagactgcaaattgaaaatatgtgatttcggacttgcccgagcatcattcaatgatgccccttcagcaatattttggacggattatgttgcaacgaggtggtaccgagcacctgaattatgtggctcatttttctccaaatacactcctgcaattgatatttggagtattgggtgcatatttgctgaacttctcactgggagaccactatttcctgggaagaatgttgtgcaccaattagatattataacagatcttcttggaactccatcatcagaaaccttatccaggattcgaaatgagaaggccaggagatacttgagcaccatgcggaaaaaacatgctgtccccttctctcagaagttccgcaatactgaccccttggctcttcgtctgctagagcgtttactggcatttgatcctaaagatcggtcttcagctgaagaagctttggctgatccgtacttcgcaagtcttgctaatgtggaacgtgagccctcaagacatccaatctcaaaacttgagtttgaattcgagagacggaagctgacaaaagatgatgttagagaattaatttatcgagagattttggagtatcacccacagatgctgcaagagtatatgaaaggtggagagcagattagcttcctctatccaagtggggttgatcgcttcaaacgacagtttgcacaccttgaggagaactacagcaaaggagaaagaggttctccactgcagaggaagcatgcttctttaccgagggagagagtaggtgtatcaaaggatggttataaccaacaaaacaccaatgaccaagagaggagtgcagattccgttgcccgcactacagtaagccctccaatgtcacaagatgcacaacaacatggatctgctggccaaaatggtgtgacatccacagacttgagttcgaggagctatctgaagagtgcaagcattagtgcttccaagtgtgtcgctgtcaaggacaataaagaaccagaggatgattacatctctgaagaaatggaagggtcggtcgatggattgtctgaacaagtctccaggatgcactcctagtgcacaacgatgacgatgatcagtgcaagattctgtgaggcgcaccagatgctgataatttccaagcagaatgctgcactgcaagtttggactttggacaatgcaagtatgcaacagccagcccgagatgattggcatcttcttatgctcatccatgttcacatattcttcttgccattgtgctgtctgtcactacaggacccctgcatggattaatgtattatccctctgatgtaacactagattagtccatctgtccatggaggaatgaatagcaagcagccagcttgtgcatcatgtgggcatgttcattttccagtgagatctagtcatatccatgctttttttgtaatggtatatgaaacagtttatcagtgagactctggtccattcctctttgaagaactgctgagacagtgatccattcctctttgaagaactgttcattttcagtacattaagcctagtaaagttcagatgtttgagttcggtgcttaataatcatgtcacacgaattttcc

SEQ ID NO: 1310 - DNA, 3244 bp, Sorghum bicolor
taaaaaccttgtctgtgtcttgcgtcaccatcgaatcgagttcgttgcttgcgcaccgtctaccgataaactactaccgtagatatatcctaaggtagactgccgaccagctttcgtcgacacattgctagaattttttttctttttctagcagctagtaatttcggtaatagcaagcaattcaggcacagcctgccttttccaggtttcagctcctccagatttgcagtccaccactgtatgctgcgtgtgctccatcatcgtcatcagtctgaacacagcgcattatcaggagacgctagaaaaagaggggaggaaaagaaaatcgtctatccaatcccaactggtaaaataagatcccgttccttcccatcacgcccatcgttttccgctctccattccgttctgcatccgtcaatccactcccccacggcgccgacgactcgggctcccggctcccccccttggactcggacgggaacagcacgtcggggaaaggaagcaagcgtccgcgagtaggaacagtgacgagtgacggcagcagggggagggacgggacacgggaggaggggaggggacagaggaggagcttgggcggtggagctggtggactggtggtatatagctaggcgggcgggccgtgggcgggcagccaatgccgtcgggcgcgcagggctaggaggatgggcggagggggcgcgatcgtccacggcttccgccgctggttccaccgccggaacggctccacctccggctccaaccagtcgtccgtcgccggcgagggggacgacggctcgtccgatctcgaggtcatcgaggacccggatctcgtcgcactccgcgccatccgcgtgcccaagcgcaagatgccgctgcccgtcgagagccacaggaagaactcggtggaaatggagttcttcacagagtacggagaggcaagccagtaccagatccaagaagtcattggtaaagggagctacggagtagttgctgcagctgtagatacccgcaccggtgagcgggttgctatcaagaagatcaatgatgtgtttgagcacgtctcggatgccacacgcatactgcgggagatcaagctccttcggttgcttcgccacccagacatagttgagattaagcacattatgctccctccttctcggagggagttccaagacatctatgttgtttttgagctcatggagtcggatctccatcaagtgatcaaggcaaatgatgacctcacccctgaacatcaccagtttttcttgtaccaacttcttcgtgctctaaagtacatacatgctgctaatgtatttcatcgcgacctaaagcccaagaatatactggctaactcggactgcaaactgaaaatatgtgacttcggacttgcccgtgcatcatttaatgatgccccttcagctatattttggacagattatgtggcaacaaggtggtaccgggcacctgaactttgtggttcctttttctccaaatacactcctgcaattgatatttggagcattgggtgcatatttgctgaacttctcactggaaggccattatttcctgggaagaatgttgtgcaccaattagatcttataacggatcttcttggaactccatcatctgagaccttatctcggattcgaaatgagaaggccaggagatacttgagctgcatgcggaaaaaatatcctgtgccctttactcataaatttcgaaatgctgatcctttggctcttcgtcttctagagcgtttacttgcatttgatcctaaagatcggcctactgcagaagaggctctagcagatccatactttgcatcccttgctaatgtggaacgtgagccatcaagacatccaatttctaaacttgagtttgaatttgaaagaaggaagctggccaaagatgatgttagagaattgatctatcgagagattttggagtatcatccacagatgctggaggagtacatgaaaggtggagaacagattagcttcctctatccaagtggagttgatcggttcaaacggcagtttgcacatcttgaggagcattatagcaaaggagaaagaggttctccactgcaaagaaagcatgcttccttaccaagggaaagagtggttgtatcgaaggatggcaatactgaacaacatattaatgatcaggagaggagtgcagattctgttgcccgcactactgtgagccctccaaggtcagaagatgccgacatgaatgatgtgaaatccacaagtttaagctctcggagctacctgaagagcgcaagcataagtgcttccaagtgtgtcgttgtcaaaaataaacacccagaggatgatgaaatcccagaggaaatggaaggcgtcgtcgatggattgtctgaacaggtctccaggatgcactcctaggcaggtctgtccacggcgacagcaatcttggtgcaaggtttctatctggtacactgtatgtcgacgatgatacagaggacagcctgggaaagcgaaacactctatggtacactgcccacagctagtacttgggtagaagaggaatatgccaccgtctgatggttctttcttcatcatctgtatttccaccgtgtcatgccagcatgttgtggcgtctctggaagccctgcatggattcatgaagaattcctgagatgtagcactagttagtccatggagggaacagaatgaacaatgaagtatgatcagcctgtcgaccatgaagatgttttcttgcaatggagtctggacctatgtttgagttttattacaacggcttctgccgtacgaagtgtcagcactcagcagtgtatcatccttttttccattttgaggggatatcactacagtgcacattttgcctgtcaagaaactcatgagtaatttctccagtcatataactcataagtacactgaacttccttgggtaacaccttacttacggattaactatcgaaacagaccctttttgaacagaggataaacctatgcttataagaaatcaaggtaacagtttacatactgcaaaagcagtttaaaccctggcagaaaagcaagctagtcgaagcaacagaccaaggaaatcagatttcaactacatctgatagcatcactgaagtaggcataaagagcttcatccattgcgagattgcctccttcacgttcccgagacgttctctgtcttactcttgttgtttagtttatccaaaaataaaaaaaaattttaatatttcctg

SEQ ID NO: 1311 - DNA, 2603 bp, Zea mays
tgatttggcaaagcttattattagcttatataaggtgctaaaataactgtttttatatattatcaagcaggggagccactcacgatgacgtcactgttttatctagatttttcttttctctacaaattagaagaaagccgtccatccaatcccaactggtataacaagatcccgctcattcccatcacgcccatcattttccgttcttcaatccgtcaatccagtccccatccccacggcgccgacgactcgggggcttccccccttggacttggcccgggtgggagtagcacgtcggggaagggaagcaagcgtccgcgagtaaggacagaaaaccgaagggaggagtggagaggaggagcttgcttggagcgggtggacgtgtggtgtgtatatagttaagcgggcgggcgggcgggcagccaatgccgtcgggcgcgcagggctaggagcatgggcggagggggcgcgatcgtgcacggcttccgccgctggttccaccgccggagcgaaggctccacctccaactccaaccagtcgtccctcgccggcgagggggaagcggacgacggctcatccgatctcgaggtcatcgaggacccggatctcctcggcctccgcgccatccgcgtgcccaagcgcaagatgccgctgcccgtcgagagccacaggaagaactcagtagaaatggagttcttcacagagtacggagaggcaagccagtaccagatccaagaagtcattggtaaagggagctacggagtagttgctgcagctgtggacacccgcaccggtgagcgggttgctatcaagaagatcaatgatgtgtttgagcacgtctcggatgccacacgcatactgcgggagatcaagctcctccggttgcttcgtcacccagacatagtcgagattaagcacatcatgctccctccttctcggagggagttccaagacatctatgttgtttttgagctcatggagtcggatctccatcaagtgatcagggcgaatgatgacctcacccctgaacatcaccagtttttcctgtaccaacttcttcgagctctcaagtacatacatgccgctaatgtattccatcgtgatctaaagcccaagaatatactggctaactcggactgcaaactgaaaatatgtgactttggacttgcccgtgcatcattcaatgatgccccttcagctatattttggacagactatgtggcaacaaggtggtaccgggcacctgaactatgtggttcctttttctccaaatacactcctgcaattgatatttggagcattgggtgcatatttgctgaacttctcactggaaggccactatttcctgggaagaatgttgtacaccaattagatattataacagatcttcttgggactccatcatctgagaccttatcccggattcgaaatgagaaggccaggagatatttgagctgcatgcggaaaaaatatcccgtgccctttactcataaatttcgacatgctgatcctttggctcttcgtcttctagagcgtttgcttgcatttgatcctaaagaccggcctagtgcagaagaggctctagctgatccatactttgcatcccttgctaatgtggaacgtgagccatcaagacacccgatttctaaacttgagtttgaatttgaaagaaagaagctggccaaagatgatgttagagaactgatctatcgagagattttggagtatcatccacagatgctggaggagtacatgaaaggcggagaacagattagcttcctctatccaagcggagtcgaccgcttcaaactgcagttcgctcatcttgaggagcattacagcaaaggagaaagaggttccccactgcaaagaaagcatgcttccttaccaagggaaagagtggttgtatccaaggatggcaatactgaacaacaaattaatgaccaggagagaagcgcagattctgttgcccgcactaccgtgagccctccaaggtcagaggatgctgacatggatgatgtgaaacccacaagcttaagctctcggagctacctgaagagtgcaagcataagcgcttccaagtgcgtcgttgtcagaaataaacacccagagccagaggatgatggaatacctgaggagatggaaggcaccgtcgatggattgtctgaaaaggtctccaggatgcactcctaaggcaggactgtccatggcgacagcaatctcgacacaagatttctgtctggtgcactgtaatgccgacgacacactgtttggatcttgtgtacacccacagctagttcaactaagatgtagcactagttcgtccatggaggaagcagaatggacgatgaagtgtggtcagcctgtcgaccatgaggtgttttcttccaatggagtctagggtatgtttgagttctacaacggcttgtgccgtacgaagtgtcagcagtgtacgaggaggaggatatcgttgtcagtacacattttgcctgtctagaaaattatgagtactttctccgatcacaagtacatgtacatccatgtttgtcttaagataaaaaaagaaaattcacaaatactagtcagtcgtggtcgcaatcaaa

SEQ ID NO: 1312 - DNA, 2682 bp, Zea mays
gtctgaagtctaaacagtgaacactcattcagcgcattatcaggaggcgatatagaggggagaaaaggaaaatcgtccatccaatcccaacttggtataacaagatcccgctcctttcccatcaccacccatcgttttccgctttgcatccgtcaatctgcttgccatcagcccccacgggccacggcgccgacgactcagcatcccgccttggacttggacgggatcagcacgtcggtcggggaagcaagtgtccagtccatccatccgcgaccgcgagtaggaacagtaactgacggcggcaagggagtagaggagggacgggacacgggaagagaggaggagcttgcttggacagccggtggactggtgctggtatatagatagctactagaggtaggcgggcgggcgggcggccaatgctgtcaggcgcgtagggctaggagcatgggcggagggggcgcgatcgtccacggcttccgccgctggttccaccgccggagcggctccacctccaatcagtcgtccatcgccggcgacggcgagggggaggcggacggcggctcgccggatctcgagatcgtcgatgacccggatctcctcggcctccgcgccatccgcgtgcccaagcgcaagatgccgctccccgtcgagagccacaggaaggactcggtggaaatggagttcttcaccgagtacggagaggcaagccagtaccagatccaagaagtcattggtaaaggcagctacggggtagttgctgcagctgtagatacccgcaccggtgagcgggttgctatcaagaagatcaacgatgtgtttgagcatgtctcggacgccacacgcatactgcgggagatcaagctccttcggttgcttcgtcacccagacatagttgagattaagcacatcatgctccctccatctcggagggagttccaagatatttatgttgtttttgagctcatggagtctgatctccatcaagtgatcaaggccaatgatgacctcacccctgaacatcaccagtttttcctgtaccaacttcttcgtgctctcaagtacatccatgctgctaatgtatttcatcgtgacctaaagcccaagaatatactggctaactcggactgcaaactgaaaatatgtgactttggtcttgcccgtgcatcatttaatgatgccccttcagctatattttggacagattatgtggcaacgaggtggtaccgggcacctgaactatgtggttcttttttctccaaatacactcctgcaattgatatttggagcattgggtgcatatttgctgaacttctcactggaaggccactatttcctgggaagaatgttgtacaccaattagatattataacagatcttcttggaactccatcatctgagaccttatctcggatccgaaatgagaaggccaggagatacttaagctgcatgcggaaaaaatatcccgtgccctttactcataaatttcgaaatgccgatcctttggctcttcgtcttttagagcgtttacttgcatttgatcctaaagatcggcctactgcagaagaggctctagctgatccatactttgcatcccttgctaatgtggaacgtgagccatcaagacacccaatttctaaacttgagtttgaatttgaaagaaggaagctggccaaagatgatgttagagaattgatctatcgagagattttggagtatcatccacagatgctggaggagcacatgcaaggtggagaacagattagcttcctctacccgagtggagttgatcggttcaaacggcagtttgcacatcttgaggagcattatagcaagggagaaagaggttctccactgcaaagaaagcatgcttctttaccaagggaaagagtggttgtatcgaaggacggtgatactgatcaacatattaatgaccaggagagaagtgcagattctgtcgcccgcaccactgtgagccctccaaggtcagaagacgacgacatgagcgatgtgaaatccacaagcttaagctctcggagctacctgaagagtgcgagcataagtgcttccaagtgtgtcgttgccacgaagaaacacccggaggacgatggaatcgctgaggaaatggaaggcgccgtcaatggattgtctgaaaaggtctccaggatgcactcgtaagcaggactgcccctggcaacagcaaccttgttgcaaggtttctgtctctggtacactgtattccgacgacagccttggaaaggcaaacactgtatgtcacacagcagtacagcacactgtgctgcgaggttgggttttgcttgcgtacatccatccacagctagttcgactttacctgggtggaagaggaacacaccaccgcctgatggccctttcttcatcgtctgcatttccaccgtgtcatgccagcgctgcgtggcacctctagaaggtagaagccctgcatggattcatgaagaattcctaagatgtagcactagtcagtgcatggaggaaacatagtcggcctgtcgaccatgagatgttttcttgcaaatggagtctggacctatggttttcagttttattacaacggcttctgccgtaggaagtgtcagcagtgtatcatccctgtaatacccaatttataagagaccatataaaaggagaaaaatcatttgcttt

SEQ ID NO: 1313 - DNA, 1929 bp, Panicum virgatum
atagatcctgctcctttgccatcaaccccatcgctgtctcctttccattccgccctgcatccgtcaatccaatcccccacggtgccgacgacttcgtcgtcccttcagcgggagcagcacgccgtggggagcgagcaagcgtccggagcagcagcgagtgacagcagccgcggaagaagtgggggagagcttggaggcgcgcagtacatagctaggcgggcgggtgggcagccaatgccgtggggcgcgcagggctaggaggatgggcggagggggcacgatcgtcgacggcttccgccgcttgttccaccgccgcaacggctccacctccaactcccaccagtcgtccgtcgccggcgagggggaggaaggctcgtccgatctcgaggtcatcgaggacccggatctcgtcggcctccgcgccatccgcgtgcccaagcgcaagatgccgctgcccgttgaaagccacaggaagaactcagtggaaatggagttcttcacagaatatggagaggcaagccagtaccagattcaagaagtcattggtaaagggagttatggagtagttgctgcagcagtagatacccgcacaggtgagcgggttgctatcaagaagatcaatgatgtgtttgagcatgtctcggatgccacacgcatattgcgcgagatcaagctccttcggttgcttcgtcacccagacatagttgagatcaagcacatcatgctccctccttctaggagggaatttcaagatatctatgttgtctttgagctcatggagtcggatctccatcaagtgatcaaggcgaatgatgaccttacccctgagcatcaccagtttttcctgtaccaacttcttcgtgctctcaagtacatacatgctgctaacgtatttcatcgtgatctaaagcccaagaatatactagctaactcagactgcaaactgaaaatctgtgactttggacttgcccgtgcatcatttaatgatgccccgtcagctatattttggacggattatgtggcaacaaggtggtaccgggcacctgaattgtgtggttcctttttctccaaatacactcctgcaattgatatttggagtattgggtgcatatttgctgaacttctcactggaaggccactgtttcctgggaagaacgttgtacaccaattagatctcatcacagatcttcttggaactccatcatccgagaccttatctcggattcgaaatgagaaggccaggagatacttgagctgcatgaggaaaaaacaacctgtgccgtttactcagaaatttcgaaatgctgatcctttggctcttcgtctgctagagcgtttgcttgcgtttgatcctaaagatcgacctacagcagaagaggctctggctgatccatacttcgcaagccttgctaatgtggaacgtgagccctcaagacaaccaatttcaaaacttgaattcgaatttgaaagaaggaagctggcaaaagatgatgttagagagttgatctaccgagagattttggagtatcatccacagatgctggaggagtacatgaaaggtggagaacaaattagcttcctctacccaagtggagttgaccgcttcaaacggcagtttgcacaccttgaggagcattacagcaaaggtgaaagaggttctccactgcagagaaagcatgcttctttaccaagggaaagagtggctatgtcgaaggatggtaataatgaacaacatattggtgaacaggagagaagtgcagattctgttgcccacactactgtgagccctacaaggtcagaagatgtcggccaggatggctcgaaatccacaagcttaagctcccgaagctacctgaagagtgcaagcattagtgcttccaagtgtgttgtcattgcagataaacacccagaggatgatgaaatccctga

SEQ ID NO: 1314 - DNA, 1741 bp, Saccharum officinarum
ctgacggcaccaagcgagtagaggagggacgggacacgggaggagaggagcttggagccggtggactggtggtggtatatagctaggcgggcgggcgtgcgggccaatgccgtcgggcgcgcagggctaggagcatgggcggaggaggcgcgatcgtccacggcttccgccgctggttccaccgccggaacggctccacctccggctccaaccagtcgtccgtcgccggcgagggggacgacggctcgtccgatctcgaggtcaacgaggacccggatctcgtcggcctccgcgccatccgcgtgcccaagcgcaagatgccgctgcccgtcgagagccacaggaagaactcggtggaaatggagttcttcacagagtatggagaggcaagccagtaccagatccaagaagtcattggtaaagggagctacggagtagttgctgcagctgtagatacccgcaccggtgagcgggttgctatcaagaagatcaatgatgtgtttgagcacgtctcggatgccacgcgcattctgcgggagatcaagctccttcggttgcttcgtcacccagacatagttgagattaagcacatcatgctccctccttctcggagggagttccaagatatctatgttgtttttgagctcatggagtccgatctccatcaagtgatcaaggcgaatgatgacctcacccctgaacatcaccagtttttgctgtaccaacttcttcgtgctctcaagtacatacatgctgctaatgtatttcatcgcgacctaaagcccaagaatatactggctaactcggactgcaaactgaaaatatgtgactttggacttgcccgtgcatcatttaatgacgccccttcagctatattttggacagattatgtggcaacaaggtggtaccgggcacctgaactatgtggttcctttttctccaaatacactcctgcaattgatatttggagcattgggtgcatatttgctgaacttctcactggaaggccattatttcctgggaagaatgttgtacaccaattagatcttataacagatcttcttggaactccatcatctgagacgttatctcggattcgaaatgagaaggccaggagatacttgagctgcatgcggaaaaaatatcccgtgccctttactcataaatttcgaaatgctgatcctttggctcttcgtcttctagagcgtttacttgcatttgatcctaaagatcggcctactgcagaagaggctctagctgatccatactttgcatcccttgctaatgtggaacgtgagccatcaagacaccctatttctaaacttgagtttgaatttgaaagaaggaagctggccaaagatgatgttagagaattgatctatcgagagattttggagtatcatccacagatgctggaggagtacatgaaaggtggagaacagattagcttcctctatccaagtggagttgatcggttcaaacggcagtttgcacatcttgaggagcattatagcaaaggagaaagaggttctccactgcaaagaaagcatgcttctttaccaagggaaagagtggttgtatcgaaggatggtaatactgagcaacatattaatgaccaggagagaagtgcagattctgttgcccgcactactgtgagccctccaaggccaaagatgctgacatgaatgatgtgaaatccacgagcttaagctctcggagctacctgaagagtgcaagcata

SEQ ID NO: 1315 - DNA, 1123 bp, Triticum aestivum
tccgggcgtcatcccccggagagcaacgcgagccacccaaacggagggagctcgcccttccttccacgcgccgaaatgctggccgccaccgccgcctgccgcgcgccggcgcggccgctccccgccgcgcgacccggcagcagctacctcctcgggagcgtccttctccccaaacggagagcgccggcggcgaggaggaggggacggagcgcggcggtgcggtgcgggctgctccccgtggacccgtgggcgcccggcgtggactcccagagcatcgcgtcgcagctcttcgccgtgtcgctgttcccctacctggggttcctctacttcatgacccggtccaagacggcgccggggctcacgctcttcggcttctacttcctcctcgccttcgtcggcgccaccatacctgctgggatatatgccaaagttcattacgggacctcgctgtctaatgtggacttgctgcacgggacggcggaatcgcttctcaccctcaccaatctgttcattgtgcttgggctgaggggagccttgaggaacctggacaaagcagaggagagcagccctgaagctcctcaggacagcaaggagaagagttcagtataggtactctcaccagttcccccaaatggtgcttgtaaatccctgagaaccttttcctggtgcctgtagtgatgacattgtgctgtagtgagtgcacatttctgttgctcaactagcttatgaagcccctgctgctgtaataaactgcacagactggctttgtgcatgtgctgatccataatactactctctctgtaaggagggagtatattgcagtggccagtgtatgaccactacagttctactagtgatggtgctatatctactgcagatatatagcttccattgcgataaatgatcacgagtctgaatctaagtactagtgggaatacagtacgatagtggacacggcgcctacagtcttctgaaactccggttagaaaaactacatattccagaacagctcgtcgaactccatgtcagccccgaggccgccgccggcagcgtagccgtagttgccggcaagctggcaccaggagttccccggcgtgtagcagccggccggcgaggaggggaa

SEQ ID NO: 1316 - DNA, 782 bp, Secale cereale
catcccccgggacgagcaacgcgagccacccaaacggagggagctcgtccttcccttccccgcgccgaaatgctggccgccgccgccgcctgccgcgcgccggcgcggccgctccccgcagcgcgacccggcagcggatacctccacgggcgcgtccttctccccaagcggagagcgccggcggcgaggaggaggggtcggagcgcggctgtgcggtgcgggctgctccccgtggacccgtgggcgcccggcgtggactcccagagcatcgcgtcgcagctcttcgccgtgtccctgttcccctacctggggttcctctacttcatgacccggtccaagacggcccccgggctcacgctcttcggcttctacttcctcctcgccttcgtcggcgccaccaccaaagttcattacgggacctcgctttcaaatgtggacttgctgcacgggacggcggaatcgctcctcacactcaccaatctgttcattgtgcttgggctgaggggagccttgaggaacctggacaaagcagaggagagcagtcctgaagctccccaggacagcaaggagaagagttcagtataggtactcctctcaccagttcccccaaatggtgcttgtaaattcctgagaacctcttcctggtgcatgtagtgatgacattgtgccgtagtgagtctacatttctgttgctcaactagcttatgaagcccctgctgctgtaataaactgcacagattattggttttgtgcatgtgctgatccataatatattggagtta

SEQ ID NO: 1317 - DNA, 750 bp, Pseudoroegneria spicata
  misc_feature (11)..(11): n is a, c, g, or t
  misc_feature (255)..(255): n is a, c, g, or t
gtcgcccttcnttccccgcgccgaaatgctggccaccgccgccacctgccgcacgccggcgccggcgcacccctccgcgcgacccggcagcagctacctcctcgggcacgtccttctccccaagcggagagcgccggcggcgaagaggaggggacggagcgcggcggtgcggtgcgggttgctccccgtggacccgtgggcgcccggcgtggactcccagagcatcgcgtcgcagctcttcgccgtgtcgctgtncccctacctggggttcctatacttcatgacccggtccaagacggcgcccggcctgacgctcttcggcttctacttcctcctcgccttcgtcggcgccaccatacctgctgggatatatgccaaagttcattacgggacctcgctgtctaatgtggacttgctgcacgggacggcggaatcgcttctcacccttaccaatctgttcatcgtgcttgggctgaggggagccttgaggaacttggacaaaacagaggagaacagtcctgaagctcctcaggacagcaaggagaagagttcagtataggtactctcaccagttcccccaaatggtgcttgtaaatccctgagaaccttttcttggtgaatgtagtgattgtgctgtagtgagtgtacatttctgttgctcaactagctataaaggccctgctactgtaataaactgcacagattggcttttgtgcatgtgctgatccataatatattggagttatggaa

SEQ ID NO: 1318 - DNA, 668 bp, Secale cereale
agcagctacctcctcgggcgcgtccttctccccaagcggagagcgccggcggcgaggaggaggggtcggagcgcggctgtgcggtgcgggctgctccccgtggacccgtgggcgcccggcgtggactcccagagcatcgcgtcgcagctgttcgccgtgtccctgttcccctacctgggtttcctctacttcatgacccggtccaagacggcgcccgggctcacgctcttcggcttctacttcctcctcgccttcgtcggcgccaccatacctgctgggatatatgccaaagttcattacgggacctcgctgtctaacgtggacttgctgcacgggacggcggaatcgctcctcacactcaccaatctgttcattgtgcttgggctgaggggagccttgaggaacctggacaaagcagaggagagcagtcctgaagctccccaggacagcaaggagaagagttcagtataggtactcctctcaccagttcccccaaatggtgcttgtaaattcctgagaacctcttcctggtgcatgtagtgatgacattgtgctgtagtgagtctacatttctgttgctcaactagcttatgaagcccctgctgctgtaataaactgcacagattattggttttgtgcatgtgctgatccataatatattggaagtt

SEQ ID NO: 1319 - DNA, 1121 bp, Avena sativa
gaaaaaaagagggagctcgtccttccttccacacgcccaaatgctggccaccgccgcctcccgagcgccggcgccggccgcgagacccggcggctgctgcctcctcggccgtgtccgcgtcagcaagcggagggcgccgactaggagagggcgagcggtggtgcggtgcgggatgctccccgtagacccatgggcgcccaccatggactcccagagcatcgcgtcgcagctcttcgccgtgtccctgttcccgtacctgggattcctctacttcatgaccaggtccaagacggcgcccgggctcacgctcttcggcttctacttcctcctcgccttcgtcggcgccaccatacctgctgggatatatgccaaagttcactacgggacctcgctctctaatgtcgacttgctgcacgggacagctgaatcgctactgactctcactaatctgttcatcgtgctggggctgaggggggccttgagaaaactgaaggacggagaggagagcaattctgaagctcctcgggacagcaaggaaaagagttctgtctagacacactcaatagttcctctctgaaaggtgcttgcatatatccctgaggatttctatagtgatgacattgtagcctagctcctaggagtgtacatttcttttgcccagctctagttttcaaaggcctgtgtaataaactgcagggattggctcttgtgcatatgctgatccataatatattggagttatggagctactgcagttgtgagtttttgtactagatcaatctgggcctattccattcgctggtgtatgaccaattgggatactcttccctagtgataactgatcatatgctaagtgtaccacctgtgatcacacaactcttctgaatctaatactagtgcgggtacagcaggatactggccgcgatgcctataggctctgaatctgtggttggaaaaactgggacgggttcaagaagaactcgagctgagcctcgaactccatgtcagccccgacgccgcctgctgccgtgtagtcgtagctgccgtcaagctggtagcagtagctggccggcgagctgcagccgtcgatggcctggtgtggcgtcacgggctcaccggca

SEQ ID NO: 1320 - DNA, 636 bp, Triticum aestivum
cctaattaaccagtccctgatcccagaaagacgaagagatggcctccttctccaagcaggcggcactcttcttgctggcggcgctgctgctgtgcctcctctgcactagagggcaagcagcaaggcctacaccaggatccagccaccaacaatcacagggtgctggctccgccacctcccatgagaagagtgctgcaggaaccgggatggaaatggagcaggtagatcaggaggcgatgagaggatgcgagggaggggaaggagcggaggagtgcctgatgaggaggaccctcgtcgctcacaccgactacatctacacccaggggaaacacaactagatgctgtgctgaaagcctgaaaccgttggtgcttacgatggactccgtgaactgaaggccatatctggatgatcgcatggttaagcaggccctacttaagaaaggcatttttcatgagctcgtcggtctgttctgcagtcccatgcaccgtctgtgaattacagctatagtcacctctttgtattttccgcgtttcgttgttttcaggtcatgtatctgttctggactcgaacttttatcatcatgtatatatttattgaatatattatctctctttatctatacactgaatagtaat

SEQ ID NO: 1321 - DNA, 726 bp, Triticum aestivum
ccgtctacggcagtacggcacggccgctgtgtggccgaaccgcgccacccacccgccccgccacggtgtcgattggccatcagttccctatatataagtccatgggcggatgcttatgatcgtataccgccacctaattaacaagcccctgatcccagagagaccaagagaataagagatggcctccttctccaagcaggcggcactcttcttgctggcagcgctgctgctgtgcctcctctgcactagagggcaagcagcaaggcctacaccaggatccagcctccaaaaatcacagggtgctggctccgccacctcccatgagaagagtgctgcaggaaccgggatggaaatggagcaggtagatctggaggcgatgagaggatgcgagggaggggaaggagcggaggagtgcctgatgaggaggaccctcgtcgctcacaccgactacatctacacccaggggaagcacaactagatggtgcgctgaaagcctgaaaccgctggtgcttacgaaggactccgtgaactgaaggccatatctggatgatcgcatgcttaagcaggccctacttaagaaaggcatttttcatgagctcgtcggtctgttctgcagtcccatgcatcgtctgtgaattacagctatagtcgccgcctccttgtattttccctgtttccttgttttcaggtcatgtatctgttctcgactcgaaattttatcatcat

SEQ ID NO: 1322 - DNA, 672 bp, Secale cereale
agaccgccacctaattaaccagcccctgatcccagagagatcaagagatggcctccttctccaagcagacggcactcttcttgctggcagcgctgctgatgtgcctcctctgcactagagggcaagcagcaaggcctacaccaggatccagccaccacaaatcacagggtactggctccgccatctctcatgagaagagtgttgcaggagccgggatggaaatggagcaggaacaggaagatcaggaggcgatgagaggatgcgagggaggggaaggagcggaggagtgcctgatgaggaggaccctcgtcgctcacaccgactacatctacacccaggggaagcacaactagacggtgcgctgaaaccctgaaactgctggtggttacgaaggactccgtgagctgaaggccacatctggatgatcgcatgcttaagcaggccctatttaagaaaggcatttttcatgagctcgtcggtctgttctgcagtcccatgcatcgcctgtgaattacagatatagtcgccgcctctttgtattttccctgtttccttgttttcaggtcatgtatctgttctggactccagcttttattatcatatatgtatatattgaatattttatctctttatctatacactgaatactacacttatagcaacaaaaaagtc

SEQ ID NO: 1323 - DNA, 504 bp, Gossypium hirsutum
  misc_feature (496)..(496): n is a, c, g, or t
gcacgagcagaaatccgcagccatggcttcccagctctccgccatgacctccgtgccgcagttccacggcctcaggacctactcctcgcccaggtccatggcgacgctgccgtccttgaggaggaggaggtcccagggcatccgctgcgactacatcggctcctccaccaacctcatcatggtgacgacgacgaccctgatgctcttcgccgggcggttcgggctggcgccgtcggcgaacaggaaggcgacggcggggctcaagctggaggcgcgcgagtccgggctgcagacgggcgacccggccggtttcacgctcgccgacacgctcgcatgcggcgccgttggccacatcatgggcgtcggcatcgtgctcggcctcaagaacaccggcgtcctcgaccagatcatcggctagaataacccttccttttccctccatagctgttctgcatccatcgggcgctccatctagtggatcaactaatggcttccncttttccg

SEQ ID NO: 1324 - DNA, 587 bp, Leymus cinereus x Leymus triticoides
gcacgaggcagcacacaaatccgcagccatggcttcccagctctccgccatgacctccgtgccgcagttccacggcctcaggagctactcctctcccaggtccatggccacgctgccgtccttgaggaggaggtcccagggcatccgctgcgactacatcggctcctccaccaacctcatcatggtgacgacgacgaccctgatgctgttcgccgggcggttcgggctggcgccgtcggcgaaccggaaggcgacggcggggctcaagctggaggcgcgcgagtccgggctgcagacgggtgacccggccggctttacgctcgccgacacgctcgcatgcggcgccgtcggccacatcatgggcgtcggcatcgtgctcggcctcaagaacaccggcgtcctcgaccagatcatcggctagaactttccttgtccgtccatagctgttctgcatccatcgggcgctccatgtagtggatcaactaatgctgcctttgtaatttgatgatgtggtgtagtacaatgtatgtgtatgcatctttgtttcagcgggacgtaccgccgcgccggtgcggcaactgcttgat

SEQ ID NO: 1325 - DNA, 744 bp, Pseudoroegneria spicata
gcatccacagcacacaaatccgcagccatggcttcccagctctccgccatgacctccgtgccgcagttccacggcctcaggagctactcctcgcccaggtccatggccacgctgccgtccttgaggaggaggtcccagggcatccgctgcgactacatcggctcctccaccaacctcatcatggtgacgacgacgacgctgatgctgttcgccgggcgtttcgggctggcgccgtcggcgaaccggaaggcgacggcggggctcaagttggaggcgcgcgagtccgggctgcagacgggcgacccggccggcttcacgctcgccgacacgctcgcatgcggcgccgtcggccacatcatgggcgtcggcatcgtgctcggcctcaagaacaccggcgtcctcgaccagatcatcggctagaaccttccttttccgtccatagctgttctgcatccatcgagcgctccatgtagtggatcaactaatgctccgtttgtaatttgatgatgtgaatgtatgtgtatgcatctttgttttagcgggacgtaccgcgccgcgccggtgtggcaactgcttgatcccatgcgtttttcatcatctagagtatctttcacatggtgaagatcctcttgcgctaagggcaacatagagcccaaaaacaaaattaggccccgcttggattaccgttttcgttcgtattcggctggtttaggatacacgtctggactggtcgttttgttttca

SEQ ID NO: 1326 - DNA, 600 bp, Festuca arundinacea
  misc_feature (115)..(115): n is a, c, g, or t
  misc_feature (551)..(551): n is a, c, g, or t
ggcacgaggagaacacagcaaatccgccgctgccatggcttcccagctctccgccatgacctccgtgccgcagttccacggcctcaggacctactcctcgcccaggtccatggcngcgctgccgtcgttgaggaagaggtcccagggcatccggtgcgactacatcggctcatccaccaacctcatcatggtgacgacgacgacgctgatgctgttcgccgggcggttcgggctggcgccgtcggcgaaccggaaggcgacggcggggctgaagctggaggcccgcgagtccgggctgcagactggcgacccggccgggttcacgctcgccgacacgctcgcgtgcggctccgtcggccacatcttgggcgtcggcatcgtgctcggcctcaagaacaccggcgtcctcgaccagatcatcggctagatccatcgtgcgatcgatgtaatagatcgattcatgctccggcgcctacgtgctgtaatgtgatgatgtgatgtacaatgtatgtgtctatgcatcttgttgtttcaatggaacgtacagctanagcttcttcacgtactcgatccaggtttaaatgagaaggtgccatgaat

SEQ ID NO: 1327 - DNA, 645 bp, Lolium multiflorum
ggcactcgagcaatcgcagacagtatccagaacatagcaaatccgccgctgccatggcttcccagctctccgccatgacctccgtgccgcagttccacggcctcaggacctactcgtcgcccaggtccatggcggcgctgccgtcgttgaggaagaggtcccagggcatccggtgcgactacatcggctcatccaccaacctcatcatggtgacgacgacgaccctgatgctgttcgccgggcggttcgggctggcgccgtcggcgaaccggaaggcgacggcggggctgaagctggaggcccgcgagtccgggctgcagactggcgacccggcagggttcacgctcgccgacacgctcgcctgcggctccgtcggccacatcttgggcgtcggcatcgtgctcggcctcaagaacaccggcgtcctcgaccagatcatcggctagaaacctcgtccatcgatggctgttctatacatccatcggggcgatcgatgtaatagttcgactgatgctccggcgcctacctgctgtaatgtgatgtacaatgtatgtgtctatgcatcttgttgtttcgatggaacgtactgctagagcttcttcacgcactccaggtttaaatgacaaggtgccataaattcagctc

SEQ ID NO: 1328 - DNA, 648 bp, Lolium multiflorum
gactcgagcaatcgcagacagtatccagaacccagcaaatccgccgctgccatggcttcccagctctccgccatgacctccgtgccgcagttccacggcctcaggacctactcctcgcccaggtccatggcggcgctgccgtcgttgaggaagaggtcccagggcatccggtgcgactacatcggctcttccaccaacctcatcatggtgacgacgacgacgctgatgctgttcgccgggcggttcgggctggcgccgtcggcgaaccggaaggcgacggcggggctgaagctggaggcccgcgagtccgggctgcagactggcgacccggccgggttcacgctcgccgacacgctcgcctgcggctccgtcggacacatcttgggcgtcggcatcgtgctcggcctcaagaacaccggcgttctcgaccagatcatcggctagaaacctcgtccatcgatggctgttctatacatccatcgggcgatcgatgtaatagttcgattgatgctccggcgcctacttgctgtaatgtgatgtacaatgtatgtgtctatgcatcttgttgtttcgatggaacgtactgctagagcttcttcacgcactccagctggtttaaatgacaaggtgccataaattcagctccaa

SEQ ID NO: 1329 - DNA, 587 bp, Lolium multiflorum
ggcactcgagcaatcgcagacagtatccagaacacagcaaatccgccgctgccatggcttcccagctctccgccatgacctccgtgccgcagttccacggcctcaggacctactcgtcgcccaggtccatggcggcgctgccatcgttgaggaagaggtcccagggcatccggtgcgactacatcggatcatccaccaacctcatcatggtgacgacgacgacgctgatgctgttcgccgggcggttcgggctggcgccgtcggcgaaccggaaggcgacggcggggctgaagctggaggcccgcgagtccgggctgcagactggcgacccggcagggttcacgctcgccgacacgctcgcgtgcggctccgtcggccacatcttgggcgtcggcatcgtgctcggcctcaagaacaccggcgtcctcgaccagatcatcggctagatccatcgtgcgatcgatgtaatagatcgattcatgctccggtgcctacgtgctgtaatctgatgatgtgatgtacaatgtattgtgtctatgcatcttgtcgtttcaatggaacgtccagctgctagagtttcttcacaa

SEQ ID NO: 1330 - DNA, 604 bp, Avena sativa
caatcgcagcatccagaacacagcaaatccgacgcggccatggcttcccagctctccgccatgacctccgtgccgcagttccacggcctccggacctactcctccccaaggtccatggcgacgctgccgtcgctgaggaagaggtcccagggcatccggtgcgactacatcggctcgtccaccaacctcatcatgatcacgacgacgacgctgatgctgttcgccgggcggttcgggctggcgccttcggcgaaccggaaggcgacggcggggctgaagctggaggcccgcgagtccgggctgcagaccggcgacccggccgggttcacgctcgccgacacgctcgcctgcggctccgtcggccacatcttgggcgtcggcatcgtgctcggcctcaagaacaccggcgtcctcgaccagatcatcggctagaggcgatcgatgtaacggatcgattaatgctccggcgcctacggtgctgtaatttgatgatgtgatgtacaatgtactatgtgtgtaatgcatgttgtttcaatggaacgtaacagctagagcttcctcgcttcagtttagatgagaaagggtgccataaataaatatacct

SEQ ID NO: 1331 - DNA, 688 bp, Secale cereale
cttcccagctctccgcgatgacctctgtgccgcagttccacggcctcaggagctactcctcgcccaggtccatggcgacgctgccgtccttgaggaggaggaggtcacagggcatccgctgcgacttcatcggctcctccaccaacctcatcatggtgacgacgacgacgctgatgctgttcgccgggcggttcgggctggcgccgtcggcgaacaggaaggcgacggcggggctcaagctggaggcgcgcgagtccgggctgcagacgggcgacccggccggcttcacgctcgccgacacgctcgcatgcggcgccttcggccacatcatgggcgtcggcatcgtgctcggcctcaagaacaccggcgtcctcgaccagatcatcggctagaaccttccttttccgtccatagctgttctgcatccatcgggcgctccatgtagtggatcaacttctgctccctttgtaatttgatgatgtcaatgtatgtgtatgcatctttgtttcagcaggacgtaccgccgcgccggtgtggcaactgcttgatcccatgcgtttttttttttttttttgtaaagtggccagcatagctggttttcatttcgtttagcagggagaggtgttacaaaagcgatcatgaaaagatcgaaattgagaaaaaggaaaggaaaggtactcagtaggaa

SEQ ID NO: 1332 - DNA, 709 bp, Triticum aestivum
cacgaatccgcagccatggcttcccagctctccgccatgaccaccgtgccgcagttccacggcctcaggagctactcctcgcccaggtccatggccacgctgccgtccttgaggaggaagaggtctcagggcatccgctgcgactacatcggctcctccaccaacatcatcatggtgacgacgacgaccctgatgctgttcgccgggcggttcgggctggcgccgtcggcgaacaggaaggcgacggcggggctcaagctggaggcgcgcgagtccgggctgcagacgggcgacccggccggcttcacgctcgccgacacgctcgcatgcggctccttcggccacatcttgggcgtcggcatcgtgctcggcctcaagaacaccggcgtcctagaccagatcatcggctagaaccttccttttccgtcgatagctgttctgcatccacatcgcgcgctccatgtagtggatcaattaatgctccctttgtgatttgatgatgtggtgtagtacaatgtatgtgtatgcatctttgtttcagcgggacgtaccgccgcgccggtgtggcaactgcttcatcccatgcgtttttcatcatctatagtatctttcacatggtgaagatcgtcttgtgctatagaaagagcaacataaagtccaaaaactaaattagtactccctccgtgaagaaatataagatcgtttagat

SEQ ID NO: 1333 - DNA, 707 bp, Triticum aestivum
atccacagcacacaaatccgcagccatggcttcccagctctccgccatgaccaccgtgccgcagttccacggcctcaggagctactcctcgcccaggtccatggccacgctgccgtccttgaggaggaagaggtctcagggcatccgctgcgactacatcggctcctccaccaacatcatcatggtgacgacgacgaccctgatgctgttcgccgggcggttcgggctggcgccgtcggcgaacaggaaggcgacggcggggctcaagctggaggcgcgcgagtccgggctgcagacgggcgacccggccggcttcacgctcgccgacacgctcgcatgcggctccttcggccacatcttgggcgtcggcatcgtgctcggcctcaagaacaccggcgtcctcgaccagatcatcggctagaaccttccttttccgtcgatagctgttctgcatccgcatcgcgcgctccatgtagtggatcaattaatgctccctttgtgatttgatgatgtggtgtagtacaatgtatgtgtatgcatctttggttcagcgggacgtaccgccgcgccggtgtggcaactgcttcatcccatgcgtttttcatcatctatagtatctttcacacggtgaagatcgtcctgtgctatagaaagaacaacatagagtccaaaaactaaataagtactccctccgtgaagaaatataa

SEQ ID NO: 1334 - DNA, 605 bp, Triticum aestivum
aatcgcagcatccacagcacacaaatccgcagccatggcttcccagctctccgccatgacctccgtgccgcagttccacggcctcaggagctactcctcgcccaggtccatggcgacgctgccgtccttgaggaagaggtcccagggcatccgctgcgactacatcggctcctccaccaatatcatcatggtgaccacgacgaccctgatgctgttcgccgggcggttcgggctggcgccgtcggcgaacaggaaggcgacggcggggctcaagctggaggcgcgcgagtccgggctgcagacgggcgacccggccggcttcactctcgccgacacgctcgcatgcggctccttcggccacatcttgggcgtcggcatcgtgctcggcctcaagaacaccggcgtcctcgaccagatcatcggctagaaccttccttttccgtcgatagctgttctgcatccgcatcgcgcgctccatgtagtggatcaattaatgctccctttgtgatttgatgatgtggtgtagtacaatgtatgtatgtgtatgcatctttgtttcagcgggacgtaccgccgcgccggtgtggcaactgcttcatcccatg

SEQ ID NO: 1335 - DNA, 719 bp, Triticum aestivum
gcatccacagcacacaaatccgcagccatggcttcccagctctccgccatgacctccgtgccgcagttccacggcctcaggagctactcctcgcccaggtccatggcgacgctgccgtccttgaggaagaggtcccagggcatccgctgcgactacatcggctcctccaccaatatcatcatggtgaccacgacgaccctgatgctgttcgccgggcggttcgggctggcgccgtcggcgaacaggaaggcgacggcggggctcaagctggaggcgcgcgagtccgggctgcagacgggcgacccggccggcttcactctcgccgacacgctcgcatgcggctccttcggccacatcttgggcgtcggcatcgtgctcggcctcaagaacaccggcgtcctcgaccagatcatcggctagaaccttccttttccgtcgatagctgttctgcatccgcatcgcgcgctccatgtagtggatcaattaatgctccctttgtgatttgatgatgtggtgtagtacaatgtatgtatgtgtatgcatctttgtttcagcgggacgtaccgccgcgccggtgtggcaactgcttcatcccatgcgtttttcatcatctatagtatctttcacatggtgaagatcgacttgtgctatagaaagagcaacataaagtccaaaaactaaattagtactcccactgtgaagaaatataagatcgttta

SEQ ID NO: 1336 - DNA, 670 bp, Triticum aestivum
cacaaatccgcagccatggcttcccagctctccgccatgacctccgtgccgcagttccacggcctcaggagctactcctcgcccaggtccatggcgacgctgccgtccttgaggaagaggtcccagggcatccgctgcgactacatcggctcctccaccaatatcatcatggtgaccacgacgaccctgatgctgttcgccgggcggttcgggctggcgccgtcggcgaacaggaaggcgacggcggggctcaagctggaggcgcgcgagtccgggctgcagacgggcgacccggccggcttcactctcgccgacacgctcgcatgcggctccttcggccacatcttgggcgtcggcatcgtgctcggcctcaagaacaccggcgtcctcgaccagatcatcggctagaaccttccttttccgtcgatagctgttctgcatccgcatcgcgcgctccatgtagtggatcaattaatgctccctttgtgatttgatgatgtggtgtagtacaatgtatgtatgtgtatgcatctttgtttcagcgggacgtaccgccgcgccggtgtggcaactgcttcatcccatgcgtttttcatcatctatagtatctttcacatggtgaagatcgacttgtgctatagaaagagcaacatagagtccaaaaactaaa

SEQ ID NO: 1337 - DNA, 563 bp, Triticum aestivum
agcatccacaacacacgaatccgcagccatggcttcccagctctccgccatgaccaccgtgccgcagttccacggcctcaggagctactcctcgcccaggtccatggccacgctgccgtccttgaggaggaagaggtctcagggcatccgctgcgactacatcggctcctccaccaacatcatcatggtgacgacgacgaccctgatgctgttcgccgggcggttcgggctggcgccgtcggcgaacaggaaggcgacggcggggctcaagctggaggcgcgcgagtccgggctgcagacgggcgacccggccggcttcacgctcgccgacacgctcgcatgcggctccttcggccacatcttgggcgtcggcatcgtgctcggcctcaagaacaccggcgtcctcgaccagatcatcggctagaactccttttccgtccatagctgttctgcattcgcatcgcgcgctccatgtagtggatcaattaatgctcccttcgtgatttgatcatgtggtgtagtacaatgtatgtgtatgcatctttgtttcagcgggacgtacc

SEQ ID NO: 1338 - DNA, 600 bp, Triticum aestivum
catccacagcacacaaatccgcagccatggcctcccagctctccgccatgacctccgtgccgcagttccacggcctcaggagctactcctcgcccaggtccatagccacgctgccgtccttgaggaagaggtcccagggcatccgctgcgactacatcggctcctccaccaacatcatcatggtgacgacgacgaccctgatgctgttcgccgggcggttcgggctggcgccgtcggcgaacaggaaggctacggcggggctcaagttggaggcgcgcgagtccgggctgcagacgggcgacccggccggcttcacgctcgccgacacgctcgcatgcggctccttcggccacatcttgggcgtcggcatcgtgctcggcctcaagaacaccggcgtcctcgaccagatcatcggctagaaccttcctttccgtccatagctgttctgcattcgcatcgcgcgctccatgtagtggatcaattaatgctcccttcgtgatttgatcatgtggtgtagtacaatgtatgtgtatgcatctttgtttcagcgggacgtaccgccgcgccggtgtggcaactccttcatcccatgcgtttttc

SEQ ID NO: 1339 - DNA, 1127 bp, Triticum aestivum
ccccccgccccggggaaccacaaattggcggcggagcgcgttttccgcgctggggatgttttatataacgacagagagctcgtttttttgaaacgctcccaaattcccccgggggaccggccaacacccgcgctttttttttcccggggataagaaaaacgccgggggccggatccaccccttcccggatttttacgatcggggcgccgggggcgggttaaacatttttaccccccgggaccgccttttgccctttagggcctttttagggtgcacttatggaacaagtttgttaccaaaaaagccgggtggtaccccgtcccgaatttcccgggatatttttgacccacgcgtccccggttggaggcacggggacccttaacatgggctgaagggggtagaaaacctgagcaatcgcagcatccacagcacacaaatccgcagccatggcctcccagctctccgccatgacctccgtgccgcagttccacggcctcaggagctactcctcgcccaggtccatagccacgctgccgtccttgaggaagaggtcccagggcatccgctgcgactacatcggctcctccaccaacatcatcatggtgacgacgacgaccctgatgctgttcgccgggcggttcgggctggcgccgtcggcgaacaggaaggctacggcggggctcaagttggaggcgcgcgagtccgggctgcagacgggcgacccggccggcttcacgctcgccgacacgctcgcatgcggctccttcggccacatcttgggcgtcggcatcgtgctcggcctcaagaacaccggcgtcctcgaccagatcatcggctagaaccttccttttccgtccatagctgttctgcattcgcatcgcgcgctccatgtagtggatcaattaatgctcccttcgtgatttgatcatgtggtgtagtacaatgtatgtgtatgcatctttgtttcagcgggacgtaccgccgcgccggtgtggcaactccttcatcccatgcgtttttcatcatctatagtatctttcacatggtgaagatcgtcctgtgctatagaaagagcaacataaagtccaaaaactaaataagtactccctctgtgaaggaatataaat

SEQ ID NO: 1340 - DNA, 788 bp, Triticum aestivum
tcggggggacctgagcaatcgcagcatccacagcacacaaatccgcagccatggcctcccagctctccgccatgacctccgtgccgcagttccacggcctcaggagctactcctcgcccaggtccatagccacgctgccgtccttgaggaagaggtcccagggcatccgctgcgactacatcggctcctccaccaacatcatcatggtgacgacgacgaccctgatgctgttcgccgggcggttcgggctggcgccgtcggcgaacaggaaggctacggcggggctcaagttggaggcgcgcgagtccgggctgcagacgggcgacccggccggcttcacgctcgccgacacgctcgcatgcggctccttcggccacatcttgggcgtcggcatcgtgctcggcctcaagaacaccggcgtcctcgaccagatcatcggctagaaccttccttttccgtcgatagctgttctgcatccacatcgcgcgctccatgtagtggatcaattaatgctccctttgtgatttgatgatgtggtgtagtacaatgtatgtgtatgcatctttggttcagcgggacgtaccgccgcgccggtgtggcaactgcttcatcccatgcgtttttcatcatctatagtatctttcacatggtgaagatcgtcctgtgctatagaaagaacaacatagagtccaaaaactaaataagtactccctctgtgaaggaatataaaattgtttaaatcactacttagaccagttaatgatctaaacgatcttatattagtttac

SEQ ID NO: 1341 - DNA, 729 bp, Secale cereale
tcaggttcttagttcttatttccttacttagttcttacttactaaattccgtctagtcctattggtcttcccagctctccgcgatgacctccgtgccgcagttccacggcctcaggagctactcctcgcccaggtccatggcgacgctgccgtccttgaggaggaggaggtcacagggcatccgctgcgacttcatcggctcctccaccaacctcatcatggtgacgacgacgacgctgatgctgttcgccgggcggttcgggctggcgccgtcggcgaacaggaaggcgacggcggggctcaagctggaggcgcgcgagtccgggctgcagacgggcgacccggccggcttcacgctcgccgacacgctcgcatgcggcgccttcggccacatcatgggcgtcggcatcgtgctcggcctcaagaacaccggcgtcctcgaccagatcatcggctagaaccttccttttccgtccatagctgttctgcatccatcgggcgctccatgtagtggatcaacttctgctccctttgtaatttgatgatgtcaatgtatgtgtatgcatctttgtttcagcaggacgtaccgccgcgccggtgtggcaactgcttgatcccatgcgttttgcatcatctatactactccctccgttccataatgtaagatgttttttcacattaatgtagtgtcaagaaacgtcttacattatgagacgaagggagtagtat

SEQ ID NO: 1342 - DNA, 891 bp, Oryza sativa
gtccacaagctccccttgtggctcccattccacatctcctccaagaattaaagcccaatgcatctccatggtggcacttgacattatttttttcctcgaaactcagctgcaaggagaaggagaaggtaggctccagccatggcttcccagctctccgccgccacatccgtgccgcagttccatggcctccggacctactcctctcctaggtccatggtgacgctgccatcgttgaggatgagcaagaagaggtcccagggcatccggtgcgactacatcggctcagccaccaacgttatcatggtgacgacgacgacgctgatgctgttcgcggggaggttcgggctggcgccgtcggcgaacaggaagtcgacggcggggctgaagctggaggcgcgcgactccggcctgcagaccggcgaccccgccgggttcacgctcgccgacacgctggcctgcggcgccgtcggccacatcatgggcgtcggcgtcgtcctcggcctcaagaacatcggcgtcctggaccagatcatcggctaatcaaattcattaagctagtcacacgaatcaatactcctatgtgtaatcgatgcatgagtgcctgtgtgatggacgatgtaatgatcatgtaaattgtgcgtggaatcagtgcttatctagcttaattttgtttctgtcaaccaatggaatgtttcttgatgcagagctttgttgttggatcttcgaggaagaaaatgtttttgattgcttggttttaaagttctaaacacgaaaccttttcctcttaatgtttattttgtacatccctatgccattttttgtcacctgaaagttgtacatttttgcaactgcaaaattacatgagctttcacataggcttcaagaggcaag

SEQ ID NO: 1343 - DNA, 1306 bp, Brachypodium distachyon
gcaggggatccggaacctatccgcgagtggccgctgcgcgccacaagctggatcccgctgaaggtctcgtctccacaagatttaagaaaggagcttcttttgccattgcgcctgaacaacaaccacaaagcaattaagcaaaagcaatggcctcccagctctccgccatggcctccgtgccgcagttccacggcctccggagctactcggcgccgaggtcatccatggcgatgctgccaacgcttagagcgtccaggaagaggtcccagggcatccggtgcgacttcatcggctcctccaccaacctcatcatggtgacgacgacgacgctgatgctgttcgcggggcggttcgggctggcgccgtcggcgaaccggaaggcgacggcggggctgaagctggaggcgcgcgagtcagggctccagaccggcgaccccgccgggttcacgctcgccgacacgctcgcctgcggcaccgtcggacacatgctcggcgtcggcatcgtcctcggcctcaagaacaccggcgtcctcgaccagatcgtcggctagatcacccacctacatacagttatcaagcttccatcccacatatgatggaatgaatgagagggccctaagctgcctgatgtaatttggtgtgatgatgatgatgtgatgtacaatgaactaatgtgtggtgcatatcttgtcctcaatcgaaccggcctacagagcttcttgatttcaggttttttagatggccagtccatcactgtcaggacaaagaaaaaagtacatgcacaatggatttcactgtccgggcaatgaactaatatgtatgatgtataaaccaatgatgtacggacctgctcagtatagtgttgtgtaattagcttaggttcaacttaacgaaatatgtataaacatctaccttaattacctgcttctttcatctgaaacctaacgtggagaaaagaagtgaccctggcacttttatctgagatctaactttaatggaataaataaacattgtgcatttctaaacaagcaccgctcctaagacatacatatctttgcaaatttacagaagaaaaaaagtagcactgccagctccttacagagtgcaaaaaacaaaccaccatggcattgttgatcttcgcatcacatactctgttactcttgttagcaccaggccatcccctccctctcaccgacacttgcaggcgctcagtactgcacagcttaggaaactctcagctgaagcaaggtcagaaatgcagcacagatcatcatccgcatgctcctcagtatcagcgctgaagcag

SEQ ID NO: 1344 - DNA, 3253 bp, Sorghum bicolor
taacaaatcacgcctgaaacacccaccacacacaccactctgcacacacagaccgacgacgacgacggcacaggcgccatacgaaatggcctcccagctctccgccgccgtgccgcagttccacggcctccggggctacgcctcgcccaggtccgtggtggcgatgccgtccgtgcgggtcggcaggaagaggtcccagggcatccgctgcgactacatcggctccgccaccaacctgatcatggtgacgacgacgacgctgatgctgttcgcggggcggttcgggctggcgccgtcggcgaaccggaaggcgacggcggggctgaagctggaggcgcgcgactccgggctgcagacgggcgaccccgccgggttcaccctcgccgacacgctggcatgcggcgccgtcggccacatcctcggcgtcggcatcgtgctcgggctcaagaacaccggcgccctcgaccagatcatcggctagacgatccctacggttgttcttaagctctgatgaagctcacaatcctcgatcgcgccgccgccgccggtgcatatgcctatgtaacgtgcgtgcgtgtgtgtttgtgcgcgcatgccatgcgtacgtctcgttccaatggacatagctcttgttgctcctcttgctggcttgcatgagattccattccaggtcatagttcataactgaaaaaaaaaagaaaagaaaatctcacacaagtgccaactccctaagaggaagcagctaacggatggaaggcataccctaaatctattgggttgggctttgtgtgccatacagcccagtgaaatcacgtatatgggccaaacagcccagtaaaatcacgtctgtgggccgggccacggctctagagcaaaaattgttaaggaaagacactgccagcttccgttagagagatggctcaagacatctcattccacggtttgaacagaggaagtacattcccttactctcctttcttgggccttgtttagttcccaaaatattttacaaaaattttcacattccccatcacatcgaatcttacggcacatacatgaagcactaaatatagataaaagaaataactaattacacagtttatctgtaatttgctagacgaatcttttgagcctagttagtacatgattaaacaatattgtcaaatacaatggaagtggtactgtttatattttgcaaaattttttagaagtaaacaaggcccgttttgattttctaaatctattgttcatccattcataactgaggccttgttcagttggagattttttttggttttaggtactgtagcattttcgtttgtatttgacaaattttgtccaatcatggactaactagactcaaaagattcgtctcgcaaattacaggtaaactgtataagttgttttttactatatatttaatgctttatgcatgtgacgcaagattcaatgtgacgaaaaatttgaaaattttttagaaactaaacaaggcctgaactgacatgcatccatgattttttttttttttttgctcgcgcaggagaggcatcagaaggttataggactgcagtgtcgatcgttttgttgtgaaaccatgtctcctctgaagagacaccttttcatcatctaatcggtgatctcatctggtgataagattagcagttagcctagcagttagcatgccatccgaaggagcatgtcctttggccaatagcagttgctcttcctcaaacaccaaggagtcacgtccgtacgactaccaagagacgtccgtacgacgtgatctctcacttgtatataatctaacaagatcaatgaaagcagcagttgttcccaaaatctttgtttcatttacattacacttaacacgttatcagacacgttgctctcaggaactgaggaagaagaacaacgaacagaggcaattcatgcctctgtaccgaccaccggtaagccctatggcgcgaatcaatgtcgatttaccttcacatgttgctcgtggattgttcttcgctcttcgtcacgttggtggagtgcgtcgtggcccgatccgtcaccacggccaccatggacagcgccgcagtgttttcgagcgtcttgggcctcgtctccgccgcactgctgcccatggccatggccatggtccatacggccgcatcttcgactccgctgttcgtgacgtccgtgcagatgttcgccgtcgccgttggtccccgatccgtcgtggccgcctcgcttcgccgcaagatcgctctctgcagagccagccaccgtctcctcgccttggcgcggacggtgccggccccagcaacacggcgccgcccgctgtcgaagtcgcggcgccaccagtcgtcgaagccccgatgccgcttgctgaagccgggccctcggctccacctccggcgagcgcgggcctctcggctcctcctccgcccgcgacgcgcgcggaggccgctgcccgcatgaaggcgcaagccctcccgggtccttcggcagagacgctgccgactccgacgctccggcacttcctcggccacaagacggtggcagtagaccagcgccctggccttcgtcgcaccggcgcccggaacccggcagatcttggcctcccgagcgcggaggtgctcaacatggggacctacggcagcggcttctactcccctgatgagggggagtcttcttcgacttgaagatggcgagcacgggcagcgcagtggaggggagcagcgaggtgattttgcggcggcagagtatttcaggcgagcaacggcggcggcctcacaagcagtggtgtgcagtagggttgtagccaactgctgctcgtccactcctaaaaggcctgcgccctcacatgggccagcccaaggctgacgtcctgcagcaccctctcgtctcctactgtgtgcacccgatgagtcatactggcccaaaatgaacttggatcattttccatttcctatggccggctggcttgttaccttttatgttttatttattttcaacataaattcgcatgagactctgtttagtccctagtagttttatgttgtaaatttaaaagtacaatatgttgctgtacgattattttagtcattgtctttagcaacaaatatgtacttgtgatactttatattgttataaaatatctgtttgtgatattattcaaagtgtttgtcccggtatgaatgacaaatccaataaataatatccttgttattgtgaccatgatcttgcaattatttatttatttcgc

SEQ ID NO: 1345 - DNA, 610 bp, Saccharum officinarum
taacaaatcacgcctgaaacacctaccacacaccactctgcacagaccgacgacgacacagcaggcgccatacatggcctcccagctctccgccgccgccgtgccccagttccacggcctccggggctacgcctcgcccaggtccgcggtggcgatgccgtccgtgagggtgggcaggaagaggtcccagggcatccgctgcgactacatcggctccgccaccaacctgatcatggtgacgacgacgacgctgatgctgttcgcggggcggttcgggctggcgccgtcggcgaaccggaaggcgacggcggggctcaagctggaggcgcgcgactccgggctgcagacgggcgaccccgccgggttcacgctcgccgacacgctggcctgcggcgccgtcggccacatcctcggcgtcggcatcgtgctcgggctcaagaacaccggcgccctcgaccagatcatcggctagatccctacgttgttaagctgtgaggctcacgagcctcgatcgcgccgccggccgccggtgcctatgtaacgtgcgtgtgtgtaatacattgttttgtgcgcgcatgcgtacgtctcgttccaatggacatagctcttg

SEQ ID NO: 1346 - DNA, 681 bp, Triticum aestivum
tctccgccatgacctccgtgccgcagttccacggcctcaggagctactcctcgcccaggtccatggcgacgctgccgtccttgaggaagaggtcccagggcatccgctgcgactacatcggctcctccaccaatatcatcatggtgaccacgacgaccctgatgctgttcgccgggcggttcgggctggcgccgtcggcgaacaggagcgacggcgggctcaagctggaggcgcgcgagtccggctgcagacgggcgacccggccggcttcactctcgccgacacgctcgcatgcggctccttcggccacatcttgggcgtcggcatcgtgctcggcctcaagaacaccggcgtcctcgaccagatcatcggctagaaccttccttttccgtcgatagctgttctgcatccgcatcgcgcgctccatgtagtggatcaattaatgctccctttgtgatttgatgatgtggtgtagtacaatgtatgtatgtgtatgcatctttgtttcagcgggacgtaccgccgcgccggtgtggcaactgcttcatcccatgcgtttttcatcatctatagtatctttcacatggtgaagatcgtcctgtgctatagaaagaacaacatagagtccaaaaactaaataagtactccctctgtgaaggaatataaaattgtttaaatcac

SEQ ID NO: 1347 - DNA, 813 bp, Zea mays
cccatcccacgcctcgccgtgtccaggctttaagccacacgcacttgagctccaccgccactaccaccagtaccacaccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtcggcgaaccgcaaggcgacggcggggctgaagctggaggcgcgcgactccggcctgcagacgggtgaccccgccgggttcaccctcgccgacacgctggcctgcggcgccgtcggccacatcctcggcgtcggcatcgtgctcgggctcaagaacaccggcgccctcgaccagatcatcggctagatccctacgtcgccgttgttaagatcagactcagcagcctcgatcgcgccgccggccggcaggtgcaggtggtgactttgtaacgtgtgtgcgtgcgtacgtgtacattgcatccatcttgattccaatggacatatagctcctgttgctcctctagtcctcttgcgttgaccccgatcgatgagtatgacttctaccttccatgatagcaattagcaagcggttaaaacttataaaaaagagataaatccagatc

SEQ ID NO: 1348 - DNA, 574 bp, Eragrostis curvula
  misc_feature (478)..(478): n is a, c, g, or t
  misc_feature (494)..(494): n is a, c, g, or t
  misc_feature (502)..(502): n is a, c, g, or t
ggggaacgacgcaccacagacaagctgcaggttagttagacgacaggcgaccgccatggcttcccagctctccgccgccgcgaccgtgccgcagttccacggcctccgcggctacgcctcgccgaggtccgtcgtggccgtgccgtcgatgagggtgggcaggaagaggtcgcagggcatccggtgcgactacatcggctcagccaccaaccagatcatggttgtgacgacgacgctgatgctggtggctgggcggttcgggctggcgccgtcggcgaaccggaaggcgacggcggggctgaagctggaggcgcgcgactccggcctgcagaccggcgaccccgccgggttcacgctcgccgacacgctggcctgcggcgccgtcggccacatcctcggcgtcggcatcgtgctcggactcaagaacaccggcgcgctcgaccagatcatcggctaaatccggccgttagatgaactntgtttctctaatggangatggtgncaagttactttaacatgtacattgtgcgtgcatcatcttgttcgaatggactatagcttttgtttcctgttc

SEQ ID NO: 1349 - DNA, 556 bp, Triticum aestivum
cccgactgacctccgtgccgcagttccacggcctcaggagctactcctcgcccaggtccgactagccaccgctgccgtcccttcgtaggaaggaagggtcccacgggcgatccgctgcgactacatcggctcctccaccaacatcatcatggtgacgacgacgaccctgatgctgttcgccgggcggttcgggctggcgccgtcggcgaacaggaaggctacggcggggctcaagttggaggcgcgcgagtccgggctgcagacgggcgacccggccggcttcacgctcgccgacacgctcgcatgcggctccttcggccacatcttgggcgtcggcatcgtgctcggcctcaagaacaccggcgtcctcgaccagatcatcggctagaaccttccttttccgtccatagctgttctgcattcgcatcgcgcgctccatgtagtggatcaattaatgctcccttcgtgatttgatcatgtggtgtagtacaatgtatgtgtatgcatctttgtttcagcgggacgtaccgccgcgccggtgtggcaactccttcat

SEQ ID NO: 1350 - DNA, 909 bp, Panicum virgatum
acgattaacacctcaggtctcagcacctgcattgcgagagcagtatcttatctaatcccacgtggcagctccgctactctaaccagggcacggcacgtcagcgccgaggatccggaacctatccacgagtggccgctgcaggccacaagctgcccctgtggctcccatcacccatcacccgtgtccaagctttaagacacgcacactccacaaccgccgcgcctgaagtaccacacgggacagaccagagcagcacagacgtcgccatggcctcccagctctccgccgccgtgccgcagttccacggcctgcgtggctacgcctcgccccggtccgtggcggcgctgccgccggtgagggccggcaggaagcgggcgcagggcatccggtgcgactacatcggctcggccaccaaccagatcatggtgctgtcgacgacgctgatgctggtcgcggggcggttcgggctggcgccgtcggcgaaccggaaggcgacggcggggctgaagctggagtcccgcgactccggcctgcagaccggcgaccccgccgggttcacgctcgccgacacgctggcctgcggcgccgtcggccacatcatcggcgtcggcatcgtgctcgggctcagaacaccggcgcgctcgaccagatcatcggctaggtacattgtctgccttgtctctctcgccgccggccggtgcccatgtaaccatgcatctcgtttcgtttcaatggacatagcttgttgcttcttttgccccccagagttatcaggttcagtacgttctttacattctttcgatcggtgcgagtttacagatttttttttaacaaaacagttcgaagtttcttccgactgagctatccaaccaaagagaatgtagcactgtagaaaagatgctatccaaa

SEQ ID NO: 1351 - DNA, 617 bp, Cynodon dactylon
acggccataccacactccccggttcagcagacgagcaacgaagacgacaggcgccatggcttgccagctctccgccgccacttccatggccgccgtgccgcagttcaacggcctccgtggctacgcctcgcccaggtccgccgtggcgatgccgtccttgaggaagaggtcgcagggcatccggtgcgactacatcggctcagccaccaaccagatcatggtcctgagcacgacgctgatgctggtcgcgggtcggttcggtctggcgccgtcggcgaaccggaaggcgacggcggggctgaggctggaggcgcgcgactccggcctgcagaccggcgaccccgccgggttcacggcctccgacacgctggcctgcggcgccgtcggccacatcatcggcgtcggcatcgtgctcggcctcaagaacaccggcgtgctcgaccagatcatcggctagatccatccatccactagctgagctcacagtttctctcctgctggaacgatcgatcggtgccaaatatgtaacacatgtacattgctgcgcgtgcatcttgttcgaatggaccatagctttcctgttcatgttctctgtcggtcaacattgggtactatca

SEQ ID NO: 1352 - DNA, 574 bp, Panicum virgatum
cacgggacagaccagagcagcacagacgtcgccatggcctcccagctctccgccgccgcgtccatgtccgccgccgtgccgcagttccacggcctgcgtggctacgcctcgccccggtccgtggcggcgctgccgccggtgagggccggcaggaagcgggcgcagggcatccggtgcgactacatcggctcggccaccaaccagatcatggtgctgtcgacgacgctgatgctggtcgcggggcggttcgggctggcgccgtcggcgaaccggaaggcgacggcggggctgaagctggagtcccgcgactccggcctgcagaccggcgaccccgccgggttcacgctcgccgacacgctggcctgcggcgccgtcggccacatcatcggcgtcggcatcgtgctcgggctcaagaacaccggcgcgctcgaccagatcatcggctaggtccattgtctgccttgtctctctcgccgccggccggtgcccatgtaaccatgcatctcgtttcgtttcaatggacatagcttgttgcttcttttgccccccagagttatcaggttcagtacgttct

SEQ ID NO: 1353 - DNA, 623 bp, Panicum virgatum
aagctttaagacacgcacactccacaaccgccgcgcctgaagtaccacacgggacagaccagagcagcacagacgtcgccatggcctcccagctctccgccgccgcgtccatgtccgccgccgtgccgcagttccacggcctgcgtggctacgcctcgccccggtccgtggcggcgctgccgccggtgagggccggcaggaagcgggcgcagggcatccggtgcgactacatcggctcggccaccaaccagatcatggtgctgtcgacgacgctgatgctggtcgcggggcggttcgggctggcgccgtcggcgaaccggaaggcgacggcggggctgaagctggagtcccgcgactccggcctgcagaccggcgaccccgccgggttcacgctcgccgacacgctggcctgcggcgccgtcggccacatcatcggcgtcggcatcgtgctcgggctcaagaacaccggcgcgctcgaccagatcatcggctaggtcccgtgtctgtcttatctctctcgccgccggccggtgctcatgtaaccatgcatctcgtttcgtttcaatggacatagcttgttgcttcttttgccccccagagttatcaggttcagtacgttctct

SEQ ID NO: 1354 - DNA, 2459 bp, Secale cereale
gattctctctctctctcagggcacagccaaaacagcagtgacagcacagggcggctgcgaggccagttccaactttttctcgatttattgctagttttctcgcttcccctttggtgctggttcttgtttagttagttaaccgcccgtacccaccgccaatccccaggccgccgcctgctcttgccaaaccccaaccacccgcagcagtcagcaggactccctttctcctgctcatcttgccgcctctttggttttgggattgattgttaacggttcttgaaaatccttcctggaagcaggctcgttttagttttctcattcttctgttgctgtgttgccaagttcatggggttggataacgttgattgctcttgaagggaagaagctttccttcagaaagggataaagcagagtcctgagttgaccgagcttgtcatggagccgtcgactgggttccgggcctctgtctggagctgcttcaagttcttgcccttcttctgcggtcttcttctcctggggatcattaaaggtgttctttttggtccatgggcctggcttattatggcaatcggaatttctgcactcgttctgggattatggcctatgcatgtgatttggacatactactgcatcttcagaaccaagctggtgggacctgttgtaaagctgctgcttcttatttctgtatctgggattttgatcctgtggttgatagttggcatcgttggaagtgtatttgctgggttagcatacggctttctagcaccagtaatggccacatttgatgcactcggggaaggaaaagaaaggccactcgttcattgttttgtggatggaacatggagcactatcacaggaggctgtacagtagtcagggacctgaaagatatgctattccactcatatcttgcatatatggatgatctacggttccacgaacctcctggtggaaaaccatttgaaataagagtgcttgatattcctggcgcagtactcgctgccgcatgtggactcttaatggatgggataatgttcacagtaattgccttgtacaagttccctgtgatgcttttcaaaggatggaagcgacttattgaagatctagttggcagagaaggaccttttcttgagacagtgtgtgtgccattcgctggtctggctattcttctctggccatttgctgttttaggagccttcctagcctccatgatctccagtgttcctctaggcgcatatgctgccattgtggtttatcaggaatcctcgcttttcatgggactatcttatgcagtatcatcagtatccatcttcgatgagtatacaaatgatgtgcttgacatggcaccaggatcttgctttcctaggtttgcataccggaagaatcaagcttccgtggaaagtggcccgctctcaaggcctgcctcattcagggataagcaagatggaaagaaagctccagcgcgggttacatcatttaagagtagttttgatgagttcaatccatttaagttgctagatcacctattcgaagagtgtcagcaccgtggcgaggctctggttgctgaaggagtgataacacccaaagatattgaagaaacaaagtcaggcaaaggcggcagcggagtgcttaatgtcggtttgccagcatatgttattctcaatgcgctcctacgatctgcaaaggctgattccgatggcttgattctgagagatggctgtgaaataacatctgacaataggcctaagaatacactgtttgattggttctttgaccctctgatggtcatcaaagatcaaatcaaagccgagaattttacagaagaggaggaggcgtaccttcagaaacgcgtactgttgatcagcgacccgaagcgcctcaaggcgactcttccgcatttgccatccctgaatgagcgaaaacaagcagaaatagacgcatttgctcggaggttgcaagggatcacaaagtcgatatcaagatacccgacattcaagcgccgtttcgatgaccttgtcaaagcgctttccgaggagctcgagagggcaatgggcggcagccgatctgtcggtggatcacagtttcagaagctcagaagcggccttgttcgaatgcttagccagagatcgctggggaagacaacaagcatccgaggatatgatcaagaggcgcaactcacaagcaacactcgtgcggcgtaatatttcagaaaaacggtgaagagaggattgacgttgtccatatgtgtttcctgagttgttttctcactaactttgtacagagagctgaccctggcctggtgtatgggttgtatattgttgcaaacttgcaatgctccatgtttcagaaagcaaaaagttcgcctcggtcttttatcttcaaaatgtggattctattacctaccaacagactcattcgagtttgtgttattttggtgccttcacatgaatgttgcaataaa

SEQ ID NO: 1355 - DNA, 3640 bp, Brachypodium distachyon
ctgccttagcatcagattctctcatggctcagccaacacaacagtgccagcgcgcgcagggcgattgcgaggccagttccgctttgtccccatttattgctagttttcttgcttcccttttggtggtggttcttgtttagttaaccgcccataccaatcgccaatccccaagccgccaggctgctgccaaactccaaccaccaccgggcagtcagcagaccgcacttcctcctgcctctcttggcagttcttgcgtgggtgccgctttcagttctccatatctgcagcggttcgttgtgctttctggaaggaggttcacttttctaactgttttgttcccgtcttgccaagtttgggggttggataactttgattggtcttgaaggaaagaaaggaattgagcaagtctcgagttgaccgaggttgtcatggagccatccactgggctctgggtctctgtctggagctgtttcaagttcttgccgttcttctgtggccttcttctcctggggatcatcaaaggtgttttgtttggcccatgggcatggcttattatgacggttggaatttctgcaatcattctaggattatggcctatgcatgtggtttggacatactattgcatcatcagatccaagttggtggggcctgttgtaaaacttctgcttcttatttctgcatctgggattttagtgctatggctgatagttggcatcgttggaagcgtaattgctggtttagtttatggttttctagcaccagtaatggccacatttgatgctgctggggaaggaaaagaaaggccactagttcactgtcttgtggatgggacatggagcactatcacaggaagctgtaccgtagtcagggacctgaaagacatgctattccattcgtatttttcaattatggatgatttacgttttcatgcacctcctggtggaacgccatttgagataagagtgcttgacattcctggtgcagtatttgctgccgcatgtggactcttgacggatggaataatgttcacagtaatcgccttgtacaagttaccagtgatgctttttaaaggatggaagagactaattgaagatctagttggcagagaaggaccttttcttgaaacagcttgtgtgcctttcgctggtcttgctattcttctctggccatttgccgttttaggagcctttctagcttccatcatctccagtgttcctctaggtgtatatgctgccattgtggtttatcaggaatcttcacttctcatgggactattttatgtaatatcatcagtgtccatctttgacgaatatacaaatgatgtacttgacatggcacaaggatcttgctttcctaggtttgcatatcgaaaaaatgaagtttccacacagagtggtccgctatcaaggccagcctcgttcaaggacaggcaagatgagaagaaagctccagcacgcatgacatcatttaagagcagctttgatgaattcaatccattcaagatgctagatcacctattcgccgagtgtaagcaccatggtgagactctggtttctgaaggagtgataacatcgaaagatattgaagaaacaaagtcaggcaaagtcggcagcggagtaattaatgttggtttgccagcatatgttattctcaatgcactcctccgatctgtgaaggctaattccgatggccttcttctaagtgatggctgtgagataacatctgacaataggcctaagaatacagtatttgattggttctttgaccctctgatggtcattaaagatcaaatcaaagccgagaattttacagaagaggaggaagcatacttaaaaaaaagggtactgctgatcagcgacccgaaacgcctcaaggcgactcttccacatttggcatcactgaatgagcgacaacaagcagaaatagatgcatttgctcggagattacaagggatcacaaagtcaatatcaaggtacccgacatccaaacggcgtttcgacgaccttgtcaaagcactttcagaggaacttgagagagcaatgggtggcagccaatctgtcagtggatcacagtttcaaaggctaagaagtggtgtcgctcgaatgcttagccagagatcgatggggaaaacagcaatcatccgaggcgacgatcaagaggctcaacttacaagtaacggccgtgacacataatatttcagaaaagaactgaagagaaaacctccattgtccatatgtgtttcctgagcttctttcaaataatatttgaaaaagctcaggaaagtatgtccattctctgtatgtgtttcctgagtttttcacaaactttgtatagaagagcttacgctggtgtgcgagcaatagttcgaggcagtctttacaagaactgtatgttgcaaatttgcaaaactcctttcagaaagcaaagcccctctcttgtatcattgacaccccaaatgagatacaacattttggtgtgtgcccatctgcttattgcatatttgaacagcaggtgtaatttgacattgcgtaattctgctgcccttttacagagctgttgtgctaaaggatttgtgaagcttttttttttcctccagcatgatgccgagtagccaaaactgaaatgagtagtaagagaaatgacaaagacaagagaattttctaaaaacggtggtgtgaaccttcattattgacatcatgattatgatcaagagatatggcattgatgaagatgcagaaaggggaagaaacaccatgtgttacctggatagaccaaagcctggtgttatctggatagccatttcctctacggagtagattaaatttgcaaggaatgtcatcatgggaggatattacagtgagcaaaccaacctactaacaaagctgaaaaataactgtagagggaattacacgatttggttaatttcatttccatcttgagtgcagctggttgcatatttggaaatgaaggtacaagttttgtggttcacaatcgtggaaagaacaccaagagtccaatctagtaggatgggaaggtaacaaagctgaagcagcgaaacaaagctagaagaagtacttgtccattacacatgatgattgaacacaacaaatctcaacaataagcaagcttatgaaacatcattgtgctttcttcttagcatctttggcctgtcccttcttgcggattttgatgcacatgctcaatcgtgtgctgtctacaagtgactctggaagaagagagattaagaaccacataacggagtgtggccagtatggtgtgcacctcggctcataaccaatgtgacgaatagctgcacgagcataagtatcagctgatggcacaaggaaggaagatctcctgattgatgccatctttgttgccacatataaaggcacctgaatatatcagaggagtcaagttagagctcagtgacaggctggataggcgattcggataattagattttagcagaattccaaagctcctcgtttctcatacaaacaatctatctacatgtctttttaacaagtatggggcactttagaggaccgaattatcaaacgacccaataaacagagacaaaaagtaggtaatagcacaataaaacagagatacaatctttgctgaaagatgagaaaat

SEQ ID NO: 1356 - DNA, 1926 bp, Triticum aestivum
gtgaagcaagcggcggagcgtccccgcggcaagggatggcggcgtgggcggagcagctgcagcgcgagctcgccggccgcggcctcgccgtcgcctccgttccagggaagggccgcggcctcgtcgccgcccgcagcttcttcccaggggaggtcattatttgccaggaaccctatgcttctacgcccaacaggatttcggttggatcgagctgcgaccactgcttcgcctccggcaacctgaggaagtgctcggtttgtcgagtagcttggtactgtgggagcgtgtgccagaaagaagaatggaagctgcatcaacttgagtgtcaagccatctcagcgctgacagaggaaaggaagaagatgcttactcctacaatccgtttgatggtgaagcttatactaagaagaaaactgcaaagcgagaaggccattccatcttcagcaacagataactacgatctagtggatgcgttggagtcccacatctcgaaggttgatgataatcaattggtcctctatgctcagatggccaatcttgtgcagctgattctcccttcaattgaacttgatcttaaggaaattgcacatactttttctaagttcacctgcaatgctcataccatatgtgatcctgaactgaggccccttgggactggactgtttcctgctatatcaattattaaccacagttgtgtaccaaatgcagttttgctatttgagggtcggactgcatatgtacgcgcgttgcaacccttgagtagcaatactgaggtatcaataagttacatcgaaactgcagcaaccactttgaagagacacaatgatctcaagcagtacttcttcacctgcacatgtacccgatgtattaaggattctgaggaagatgctctcctggagggatacagatgcaaggaccaaaagtgtgatggctttctgctgcctgactcgggaaagaaggcttatacatgccagaaatgtagcatttctagagatgaagaagaggtaaagaaggtgtcaagtgaaatattactgttgtctgacaaagcttcttctcttctttcatctggaaataatagtgaagcaggttcagtgtacaagatcattgagcagttagaacagcagcattaccattctttctcgatcactttgcttcacacacgtgaaacactcctgaagatatatatggagttgcaagattggcagactgcattgatgtattgcagaatgactattccagtttatgaaagagtttacccaccttttcatccaatggtcggactgcaattctatacttgcggaaagctcgaatggttgcttgagtacacggaggacgctctgaaatcattaactagggcagcagatgtacttcggataacacacggcacacaatcccagttcatgaaagagctatttggtaagctggaggaagcgagggcagaagtttcatttaggctatcgtctggagacgagcaaatttcatgaaaagacgcaactcaccgtgatggcaaatagggatcgtcaaactcaggacagtggtatatggtactaaggatagctcattagcacccagcagacgatgcctgaagatgatgatacggaggatgctgtggtcatgatgagattgaaatctgaggttttgttgagggaggacacgctctacaaacagcatgcctttgtctgatgtaacatggataaggtgttgagtttaatgatgatgtagcattattagttccgtggtttcttctttgggcatttctcctatccaggagcttgactttttgtccataagaccataactaaatccgtcacatggagattgcctcatcaatcatcttgctaaaacaaggtagtatggggggaaagactcttggagttgcaatccaaatgcatttactgaacttcaacagcgaagaagaattatgac

SEQ ID NO: 1357 - DNA, 1916 bp, Triticum aestivum
agcaagcggcggagcgtccccgctgcggcaagggatggcgtcgtgggcggagcagctgcagcgcgagctcgccggccgcggcctcgccgtcgcctccgttccaggaaagggccgcggcctcctcgccgcccgcagcttcttcccaggggaggtcattatttgccaggaaccctatgcttctacgcccaacaggatttcggttggatcgagctgcgaccactgcttcgcctccggcaacctgaggaagtgctcggtttgtcgagtagcttggtactgcgggagcgtgtgccagaaagaagaatggaagcttcatcaacttgagtgtcaagccatctcagcgctcacagaggaaaggaagaagatgcttactcctacaatccgtttgatggtgcggcttatactaagaagaaaactgcaaagcgagaaggccattccatcttcagcaacagataactacgatctggtggatgcgctggagtcccacatctcgaaggttgatgataatcaattggtcctctatgctcagatggccaatcttgtgcagctgattctcccttcaattgaacttgatcttaaggaaatcgcacatactttttctaagttcgcctgcaatgctcataccatatgtgatcctgaactgaggccccttgggactggactgtttcctgctatatcaattattaaccacagttgtgtaccaaatgcagttttgctatttgagggtcggactgcatatgtacgcgcgttgcaacccttgagtagcaatactgaggtatcaataagttatatcgaaactgcagcaaccactttgaagagacacaatgatctcaagcagtacttcttcacctgcacatgtccccaatgtattaaggattctgaggaagatgctctcctggagggatacagatgcaaggaccaaaagtgtgatggctttctgctgcctgactcgggaaagaaggcttatacatgccagaaatgtagcatttctagagatgaagaagaggtaaagaaggtgtcaagtgaaatattactgctgtctgacaaagcttcttcgtttctttcatctggaaataatagtgaagcaggttcagtgtacaagatcattgagcagttagaacagaagcattaccattctttctcgatcactttgcttcacacacgtgaaacactcctgaagatatatatggagttgcaagattggcagactgcattaatgtattgcagaatgactattccagtttatgaaagagtttacccaccttttcatccaatggtcggactgcaattctatacttgcggaaagctcgaatggttgcttgagtacacggaggacgctctgaaatcattaactagggcagcagatgtacttcggataacacacggcacacaatcccagttcatgaaagagctatttggtaagctggaggaggcgagggctgaagtttcatttaggctatcgtctggagacgagcaaatttcatgagaagacgcaactcaccgtgatgacaaatagggattgtcgatcatgcctgaagataataaagaggatgctgtggtcacgatgagattgaaatctgaggtttcgtcgagggagggcgatggggacaagggtggttaaacggatcgcatagacacgctctacaaacagcatgcctttgtctgatgtaacgttgatgatgtgttgagtttaatgatgtagcattattagttccgtggtttcttctttgggcatttctcctatccagaagcttgactttttgtccataagaccataactaaatccgtcacatggagattgcctcatcaatcatcttgctaaaacaaggtggagtagtatggggggaaagactctaggagttgcaatcgaaatgcatttactgaacttcaacagcgaagaagaattatgaccaagcggc

SEQ ID NO: 1358 - DNA, 2180 bp, Triticum aestivum
aagtcggcctcactacttccagcgcggtggggcccaactgtttccgctctgattttccccgcggcaagggatggcggtgtgggcggagcagctgcagcgcgagctcgccggccgcggcctcgccgtcgcctccgttccaggccagggaagggccgcggcctcgtcgccgcccgcagcttcttcccaggggaggtcattatttgccaagaaccctatgcttctacgcccaacaggatttcggttggatcgagctgcgaccactgcttcgcctccggcaacctgcggaagtgctcggtttgtcgagtagcttggtactgcgggagcgtgtgccagaaagaagaatggaagctgcatcaactcgagtgtcaagccatctcagctctcacagaggaaaggaagaagatgcttactcctacaatccgtttgatggtgaagctcatactaagaagaaaactgcaaagcgagaaggccattccatcttcagcaacagataactacgatctagtggatgcgttggagtcccacatctcgaaggttgatgataatcaattggtcctctatgctcagatggctaatcttgtgcagctgattctcccttcaattgaacttgatcttaaggaaattgcacacactttttctaagtttgcctgcaatgctcataccatatgtgaccctgaactgaggccccttgggactggactgtttcctgctatatcaattattaaccacagttgtgtaccaaatgcagttttgttatttgagggtcggactgcatatgtacgcgcgttgcaacccttgagtagcaatactgaggtatcaataagttacatcgaaactgcagcaaccactttgaagagacacaatgatctcaagcagtacttcttcacctgcacatgtccccgatgtattaaggattctgaggaagatgctctcctggagggatacagatgcaaggaccaaaagtgtgatggctttctgctgcctgactcgggaaagaaggcttatacatgccagaaatgtagcatttctagagatgaagaagaggtaaagaaggtgtcgagtgaaatattactgttgtctgacaaagcttcttcgtttctttcatctggaaataatagtgaagcaggttcagtgtacaagaccattgagcagttagaacagaagcattaccattctttctcgaccactttgcttcacacacgtgaaacactcctgaagatatatatggagttgcaagattggcagactgcattgatgtattgcagattgactattccagtttatgaaagagtttacccaccttttcatccaatggttggactgcaattctatacttgtggaaagctcgaatggttgcttgagtacacggaggacgctctgaaatcgttaaccagggcagcagatgtacttcggataacacacggcacacaatcccagttcatgaaagagctatttggtaagctggaggaagcgagggctgaagtttcatttaggctatcgtctggagacgagcaaatttcatgaaaagacgcaactcaccgtgatgacaaatagggatcgtcgatctcaggacagcggtatagggtaccaaggatggctcattagcaccctgcagacgatgcctgaagataatacagaggatgctgtggtcacgatgagattgaagtctgaggttttgtcgagggagggcgatggggacaagggtggttaaacggatcgcataaacacgctctacaaacaacatgcctttgtcagatgtaacatggataaggtgtttgagtttaatgatgatgtagcattattagtcccatggtttcttctttgggcatttctcctatccagaagcttgactttttgtctgtaactgaatccgtcacatagagattgcctcatcaatcatcttgctaaaacaaggtagtatggggggaaagactcttggagttgcaatccaaatgcatttactgaacttcaacagcgaagaagaattgggaccaagtggcaaatgcacatacgtttcgtcgtccacacatctgagttttgtcagttcaaatgtgtgctatctgctataggggctaagctcaaacattaatatttacacgtcctgtatagcttcaggatgggaaaaatgagcattttcgatagttggcaccggatcttcgtagcgtagagactagcattta

SEQ ID NO: 1359 - DNA, 2122 bp, Brachypodium distachyon
ggaccagtcttgcaatttgatagcccaggcttgctacctcaacgttaactgtccagcgctgcgggtccaactgtgactcgtgctgtctctttctcgaagccccggcgaagcgtccccgcgcgaagggatggtgtccttgccggagcagctggagcgcgagctctccggacgcggcctcgccatcgcctccattcctggcaagggacgcggcctcgttactacccgcagattcttccccggggaagtcattctttgcggagaaccctatgcttctacacctaacaagattttggttgggtcgaactgtgaccattgcttcacctctagtaacctgaggaagtgctcagtttgtcgggtagcttggtactgtgggagcgtttgccagaaagaagaatggaaactgcatcaacttgagtgtcgagcgatctcagcacttacagatgataggaaaaagatgcttactcctacaattcgtttaatggtgcgacttatactgagaagaaaactgcaaaacgaaaaggtaattccatctacaggaacagataactacggtctagtggatgcattggaatcccacatatctgaggttgatgataaacaactggtcctctatgctcagatggccaatcttgtgcagctgattcttcctgcaatcgaacttgatcttaaggaaactgcacatattttttctaagttttcctgcaatgctcatacgatatgtgatcctgaactgaggcctgttgggactggattgttccctgctatatcaactattaaccacagttgtgtaccaaatgcagttttgctatttgagggtcggactgcttatgtccgcgcattgcagcccttaagcaacaatactgaggtatcaataagttacattgaaactgcagcaaccactttgaagagacataatgatctcaagcactacttctttacctgcacatgtccccgctgtattaagggttctgaggaagatcctctccttgagggatacagatgcaaggaccaaaattgtgatggctttctgctgccagactcaggaaagaaggcttatacatgccagaaatgtagcatgtgtagagatggagaagaagtaaagaagctttcaagtgaaatactactattatctgataaagcttcttcatttgtttcgtctggaaataataatgaagcaggctcagtgtacaagatcatcgagcagttagaacgaaagctttatcattctttctcaatcactttgctgcacacacgcgaaacacttctgaagttatatatggaattacaagattggcgcagtgcattgatgtattgcagatcgacaattccagtgtatgaaagagtttacccaccttttcatccaatggttggattacaattctatacttgtggaaagcttgaatggttgcttgagtacacagaggacgctctaaaatctttaactagggcagcagatgtacttcggataacacatggcacaaactcccaattcatgaaggagctattcggcaagctggaggaagcgagagctgaagtttcatttagactatcacctggaaacgagcaaatttcatgagaagatgcaattgaccacgatggcaatgttgatacttgatacaatgttcacatatctaaggatagcacattagtaccatctagacgatgcctaaagataacatatatggtagcgacattgagatctaacatttcctcaaggggatggagacaaaggtgattgaattgatcatccagtgaccattttcactacaatcggtgtgcctttatctgctgttacatggataagatgttgatgtaccgaacttgctctggtttcttctttgggtgatctccctccacacacaaacgcttgactttttgtctgtaactgaaaatgtcacacagtaagacctaagaaacgtgggctcctggcatttactattggcaggctagaagttaccagagaagatgtacactgtttatttcttcttattaatagttgtagaatgtgtacacccttttcttctttctttcttcaaaaaacatatgtaacagtctctggaggctggacgcgcaattttgtggataattcaacatattcatattggatttcttcgtgcatttt

SEQ ID NO: 1360 - DNA, 3296 bp, Oryza sativa
gtaggcgccacgtcagccaaaaccgctcttaaaaccaccgagggatctcatctgcaccggttttgatagttgagggacccgttgtgtctggtttttcggttgagggacctcaaatgaacttattccttttttttttttcgaaccttctcgagaggagaggcgtcggggcggggggaatggcgtcgtgggaggagcagctgcgggacgagctcgccggccgagacctcgccgtcgcctccgtccccgggaagggccgcggcctcttcgccgcacgcagcttcttcccaggagaagtcgttatttcgcaagagccttacgcttctacaccaaacaagatttctgtgggctccaactgcgacaattgtttcgcctccagaaacctgaggaagtgctccgtttgtcgagttgcttggtactgtgggagtgcgtgtcagagagaagaatggaagcttcatcaacttgaatgtcgagcaatcgccgcgcttacagaggatagaaagaagatgcttactcccacaattcgtttgatggtgcggcttgtacttagaagaaaactgcaggatgacaaggctattccatcttcaggaacagataactacaatctagtggatgcattagaatcccacatctccgaggttgataaaaatcaactggttttatatgctcagatggccaatcttgtccaactgattcttccttcattcgagcttgatcttaaggaaattacacataccttttccaagtttgcctgcaacgctcataccatatgtgatcctgaactgaggccccttgggactggactataccctgttttatctattattaaccacagttgtgtaccaaatgcagttttgatatttgaaggtcggacagcatatgttcgtgcattgcaacctataagtaaaaatgaggaggtatcaataagttacattgaaactgcggcaaccactatgaagagacaggacgatctcaagcactactacttcacttgcacatgtccccgttgtgttaaggattctgaggaagatgcgctccttgagggatacagatgcaatgaccaaaagtgtgatggatttcttctgcctaatgcaggaaacaaaggttatacatgccagaaatgtagcacttctagagatggggaagagttacaaaagatggctagcgatgtactactattatctgacaaagtctcttccttagtttcatctggaaataacagtgaggtaggttctatgtacaagaccattgaagagctagagcggaagctttaccatcctttgtcaatcactttgcttcacacacgggaaacactcttgaagatatatatggagttacaagattggcagactgcattgatgtattgcagattgacaattccagtttatgaaagaatttacccaccttttcacccaatgattggattacagttctatacttgcggaaagcttgaatggttgcttgagtacacagaggatgctctgatgtctttaaccagggcagcagatatacttcgcataacgcatgggactaaatccgagttcatgaaggaacttttgggcaagctagaagaagtaagggctgaagcttcttttaggctctcggctggagatgaacaataattgagtaaccattttattgtgaagctccaggtcatcgtgatggcaaatagaatgtaacaatgttgcaacaatgttcaaataggatagtactaagtagacaatctctaaatttagaatagctttgttaattcaacattgggatataagctgccctgaagggctcgcatcgggacaagaactgtgaactggtgatatggaaaattcattgttcacctataaagtgtgggttttaactttacatttgctgccgttttgatgttggcttagtggatagtttattattattcacttcacaaaatgcgatggtggcaccagcaaaatatgttagtgttagtggacagcaaattatagggtgcaacaagctcaaatatgtatacacaatcagtagtcactgggtcaaggtagaagtgctgctgctgtcccctcggaaaaaaagttccgctcttcaaaaattatgacatactcctacattctgaagacaagatagaagcccaaagacgtcattactttgatgcagagaatggagaaatctggaactctactagtagattggactagtctgacacaaacaaaactatatcgaacctttttcatgtcagttggggacatgagaaaaaggttagtataattactatgttatggttatctggttctgctatgcctagttatgcagatattcattatagaatttggatgaatgaactgaccatcccattgctctatacatatcgagttgattcagtttttgatgtattgtatcctataagaactatgctcaaatattcatatttacatgtcttagaatacatcaggactgaaaaagaatacttgggacagctgggacctaattgccatagtagctgtagtgcacatcagcatttagaaattattacaatggaactctgtatgttgggtcaaccattttcagtatgaacaaattccccttatcgcctcttgaggccctgaaaccagcaatttgttgcaatattagtgaacttaatcattgattactgcattagcgactagtaaccatgtctatcaactggacatcatcatgaggggaaaaaattacagctgcgaggagaacaaaagaaccgaaaacaaaatggttaagccgacatggaaactaaagtgtagtggcgataacaggaaataaaaataaaaaccacaaaacataacagaaaaatgttgctaaagaacctagattagccgatgacaaggtcagcaccacccttctcatcagggtcctatctcttcctttacaggatagaaccccggctgcattttcttggtatggtcatatttcttgtttttggcaaaccattctatcttgaaactcaaaagctacaaatcacatatattctttttttagacaaaaattacatatattctgatgcctatatcaagtgtatggctattggcatttttgtcatacttaatttgcagggtaaaggatttctggttttgggaaattagtttgacaagaaacgatctaaaattaaatgtagaaacaagagaaaactaaccgattttagtgggtaggtacatgatcaaactccactacttaaaaagctattcatagggtgaaagaagctgacctgagctcttcatcaagatatgtaatttctagttcacctttaccactgccaggtgctttgattgaaatctaatcataac

SEQ ID NO: 1361 - DNA, 2246 bp, Panicum virgatum
cctgggctaatgcggcttgagctagagcctagaagctaacatgctttatgggctgggcctggaaaggttggtgtactcggttgggattgccggcccatgataacgtcgaacaccactcgcctgtttctttgcgaaacttctggttctgggcgcgggtggatggcgaattgggcggagcagctgcagcgcgagctcgccggccgcggcctcgccgtcgcctccattcccggaaagggacggggcctcgttgcctcccgcaccttcttcccaggggaagtcattatcagccaagaaccttacgcttctacatccaacaagattttagtcggatcaagctgcgaccattgtttcgcgtctgacaacctgaggaagtgctcggtttgccgagttacttggtactgcagcagcgattgccagaaagtagaatggaaactacatcagctcgagtgtagagcgatggcagcgcttacggaggacagaaaaaagatgcttactcccacaattcgtttgatggtgaggctggtactgaaaagaaaattgcaaaatgagaaggtcattccatcttcatgcattgataactactatctagtggatgccttggagtcccatatatcggaggttgatgaaaatcaacttgtactctatgctcagatggccaatcttgtggacctcattcttccttcggttgaacttgatcttaaggaaattgcacatactttttctaagtttgcctgcaatgctcatacaatatgtgattctgagcttagacctcttgggactggattgtaccctgttatatctataattaaccacagttgtgtaccaaatgcagttctgacatttgatggtcggacagcttatgttcgcgctttgcaacctatagggaaagatgaagaggtgtcgataagctacatcgagactgcagcagtaactaagaagagacagaatgatctgaagcagtacttcttcacctgcacatgcccacgctgtgtcaagggttctgaagacgatgctctacttgagagttatagatgcaagaaccaagcatgtgatgggtttctgctgcctgagtcaggagaaaaggcttacacatgccagaaatgtagcatttctagagatgaggaagaggtcaaaaagatgacaagagaaattgtactgctatcagataaagcatcttcacttcttaagtcaggaaataccactgaagcaggttctatctacaagacaattgagcagttagagcagaagctctaccatgctttctcaatcactttgctgcacacacgtgaaacactgctgaagatatacatggagttacaagattggcagactgcattgacgtattgcaaatcaacaattcctgtttatgaaagagtttatccaccatttcatccaatgatcggattacaattctatacttgcggaaagcttgaatggctgctcgagtgcacagaggacgctctgaaatctctaaccaaggccgcagatatacttagaataacacatggcacaaaatcacagttcatgaaggagctctttggcaagatagaggaagcaagggctgaagtttcttttaggctatcctccggtcctgggcatgatgagcaattttcatgagggactgcaggccaactatgacggaaaatagatataatatcaaaaaatatgctgctgtcgttgagacaatgttcaaaaaatacaaggactgagaatgtctaggcatgcaaatagcattgttgggatagcgaccagctcgttccaagcttcattcagttggaaatggggaaatagcatctgttgtaaaattgatcagattttcgattttattgtcagcatgtggcgagttgaactccatggtctcttcatgttccaagttggacaatatattttcacatgccgcaggaaggagcacagagcacctgtatctgtgagctttatgcgtgagagtttgcctcattttatgatagcccaaatgcagctgctgatattctcagccgatggataaagttggactaaatagacttttccaagcatcgatatattttagttttcatgaggcatgttccaatgggattcccacattacaagtagaatctttaatatttacaggcattacgttaccgcagggaatgttacacataaagctgacacctaaatctatactgacatattttactttttcctattttttaaggactgcattgcaaaaagtattatcgtttaacattattacaatggaactctgt

SEQ ID NO: 1362 - DNA, 1701 bp, Setaria italica
ttctctcggcgcggaagggagaaggatggcgtcgtgggcggagcagctgcagcgcgagctcgccggccgcggtctcgccgtcgcctccattcccggaaagggccggggactcgtcgcctctcgcaccttcttcccaggtgaagtcattatcagccaagaaccttacacttccacgcctaacaagattttagtcagatcaagctgtgaccattgtttcgcctctagcaacctgaggaagtgctcggcttgtcgagtaacttggtactgcagcagcgattgccagaaagaagaatggaaactgcatcagctcgagtgtagagtgatggcagctcttacggaggatagaaagaagatgcttactcctacaattcgtttgatggtgcggctggtactgaaaagaaaattgcaaaatgagaaggccattccatcttcaaacatagataactactatctagtggaggcattggagtctcatatatcgaaggttgatgaaaatcaacttgtactctatgctcagatggccaatcttgtgagcctgattcttccttcgcatgagcttgatcttaaggaaattgcacatactttttcgaagtttgcctgcaatgctcatacaatatgtgatcctgaacttagacctcttgggactggattgtaccctgttatatctataattaaccacagttgtgtaccaaatgcagttctgatatttgatggtcggacagcttatgttcgcgctctgcaacctataggcaaagatgaagaggtgtcgataagctacattgaaactgcagcagtcactaagaagagacagaatgatctgaagcagtacttcttcacctgcacatgccctcgctgtctcaaggattctgaggaggatgctatacttgagagttatagatgcaagaaccaagcatgtgatggctttctactgcctgagtcaggaggaaaaagttacacatgccagaaatgtagcatttccagagatgaggaagagataaaaaagatgacaagagaaatactactgttatcagataaagcgtcttcatttgtttcatcaggaaataccactgaagcaggttctatctacgagaaaattgagcagctagagcagaacctctaccatgctttctcaatcactttgctgcacacacgtgaaacattgctgaaggtacatatggagttacaagattggcagactgcattgacgtattgcagattgacaattcctgtttatgaaagagtttatccaccatctcatccaatgatcggattacagttctatacttgtggaaagcttgaatggctgctcgagtgcacagaggatgctctgaaatctttaaccagggcagcagatatacttggaataacacacggtacaaaatcccagttcatgaaggagctctttggcaagctagaggaagcaagggctgaagtttcttttaagctatcctccagtcgtgggcatgatgagcaattttcatgagggactgcagggcaactatgatggaaaatagaggataaaaaacaccctgctatcttggagacaatgttaaaaaataggaaaacattgtggagacaatgtctaggcatataaatagcactgttgggataacaacctggtcttcccaagcttcattgtggtggaaatggggatatagcatctggtgtaaaatggatcatattttttatttaattgtcaac

SEQ ID NO: 1363 - DNA, 2084 bp, Panicum virgatum
ttgttcagaattaggactggcctaatgcggcttgagctagaagccaacatgctttatgggctgggcctggaaaggtgggtgtgtactactactcggttgggattgacggcccatgataacgtcgaacaccgcctgtttctttgcgaaacttctggttctcggcgcggaagaagaacgactgtgggaggatggcgaattgggcggagcagctgcagcgcgagctcgccggccgcggcctcgccatcgcctccattcccggaaagggccggggcctcgttgcctcccgcaccttcttcccaggggaagttattatcagccaagaaccttacacttctacatccaacaagattttagtcggatcaagctgtgaccattgtttcgcgtctagcaatctgaggaagtgctcggtttgccgagttacttggtactgcagcagcgattgccagaaagcagaatggaaactacatcagctcgagtgtagagcgatggcagcgcttacggaggacagaaaaaagatgcttactcccacaattcgtttgatggtgaggctggtactaaaaaggaaattgcaatatgagaaggtcattccatcttcatgcatagataactactatctagtggatgccttggagtcccatatatccgaggttgatgaaaatcaacttgtactctatgctcagatggccaatcttgtggacctcattcttccttcggttgaacttgatctcaaggaaattgcacatactttttctaagtttgcctgcaatgctcatacaatatgtgattctgagcttagacctcttgggactggattgtaccctgttatatctataattaaccacagttgtgtaccaaatgcagttctgacatttgatggtcggacagcttatgttcgcgctttgcaacctatagggaaagatgaagaggtttcgataagctacatcgagactgcagcagtaactaagaagagacagaatgatctgaagcagtacttcttcacctgtacatgcccacgatgtgtcaagggttctgaggaagatgctctacttgagagttatagatgcaagaaccaagcatgtgatgggtttctgctgcctgaatcaggagaaaaggcttacacatgccagaaatgtagcatttctagagatgaggaagaggtcaaaaagatgacaagagaaattgtactgctatcagataaagcatcttcacttctttcatcaggaaataccactgaagcaggttctatctacaagacaattgagcagctagagcagaagctgtaccatgctttctcaatcactttactgcacacacgtggaacactgctgaagatatacatggagttacaagattggcagactgcattgacgtattgcagatcaacaattcctgtttatgaaagagtttatccaccatttcatccaatgatcggattacaattctacacttgcggaaagcttgaatggctgctcgagtacacagaggacgctctgaaatctctaactagggcagcagatatacttagaataacacatggcacaaaatcacagtttatgaagcagctctttggcaagctagaggaagcaagggctgaagtttcttttaggctatccaccggttgtgggcatgatgagcaattttcatcagggactgcaggccaactatgatggaaaatagatgtaatatcaaaaaaatatgctgctgtcgttgagacaatgttcaaaaaaatacagaaagactgaaaaatgtctaggcatacaaatagcattgttgggatagcgaccagctcgttccaagcttcattcagttggaaatggggaaatagcatatgttgtaaaattgatcagattttcgattttactgtcagcatgtggcgagttgaactccatgtatcatcatgttccaagtcggacaatatattttcaatgtctcaggaaggagcacgaagcacctgtatctgtgtgctttatgcgtgagatttcgcctcattttttgatagtccaaatgcagctgctgatattttcagctgatggaataaaagttggactaaatagacttctccaagcatcgatatattttagttt

SEQ ID NO: 1364 - DNA, 1805 bp, Sorghum bicolor
attatagttgagtatgtttttgggagggccggcccatcttaacatccaagtgtgaacaacactcgcctgtttgtttgcgaaacggacgcccgcggaaggaaagaatggcgtcgtggttggagcagctgcagcgcgagcttgccggacgcggcctcgcagtcgcctccatccccggcaagggaaggggcctcatcgctacccgcaccttcttcccaggggatgtcattctcaatcaggaaccttacgcttctacgcctaacaagattttagttggatcgagctgtgatcattgtttcacctctggcaacctgaggaagtgctctatgtgtcaagttacttggtactgcagcaccaattgtcagaaagaagaatggaaactacatcagctcgagtgtagagcaatggcagcgcttacagaggatagaaagaagatgcttactcctacaattcggttaatggtgcggctggtactaaaaagaaaactacaaaatgagaaggtcattccatcctcaagtatagataactacaatctggttgatgccttggagtctcatatatggaaggttgatgaaaatcatcttgtgctctatgctcagatggccaatcttgtgagccttattcttcctttgattgagcttgaccttaaggaaattgcacacactttttctaagtttgcctgcaatgcgcataccatatgtgaccctgaacttaggcctcttgggactggactgtaccctgtcatatccattattaaccacagttgtgtaccaaatgcagtattgatatttgatggtcgtacagcatatgttcgtgcattgcagccaataggcaaaaatgaagaggtatctataagctacattgagactgcagcagtcaccaagaagagacacaatgatctgaagcagtacttcttcacctgctcatgtccacgttgtgtcaagggttctgaggaggatgctctacttgaggggttcaggtgcaagaaccaaacatgtgatggttttctcctgccagactcaggtaaaaaggcttatacatgccaaaaatgtagtgtttctagagacgaggaagagatacaaaagatgagaagcgaaatactacagttatcggataaagcatcttcatttctttcatcaggaaataaggctgaagcaggttctgtctacaagacaatcgaacaattagagcagaatctgtaccatgctttctcaaccactttgctgcacacgtgtgaaacactcctgaagatatatatggaattacaagattggcggactgcattggcatactgcagattgacagttcctgtttatgaaagagtttatccaccttttcatccgatgattggattgcaattctatacttgtggaaagcttgaatggttgcttgagtgcacagaggatgcactaaaatctttaaccagggcaacagatatacttaaagtaacacatggcacaaaatcccagttcatgaaggagctctttggcaagctagaggaagcaagagctgaagtttcttttaggatatcctccagacatggacatgatgagtaatttttataactgcaggccaaccatgatggaaaagaatatattgaaaatatccttctagtgttgagatcatattttaagggacgataagcattgtagagattttgtaggcaaataaatagcactgttctgaaatgtgccttaatttgttgtataacgaataggattattattattttattatttttgtgtgtgtgtgtgtgtgtgaaacataacgaataggatttttgaatttaattgtacaccatgtttttt

SEQ ID NO: 1365 - DNA, 1738 bp, Zea mays
cctgcttatatttgagaaaggaaacttctggttttctctgcgcgggaggaagaatggcgtcgtggttggagcagctgcagcgcgagctcgccgcccgcggcctcacagtcgcctccatccccggcaagggaaggggtctcatcgctacttgcaccttcttcccaggggatgtcattctcaatcaggaaccttacgcttctacacctaacaagattttagttggatcgagctgtgaccattgtttcacctctggcaacctgaggaagtgctctatgtgtcgagttacttggtactgcagcagcaactgtcagaaagaagaatggaaactacatcagctggagtgtagagcaatggcagcacttacagaggatagaaagaagatgcttactcctacaattcggttgatggttcggctggcactcaaaaggaaattacaaaatgagaaggtcattccatcctcaagtatagataactacaatctggttgatggcttggagtctcatatatcgaaggttgatgaaaatcaacttgtgctctatgctcagatggccaatcttgtgagcctgattcttccttttattgagcttgaccttaaggaaattgcacaaactttttctaagtttgcctgcaatgcgcataccatatgtgaccctgaacttaggcctcttgggactggactgtaccctgtcatatccattattaaccacagttgtgtaccaaatgcagttttgatatttgatggtaggacagcatatgttcgtgcattgcaaccgataaataaagatgaagaggtatctataagctacattgagactgcgacagtcaccaagaagagaaacaatgatctgaaacagtacttcttcacctgcacatgtccacgctgtgtaaagggttttgatgaggatgcactacttgaggggttcaggtgcaagaaccaagcatgtgatggctttttgctgcccaactcaggtaaaaaggcttatacatgccaaaaatgtggtgcttctagagatgtggaagagataaaaaatatgagaagcgaaatactacagttatcggataaagcatcttcatttctttcatcaggaaataaggctgaagcaggttctatctacaagataatcgaacagttagagagaaatctgtaccatgctttctcaactactttgctgcacacgtgcgaaacactattgaagatatatctggaattacaagattggtggactgcgttgacatactgtagattgacaattcctgtttatgaaagagtttatccaccttttcatccgatgattggattacaattctatacttgtggaaagcttgaatggttgcttgagttcacagaggatgcactaaaatctttaaccagagcagcagatatacttaaagtaacacatggcgtaaaatcccagttcatgaaagagctctttggcaagttagaggaagcaagagctgaagtttcgtttagactatcctcgagacatggacatgatgagtaattttcataactgcaggccagttatgatggaaaataatatattgaaattatgtttctactgttgagatcatatttcaaggtacaataaaaaatgtggagactttgtaggcaaagaattagcactgttgtaaaacgattatgtgccgacacaaaataggccctaatttgttgtataaaaaatacaattttgaatttaattgtatatcatgtggtaggttgaactccataaactctctt

SEQ ID NO: 1366 - DNA, 1476 bp, Pennisetum glaucum
cgagctcggcgcggaaggagaaggatggcgtcgtggttggagcagctgcagcgcgagctcgccggccgcggtctcgccgtcgcctccattcccggaaagggacggggactcgtcgcctctcgcaccttcttcccaggggaagtcattgtcagccaagaaccttacgcgtccacgcctaacaagattttagttggatcaagctgtgaccattgtttcacctctagcaacctgaggaagtgctcggtttgtcgagtaacttggtactgcagcagcgactgccagaaagaagaatggaaactgcatcagctcgagtgtagagtgatggcagcacttacggaggatagaaagaagatgctcacccctacaattcgtttgatggtgcggctggtactgaaaagaaaattgcaaaatgagaaggccattccatcttcaaacatagataactacaatcttgtggatgccttggagtcacatatatcgaaggttgatgaaaatcaactggtactctatgctcagatggccaatcttgcgagcctgattcttccttcgcttgagcttgatcttaatgaaattgcgcatactttttctaagtttgcctgcaatgctcatacaatatgtgatcctgaacttagacctcttgggacaggactgtaccctgttatatcgataattaaccacagctgtgtaccaaatgcagttctgatatttgatggtcggacagcttatgttcgcgctctgcaacctataggcaaagatgaagaggtgtcgataagctacattgaaactgcagcagtcactaagaagagacagaatgatctgaagcagtacttcttcacctgcacatgccctcgctgtctcaaggattctgaggatgctctacttgagagttatagatgcaagaaccaagcttgtgatggctttctactgcctgagtcaggagaaaaaggttacacatgccagaaatgtggcatttctagagatgaagaagaggtaaaaaagatgacaagagaaatactactgttatcagataaagcgtcttcatttgtttcatcaggaaataccactgtagcaggttctatctacaagaaaattgagcagctagagcagaacctctaccatgctttctcaatcactttgctgcacacacgtgaaacattgctgaaggtatatatggagttacaagattggctgactgcattgacatattgcagattgacaatccctgtttatgaaagagtgtatccaccatttcatccaatgatcggattacaattttatacttgtggaaagcttgaatggttgctcgagtgcacagaggatgctctgaaatctttaaccagggcagcagatatacttggaataacacacggtacaaaatcccagttcatgaaggagctctttggcaaggctagaggaagcaagggctgaagttcttttaagctatccaccagtcgtggcgtgacgagcaattttcta

SEQ ID NO: 1367 - DNA, 1601 bp, Secale cereale
agcgaatggcgcgttgtggtgtgccgttctcgtgctgatctccctggcctcgtgtcgcgtgcggcgtcggcgggccgcgggcggtgggggagtcaccaccaccgcggggtgggcagggcgtcggcgcggctccggcgtcgtgcccgccgcgccgggcgcgtcgctggccgagcgcgcgcgggacgaccggcaccgccacgcctacatctcccggaggctggcgtcggcgtcgcctagccggcgccgcgcggccgagacgtcgaccgccccgggcccggaggcgtcggcgttcgcgatgccgctgacgtcgggcgcgtactccggcacggggcagtacttcgtgcggttccgcgtgggcacccccgcgcagcccttcgtgctcgtcgccgacaccggcagcgacctcacctgggtgaagtgccgcggcgcgtcgccgtcgccgtcggccacgccggccgcgtcgccgcgcgtgttccggccggccgactccaagtcgtgggcgcccatcccgtgctcctccgacacgtgcaagtcctacgtccccttctccctcgccaactgctccgccggcgccaccccgcccgcgccctgcgcctacgactacaggtacaaagacaactcgtcggcccgcggcgtggtgggcacggacgcggcgaccatcgccctctctggctccagcggtggcagcggcggcggcgcggacaggaaggccaagctgcaggaggtggtgctcggctgcaccacctcctacgacggccagagcttccaggcctccgacggcgtgctcagcctcggcaacagcaacatctccttcgcctcccgtgccgccgcgcgcttcggcggccgcttctcctactgcctcgtcgaccacctcgctccgcgcaacgccaccagctacctcaccttcggcccggacaacagcgccgcttcatcgtctaggacgccgttgctgctcgacgcccaggtcgccccgttctacgcggtgacggtcgacgccgtctccgtcgccggggaggcgctcgacatccccgctgaggtgtgggacgtcaagaagaacggcggcgcgatcctcgactccggcaccagcctcaccatcctcgccaccccggcgtacaaggcggtggtggcggccctgagcaagcagctcgtgggggtgccgcgggtgaccatggacccgttcgagtactgctacaactggacggccacgagcacgccgccggccgtcccgaggctggaggtgcggttcgcggggtcggcgcggctccggccgccgaccaagagctacgtcatcgacgcggcgcccggcgtcaagtgcatcgggctgcaggagggcgtgtggcccggggtgtccgtcatcggcaacatcctgcagcaggagcacctctgggagttcgacctcgccaaccgctggcttaggtttaaggagagccgctgtgcacattaattttaattattattatattaggcacctctctagtcattcccttctccttctttcctcccgtaagggtctcgctcattctctgtaaggctctctcataagcaagtgttaatgaaatgtgggataagatggtatctcaagttgttgaaacacaaaaaaa

SEQ ID NO: 1368 - DNA, 1362 bp, Pseudoroegneria spicata
tcccccaaatctcactcccggtgctactcccgttcttccgccatcgccatggaggacgccgcgaacgccacccagaccacctccaccacctcttcggtggccgccgtagccgcggcggcccagcaccagcagctccagcgccagctctttctcatgcagcaggctcaggctcaggcgcaggcccagccccacccgcaggcgcagcagctgtcgcagcaggccatgtcccgcttcccgtccaacatcgacgcccacctccgccccctcggaccgcaccgcttccagcagccggcgccgtcgcagctccaaaccccaccccagccgcactcgcaggggcagccgcatccccagccgtccccgcagcaagcggcgcaggctagggtccggagccccgaggtggagatggcgcttcaggacgccatgcgggtctgcaacccggacatcaagacgcctttccattctctcgaggacgccgttagcaggttattgccttaccatgttgttgctgactacgaggctgaagaagatgacagaatccttgacagcgatgcaactggccagattccctctcgtcttcagcaatgggatcataacattctggtaaaaattgctgagttcacaacaacttttgagaagcaagtgttggcatacaacataatgaccaagaaaagggccattggtgagtttcgatcggaggagcgactcatgctagagcaagctttgttacaggaggagaagcaggcttcgatggaactaagagcagagatagaatctagggagaaagcaggccgcgaggctgctgaagctaagatgcgtatggccatggctgagcatgctcgagtggaagcccaagcacaccctgaggtaattggtcatggccctttgagggccaatgctgctgcttcccaaggcgatgatggtcctagtcatgacatggcacaagaacaggttgaagatggatgggaaaacactcaaagggatgatgatgatccatccgaggatttcctcaatgatgagaatgagccagagaatggaaactctgatatgcaagaggagtggcggcgatcgggggaatttgatctaaactctaggtaagactgcaagaggtacggcgtcgatggtggcaatctgatctgaactcaagacaggtgcactctacttgagataaggcttgaggatgcatcggctggtgcctggtaacttgtctagttctctgattatatatgttttgaagataacttgtcctgtcattgtggctgtaaacacgcaatttaaaactactatttagctactcatgtgttcaaacagtgttgagtggcttctgtatgttgtaaagctaacttctaaatgggcttccgcgca

SEQ ID NO: 1369 - DNA, 1834 bp, Triticum aestivum
ttgacacatcgtttcccccaaatctcacccccggtgctactcccgttcttccgccatcgccatggaggacgccgcgaacgccacccagaccacctccaccacctcgtcggtggccgccgtagccgcggcggcccagcaccagcagctccagcgccagctctttctcatgcagcaggctcaggctcaggcgcaggcccagccccacccgcaggcgcagcagctgtcgcagcaggccatgtcccgcttcccgtccaacatcgacgcccacctccgccccctcggaccgcaccgcttccagcagccggcgccgtcgcagctccaaaccccaccccagccgcactcgcaggggcagccgcatccccagccgtccccgcagcaagcggcgcaggctagggtccggagccccgaggtggagatggcgcttcaggacgccatgcgggtctgcaacccggacatcaagacgcctttccattctctcgcggacgccgttagcaggttattgccttaccatgttgttgctgactacgaggctgaagaagatgacaggatccttgacagcgacgcaactggccagattccctctcgtcttcagcaatgggatcataacattctggtaaaaattgctgagttcacaacaacttttgagaagcaagtgttggcatacaacataatgaccaagaaaagggccattggtgagtttcgatcggaggagcgactcatgctagagcaagctttgttacaggaggagaagcaggcttcgatggaactaagagcagagatagaatctagggagaaagcaggccgcgaggctgctgaagctaagatgcgtatggccatggctgagcatgctcgagtggaagctcaagcacacgctgaggtgattggtcatggccctttgagggccaatgctgctgcttcccaaggcgatgatggtcctagtcatgacatggcacaagaacaggttgaagatggatgggaaaacactcaaagggatgatgatgatccatccgaggatttcctcaatgatgagaatgagccagagaatggaaactctgatatgcaagaggagtggcggcgatcgggggaatttgatctaaactctaggtaagactgcaagggatacggcgtcgatggtggcaatctgatctgaactctaggtaagacaggtgcactcgacttgagaaaaggcttgaggatgcatcatctggtgcctggtaacttgtctctagttatctgattatatatgttttgaagataacttgtcctgtcattgtggctgtaaacacgcaatttaaaactagtactatttagcttttctttttgagaaaactagtactccctccgcaaactaatataagagcgctactcatgtgttcaaacagtgtttagaatgttaagtggcctgtgctttgttgcggaatattttagcaatgaccttatcaaaaataaacttgaatatatgagaatagtaccacaccacattccacctagaggtaaatgaagggtggctgaatgttatattgtcttgtgacacttgagttcaattattaaatatttattgttgaaaataataataataatgagggtttgcatgtgatagaaagtgaaaagtgtcaaaactaattatgtaattagggggaaaatctccccttgccccgaacggccgtacggttgctctcgcaaccaacgcctctctcctgtctgcctagaaccgacgcatccctcccaggatcgtcgcgtctctatggggatatataagctttctgtaaccattgtcaaggcaattgttcattgtttgatttggaacacgttatcagccacgctagaacagcca

SEQ ID NO: 1370 - DNA, 1638 bp, Brachypodium distachyon
ctcctcgactctccccgtcctactcctcttccccggccgtcatggaggacgccgcgaaccccaaccagacatcttccacctccgcggccgccgccgccgctgcggcggctcagcaccagcagctccagcgccagctcttcctcatgcagcaggcacaggcgcaggcgcaggctcaggcccagtcccacccgccggcgcagcagctgtctcagcaggccatgtcccgcttcccctccaacatcgacgctcacctccgcccccttgggccgcaccgcttccagcagccaccgccatcgcaaccccagccccagccgcattcgcagggcccatcgcaaccgcaaccgcagtcacagccgcaggcgcctccgcagcaacagctggcggcacaggctaggggccggagccccgaggtggagatggcgcttcaggacgccatgcgggtctgcaacccggacatcaagacgcctttccagtccctcgaggacgccgtcagcaggttgttgccttaccatgttgttgccgactacgaggctgaagaagatgacaggatccttgacagtgatgcaactggccagattccttctcgcctgcagcaatgggatcataacattctggtaaagattgctgagtttacaacaacttttgagaagcaagtgttggcatacaacataatgaccaagaaaagggccattggcgagtttcgatcggaggagcgactcatgctagagcaagctttgttacaggaggagaagcaggctatgatggaactaagagcagagatagaatctagggagaaagcaggtcgtgaggctgctgaagctaagatgcgcatggcaatggctgagcaggctcgagtggaggcccaagcacactctgatatgattggtcagggccctttgaggtccaatgctgcagcatcccaaggcgatgatggccctagccatgacatggtgcaagaacagggtgaagaaggatgggaaaatgctcaaagggatggtgatgatccgtccgaggatttcctcaatgacgagaatgaaccagagaatggaaactctgatatgcaagaggactggcgtcgatcgggggaatttgatctaaactctagataagacaggtgaagtggcgtagattgaggagcacattcaaaacttggagataaggcctggtgatgcatcggcttgcaacttatctccagtctgaaagatactccctccgttcctaaattcttgttgtggtttgagttcaagtttgaactcttgaactcaaaccatgacaagaatttaggaacagagggagtataatttatcgtgtgtatgtggctgtaaacaggtagttgcaaacaagttagctgctcatgtttctgacaatgtatagaatgttgcatctgtatgatgtaaagctaaattgtggatgggcttcgacaatctcaagtttaaatgttacttgcactcgtattcctgattgcagaaacttttagtagcaaggatgctttctgatctgtagttctgtcgaatcaaattttggaaggctcttgtttgatgcgttgacgtctgaaaaaacttagtgcttgcaacaagtgtatcccggatgccaactgtttgatatctcaatgaaatttgtgctgctaagcaatcagtt

SEQ ID NO: 1371 - DNA, 1231 bp, Leymus cinereus x Leymus triticoides
  misc_feature (162)..(162): n is a, c, g, or t
  misc_feature (345)..(345): n is a, c, g, or t
ccaaatctcactcccggtgctactaccgttcttccgccatcgccatggaggacgccgcgaacgccacccagacctcctccacctcttcggtggccgccgtagccgcggcggcccagcaccagcagctccagcgccagctctttctcatgcagcaggctcagnctcaggcccaggcccagccccacccgcaggcgcagcagctgtcgcagcaggccatgtcccgcttcccctccaacatcgacgcccacctccgccccctcggaccgcaccgcttccagctgccggcgccgtcgcagctccagaccccaccccagccgcactcgcaggggcagccgcacccccagncgtccccgcagcaagcggcgcagggtagggtccggagccccgaggtggagatggcgcttcaggacgccatgcgggtctgcaacccggacatcaagacgcctttccattctctcgaggacgccgttagcaggttattgccttaccatgttgttgctgactacgaggctgaagaagatgacaggatccttgacagcgatgcaactggccagattccctctcgtcttcagcaatgggatcataacattctggctttgttacaggaggagaagcaggcttcgatggaactaagagcagagatagaatctagggagaaagcaggccgcgaggctgccgaagctaagatgcgtatggctatggctgagcatgctcgagtggaagcccaagcacatcctgaggtgattggtcatggccctttgagggccaatgctgctgcttcccagggcgatgatgatcctagtcatgacatggcacaagaacaggttgaagatggatgggaaaacactcaaagggatgatgatgatccatccgaggattttctcaatgatgagaatgagccagagaatggaaactccgatatgcaagaggagtggcggcgatcgggggaatttgatctaaactctaggtaagacagcaagaggaatggcgtcgatggtggcaatctgatctgaactctaggtaagacaggtgtactcgacttgagataaggcttgaggatgcatcggctggtgcctggtaacttgtctctagttctcagattatatatgttttgaagataacttgtcctgtcattgtggctgtaaacacgcaatttaaaactactatttagctactcatgtgttcaaacagtgtttagaatgttgagtggcctctgtatgttgtaaagcta

SEQ ID NO: 1372 - DNA, 1376 bp, Triticum aestivum
ggtcgccctccagggtggcggcagacttcgccatgggcggcgcggcggcggtggtggccaagacgggggcggcgccggtggagcgcgtcaagctgctgctgcagaaccaggccgagatgctgcgccggggcgccctcacgcggccctaccgcgggatcgccgacgccttcgcccgcgtcctccgcgaggagggcgccgccgcgctctggcgtggaaaccaggccaacgtcatccgatacttccccacccaggcctgcaactttgcattcaaaggctacttcaagagcttcttcggctatgacaaggagaaagacgggaaatggaaatggctagctggaaatgtagcatgtggcagtgctgcaggagctacaacatcatccctgctataccatctggattatgcacggacacggctagccactgacgcgattgaatcccgagctaacaaacgtcagttcagggggttgctagatgtctacaagaagacacttgcaactgatggtattcgtggattgtaccgaggcttcagtgtgtctattgtgggtatcactctatatcggggtctttattttggcatctacgacaccatgaaacctattgtactagtagggccattggagggaaatttcctggccagttttgccttgggatggacaataactacattctccggggcctgcgcctacccatttgatacactccgacgaagaatgatgttaacttcagggcagccattcaaatacaggagcgccttccatgccgtaaaacagatagtttccaccgaagggttcttcactctattcagaggggtcggtgcaaatatcctctcgggaatggcaggagctggagttcttgctgggtatgaccagctccaacggtttgcaggccagcatgattacaaaattgagaacaagatgaaaggggcattgaaatgatgtgcatatgatggatctgcatgtgcctgggaagatccttgggttttcaggttgcgcgctggccagatgggatgtgttgtgtgagctacaattaccgagctcacagagcagaacttgaaatgcgtgcaagagttaatgggaatgaattgatcagcacagcaacatttcctggaggtgaattttcccaggacaggagatggcatcagggtgcaatagatgattcgtttctatacaaagttttgaataccataacgactagatcttattcttgaagtgtaaattaatatggtttcgaaagctgatgtccccatgtacactattaatgtaaactgtaaatagtactgtaaagaataaagagtttagggcctctttggttcaaaggaatttcgtaccttgtattaggtttgatccatttatccatacttggaacattagtttgct

SEQ ID NO: 1373 - DNA, 3903 bp, Brachypodium distachyon
atggccgcggcggcgaccaagggcggcgccgacgcctgccggcgggagcaggagcgcgcccggaggccgaagccctctagggtggcggcggacttcgccatgggcggcgcggcggcggtggtggccaagactggggcggcgccggtggagcgcgtgaagctgctgctgcagaaccaggcggagatgctgcgccgcgggggtctcacgcggccctacaaggggatcgccgacgccttcgcccgcgtgctccgggaggaaggcgccgccgcgctctggcgggggaaccaggccaatgtcatccggtacttccccacccaggcttgcaactttgcattcaaaggctacttcaagagcttatttggctatgataaggagagagacggtaagtggaaatggctagctagcaatgtagcatgcggcagcgctgcaggagctacaacgtcgtctctgctataccatctcgactatgcacgaactcggctagctactgacgcgattgaatcccggggaaacaaacgtcagttcagggggttgctggatgtctacaagaagacacttgcgagtgatggtattcctggattgtatcgaggcttcagtgtgtctattgtgggcatcactctataccggggtctctattttggcatatatgacaccatgaagcctctcgtcctagtagggccattggagggaaatttcctggccagttttgctttgggctgggcaataactacattctctggggcctgcgcttatccattcgacacaatccgacgtaggatgatgttaacttcagggcaaccatttaaatacaggaacgccttccatgccgtaaaacagatagtttccaccgaagggttcttcacactattcagaggtgttggtgcaaatattctctcaggaatggcaggagctggagttcttgctgggtacgaccagcttcaacggtttgcgggccagcatgattacagatttgggagcaagatgaaaggagcattgaagtgatgtgcatagatacacgtatgggaagaagattcgttggttgttaaggctgggttggccaaatgggatgtaggagctacagactagcttacagaacaaaactctactcccttcgatcttaacagttactgggatgaatgagttgatcaaaagaacatttcctggaggaggttcccaggacagtcatgatgtagtaaatgattcttgctatacacgttttaaatagatgtgattcttgaagtgtaaattgccatagacgcagaagttgatgtccccatgtacaccatcactgcaaactgtaaatagtacatgtggaattgctattactgaaggatatgattcttctttctgttgggcatgactcggtgagcaattgatttaccaacggaaaactgatttagagttctagatgttggtagatttttctataaataagaagtttgacgtagaacaaagctagaacatcttataatttggaacagaaggagtagatatgattcttgccgtgtaaatgaataaagattagggtaaagctgaatatgtacgtaccccatgtacactgtcaatgtaaactgtaaatagcactactgcatagatatggatattgaggagaatacgcatgtaagtaataggcatcaatttcagcacgcggaaggaagtgtaggggcagattgctgggtgtctagctggtcctccagcttcaagacaggttgttattttgctcggcaactatctgctgcaggtgttgattgaccgcttcgttgtaggaacccttgagctgcacttccttgaggcgaggtaaccggtctagcccagaaatctcaagagacgactcggtagcagaagagcagtgaaccaccagcacctcaacatattccggtatccagtttccaaaaactatcttcaacttgtagctgccgcaatcgatcttgagggctttggcggctttgaagtgtgccccacgccacgagctttcccgcctaccatagtgaagctcacagtctcgaatcggcttgacacgaagatggcgaaacatatcctgacatggcaactccataaggctgtctatgtcctcttgcgttgatattgtcaactcaagatgaacctttttgagattaccaagctgcttgagccagacaggcgatacatgtacattcccgtttccattccctcctccgtacagcttgaggctcttaagggtctttggtggctcgaatttctcatcgaaataaaacagatcctgctcatcgtcgaaccacactgacaaggactcaagatgcccgtgacccgatatggtcgaacacaagacgcgccagttttccctgttgatgccggacaccccaagcttgcgcaattgggtaagcctctcgagctccttgagaaggaaggcacctgcaccaccgctaacattgacaacaccaaaagtatgtaaggctgtcagcttcccgatcccctctacagcagcaggaacaacatcaacactgccatcgtcatgtcgtggccgtctgcgcagcttctttctgagggacaccaccaaatcgtgtgcccttctacaacatgacgctacggtaattgatttgcggaccttgtctgctgctatctggcttgtgctcgcgccatctttatctgctgcggcttgttggcttgtgcttgtgacatcactgtctgtggctcctgctgtccggcttgtgctcttgccatcaccctctgccgccgttgtctgccttgtgctcctgccctcaccctctgccgctgccgtctggcttgttctcgcgacaccaccgtctgaggctgctgctgtctggtttgtgcttgcgccatcaccatctccggctgctttctggcttgtgctcgcgccatcacggtctgcagctgcttggtttgtgctcacgccatccacatctgctactactggcacatcgctgttgccttcaaccaatgatgtattagtggtgccagcacgaagatactgcagcttcacaagcttgatgatagcacttgacagcttgactatagaggtgtgtctgacatccagagtctgcagttgcctcaatccaaccaatgaatctggcacacgggtaatatattggcatcctcgcacagagagaaacttgagacgaggcagtagcttcaggatctgctcgaggacatcatctgttacaccagaagtcgcgtcctccagatcgagcacacgaagcagtctcatcttggtatcactagagatgaagaatgatttccaatccccaaacactgtcaaagacctcagccgtgtcaagtccatgctttcaaatacaatcttgtctctgtcccagctgctcattatagcaaggtgttgtcctgtgcgttgcatgttgggcctgcaatggccttccagtgcaaacacaaggttatcttccattggccttgacttgatatattcaaggaagaaaccgttcacttggtacaccatcttgctgctgttgctgctgcttggtgtctgctgctcttggattatgcttgactcaacaagctgagcaaacaacatttccccattatcctctgcggtaccacttgcagatgtgtccgtagagtaaccctcggcgatccaccgcctcagcatacgccctcgtctgatgtcctggaagattgagaggtagaagatgcatggcttgagtgaatccgaacatgcatcgaagtaggactgcatccaacaaaatagaccccttaaactatgaaatcttgagcccatctccaacatgccaataaagtcatgatgtaatgttgatatgctagtgaagggagaatatattattggcaaggcatattcgcctatagcagctattactttgggaagtccgccacacttagccaagatagcttctgaaaactccctctctttggtagtcaactgattcttgccggcgc

SEQ ID NO: 1374 - DNA, 1492 bp, Secale cereale
acgggattcgcctctccactctctgccccgcacaccactcgtcgtcccctcctctttctcccagatccatacgccgtcgccgccatcctctccccttccctcaccccgccttctctcccaacgcccccccgatgccaactgctacggtcgtgtgtgtgctacatgtgaaactgacgatcgtgcatgctgctggcggacacgggccatgggcggcgcggcggcggtgttggccaagacgggggcggcgccggtggagcacgtcaagctgctgctgcagaaccaggccgagatgctgcgccggggcgccctcacgcggccctaccgcggcatcgccgacgccttcgcccgcgtgctccgcgaggagggcgccgccgcgctctggcgcggcaaccaggccaacgtcatccgatacttccccacccaggcctgcaactttgcattcaaaggctacttcaagagcttcttcggctatgacaaggagaaagacgggaaatggaaatggctagctggaaatgtagcatgcggtagtgctgcaggagctacaacttcgtccctgctataccatctggattatgcgcggacacggctagccactgacgcgatagaatcccgagctaacaaacgtcagttcagagggttgctagatgtctacaagaagacacttgcaactgatggtattcgtggattgtaccgaggcttcagtgtgtctattgtgggtatcactctatatcggggtctttattttggcatctacgacaccatgaaacctattgtactagtagggccattggagggaaatttcctggccagttttgccttgggatggacaataactacattctccggggcctgcgcctacccatttgatacactccgacgaagaatgatgttaacttcagggcagccattcaaatacaggagcgccttgcatgccgtaaaacagatagtttccaccgaagggttcttcactctattcagaggggtcggtgcaaatatcctctcgggaatggcaggagctggagttcttgctgggtatgaccagctccaacggtttgcaggccggcatgattacaaaattgagaacaagatgaagggggcattgaaatgatgtgcatatgatggatctgcatttgcctgggctgatccttgggttttcaggttgcgccctggccagatgggatgtgttgtgtgagctacatttaccgacctcacagagcagaataaaatgccagcaagagttaatgggaatgaattgatcagcacagcaacatttcctggaggtgaatcttcccaggacaagagatggcatcagggtgcaatagatgattcgtttctatacaaagttttgaataccataacaactagatcttatccttgaagtgaaaattattgtggtttcgaaagctgatgtccccatgtatactattaatgtaaactgtaaatagtattgtaaagaataaagagtttagggcctctttagaacccaaaaaaa

SEQ ID NO: 1375 - DNA, 2287 bp, Zea mays
gcggaaaacaaatccgtctcttcccaccaccaaggcaccaaccgccgccatcgtgtgatggccgccacgcccgacgagcggaagcaggagaggccgatgaggcccgcgacgtcgccggcgagcgtggtggcggacttcgccatgggaggcgcggccgccgtggtggcaaagacgggggccgcgccggtcgagcgcgtcaagctgctgctccagaaccaggccgagatgctgcgccgcggcaccctcacgcgcccctacaggggcatcgccgacgccttcacccgcatcctccgcgaggagggccccgccgcgctttggcgtggcaaccaggccaacgtcatccgctacttccccacccaggcttttaactttgcattcaggggctatttcaaaagcttttttggctatgacagggagaaagacggaaagtggaagtggttagctggaaatgtagcatctggcagtgctgccggagctacaacatcattgctgctataccatctagattatgcaagaacaaggctagctactgatgcaattgaatcacggggaaccaagcgccagttcagggggttgctggatgtttacaagaagacacttacaaccgatggcatgtctggactataccgaggtttcagtgtgtctattacgggaatctccttataccggggtttatattttggtatctatgatagcatgaagcctctagttctagtaggcccattggaggggaatttcttcgccagttttgtgttgggctggacaataactacgttctctggggcttgtgcctatccattcgacacggtccgtcgtagaatgatgttaacttcaggagaaccatttaaatacaagaacggtttccatgcagtaaaactgatagtttcaaccgaagggttcttcacattattcagaggtgttggtgcaaatattctctcagggctggcaggggctggagttctttctgggtatgatcaactccaacggttggcaagccggcatgatcaaaattttgagcacaatatgaaaggggcattgaaatgatgtgcatatgatatgaatagattcagatccttggttgaagtccagatcattcaaatgggatgctcaagcaagaactcctgagcctgaagaacttcgcaaaaaatattgggggaagaaaaaggaaaagttttcctggagatgaatttcacaaggagatggaatcattgcaacaaaagataactcttgtaaacagagagtgctgaatatatattttaatgtgtagatctaatccttcaagtatgagcacatgtacatgttggtgtttcttcgattgttagaggcaatagtatcctatcaatgtgaaatgtaaatccaaatccttcagtaggtcatgaccaagctatttttctaaaaagggatggacatcttgactcttgaggaaggttcttcagttacagatttggatttttgctaacatcatatgagcatgtcatgtgcagatgcaaatgacatttttgcaggagtgtcagaccttttttgaagtgacaggattcaagtggatatcgtatccattaatctgtgcatcactcaaaagaagagcaaaggagcctctaatccccatctgtctctgattctgatcatctccagggagccgagtaattgccactgcgctgggactgaacaactgaaaggagggaggctgatgagccgtgtgagctcactgggaggtgcagtcgccatggtgaccaagatggggaccatgccagtggaatgtgccaagctgctgctcctgaagaccagaactatgatgagatgaggctaggggccctcacatactcatacaatggcatcaacgacacattcactcacatcttccacgagtagggtgccgcttcaaccaggtcaatgacatccactacttcccacccaatgaggagctaaatacatctaagcttccttcctacttctggcttggatcacagactaatggacctgaatgttgtttctaagtggtgcacaggcaccagtgcacaaccgttgtttattggttagctctgcccccgctggtgtccttactcgtgagctttcatgagatgatacagataaccttgagtgttgcttttaggttgtaatattatcagtgacaaagagttcctgtcattatttcattcaatcattacttgtatgactgttacttcatacttttgttattgttgctgccctgatggttgagtaccagtactgttaattgctttgtggcacagacgtcagtgaaacaaaattaagatgcatttaaagagtt

SEQ ID NO: 1376 - DNA, 1849 bp, Panicum virgatum
tctacctggatcggtcagaccggtcggacctaccggtccctgccggataggccacagtgcctcgaccggtcagaccagttggtgccaattttggctgtcaacactatcctcggataagtggttttcatacgtcactcaaaaaagggagaatttagataaaaagaaagcaaatgaggatggaaaaaattacaatcgaatcaccgggcatctacaacaatgggcgcggcgcccgttccaccgcgccagcgagaggaggagaggccgccgatgaggtccgcgaggtcgccggcgagtgtggcggcggacttcgccatgggcggcgcggccgccgtggtggccaagacgggggccgcgccggtggagcgtgtcaagctgctgctgcagaaccagggcgagatgctgcggcggggcaccctgacgcggccctacaagggcatcgccgacgccttcgcccgcgtcctccgcgaggagggcgccgccgcgctctggcgcggcaaccaggccaacgtcatccgctacttccccacccaggcttttaactttgcattcaggggctactttaaaagcttctttggctgcgacagggagaaagacggaaaatggaagtggttggctggaaatgtagcctctggcagtgctgctggagctacaacgtcattactactataccatctagattatgcacgaacaaggctagctactgatgcaattgaatcccgaggaaacaaacgccagttcaggggactgctggatgtgtacaagaggacacttacaactgatggcgtatctggactatatcgaggtttcagtgtgtctattgttggcatcaccctgtaccggggtctacattttggcatctatgacaccatgaaacctcttgttctagtgggaccattggaggggaatttctttgccagctttgccttgggctgggcagtaacaactttctcgggggcctgttcctatccatttgacacagtccgtcgtagaatgatgttaacttcaggacaaccattcaaatacaggaatggcttccatgcagtaaagcagatcgttttaactgaagggttcttcacattattcagaggagttggagcaaatattctgtcaggaatggcaggagctggagttctttctgggtatgaccagctccaaaagttcgcaagccaacatggtcagattttgagcgcaagatgggggcattgaaatgatgtgtgtatggatatgagtatattcaagtccatggtcgaaggttcgatcattcaaatgggatgcgcaaccaagatgaaagaacttcacaaaacttagacagcaaagtgaatctccttgctgctccaacacgattggctgtagattgggttatctatatctgtacaattggctgtatgctgtagccattgatgaaatgatatcttggtaatcttgcaagctccaaaatggtttagtctaaaaaaccagtcaaccctagcaaaaccagtttgtacagatagaaacaacagtaggatggccctattacattgtattatggttatttgtacaatggccattatctgactgaacagtattaggtggttttccaggaatgctggttatcaccctgattctcttggtttcatgattctttcatctcctttgtaaagcttgcaatcagcggcctccaaaaaaactggtaccacagaacagagattcaattgtccactttgctccacttgattagtattgtgtatatctatttgtgaaactagaaaatgagaattgttagctcttgtttctgagactaactgctgatttattgaaaacatgtagatgtggtaattcaataaagagtatgacttctccttgtcttatc

SEQ ID NO: 1377 - DNA, 1819 bp, Panicum virgatum
caaattgtttccagccgtatataatggcgtacctcaaacatatgtagagttataatgacactggtatagtttcttaaatagtaatggtgtgcttcaaaaacggaacaattataatggcacagatctaattaaccctacaaaaaagtacaaccgaatcaccgtgcatctgcaacaaatcaacaatgggagcggcgcccgctccaccgcgccggcgagaggaggggaggccgccgatgaggcccgcgaggtcggcggcgagtgtggcggcggacttcgctatgggcggcgcggccgccgtggtggccaagacgggggccgcgccggtggagcgcgtcaagctgctgctgcagaaccagggcgagatgctgcggcggggcaccctgacgcggccctacaagggcatcgccgacgccttcgcccgcgtcctccgcgaggagggcgccgccgcgctctggcgcggcaaccaggccaacgtcatccgctacttccccacccaggcttttaactttgcattcaggggctactttaaaagcttctttggctgcgacagggagaaagacggaaaatggaagtggttggctggaaatgtagcctctggcagtgctgctggagctacaacgtcattactactataccatctagattatgcacgaacaaggctagctactgatgcagttgaatcccgaggaaacaaacgccagttcaggggactgctggatgtgtacaagaggacacttactactgacggcgtatctggactatatcgaggtttcagtgtgtctattgttggcatcaccctgtaccggggtctacattttggcatctatgacaccatgaaacctcttgttctagttggaccattggaggggaatttctttgccagcttcgccttgggctgggcagtaacaactttctcaggggcctgttcctatccattcgacacagtccgtcgtagaatgatgttaacttcaggacaaccattcaaatacaggaatggctttcatgcagtaaaacagatcgttttaaccgaagggttcttcacattattcagaggagttggagcaaatattctgtcaggaatggcaggagctggagttctttctgggtatgaccagctccaacggtttgcaagccgacatggtaagaattttgaccgcaagatggaaggggcattgaaatgatgtgcgtgtggatatgagtattattcaaatccatggtcgaaggttctatcattcaaatgggatgcagaagcaagataagaacttcacaaaacctagacaacaaagagaatttccttgctgctccaacacgattggctgcagattgggttatctatatctatacaattggctgtatgctgtagccattgatgaaatcatatcttggtaatcttgcaatctccaaaatggtttagtctcaaaaaccagtcaaccctcgcaaaaccagattgtacagatagaaacaacagtaggatgaccctattacattgtattatggttattgtacaatggccattttctgactgaacactattaggtggttttccaggaatgctggttgtcgccctgattctcttggtttcatgattctttcatctcctttgtaaagcctgcaatcagtggcctccaaaaaaaactggtaccacagaacagagatttatattgtccactttgctccacttgattagtaatgtgtatattttttgtttgtaaaactagaaaatgagaattgttagctcttgtttttgagactaactgccgatttaatggaaaacatgtagatgtagtaatttgataaagagtatgatatctccttgtct

SEQ ID NO: 1378 - DNA, 3257 bp, Sorghum bicolor
gccagttcaacaaaattgggcaggttcaagcctggcccaaataagcccatgcagcccatcatagtcccagattgcacgatcaggacgaagacctacccgacggcgccggcagtgctcacagccacgcaggagcaggatgccctctctctctctctctcacacacacacacacacacgaccccagcttggtaccccgcgtccggcctccagcatccccacccgacgccgacgaccacctctcagtgattcgtcctctgcgcgttggccctggttgctgcccgcgtctagtaggggggcgtcgcccggcgcgccctgcagcagctcctgacagccggcgccgccagcacccgcagcctcgcgccctcgccaccacccgctgctacagcgcgtgcgcgcccagaaggggccggcggccgtccgccggcgcacccagccgggtgcagagacgagcaggtatggcgcacggggcagaccagaggcgaacccagcaccagcagggtatagaataggagattttgcatggggaaccctagaaaagattctattctctttttcctctccgcaaccgattgaagtggatggcattgggcgacgaaaggctgacagggcgagcggacagaaaaaggcagactgaaattttccctctctatatagagattgatcttgatcgaggcggaaaacaaatccgtctcttcccaccaagccaccaaccggcaaccgccgccatcgagtgatggccgccgcgccgcccgacgagcgaaagcaggagaggccgctgacgcctgcgacgtcggcggcgagcgtggcggcggacttcgccatgggcggtgcggctgccgtggtggccaagacgggggccgcgccggtcgagcgcgtgaagctgctgctccagaaccagtcagagatgctgcgccggggcaccctcacgcgcccctacaagggcatcgccgacgccttcgcccgcgtcctccatgaggagggcgccgccgcgctctggcgcggcaaccaggccaacgtcatccgctacttccccacccaggcttttaactttgcatccaggggctacttcaaaagcttctttggctatgacagggagaaagacggacagtggaagtggttagctggaaatgtagcctctggaagtgctgcaggagctacaacatcgttgctgctataccatctagattatgcgaggacaaggctagctactgatgcaattgaatcacggggaaccaaacgccagtacagggggttgctggatgtttacaagaagacacttgcaactgatggcatgtctggactatatcgaggtttcagtgtgtctattatgggaatcaccttgtaccgtggtctatattttggtatctatgatagcatgaagcctctagttctagtaggcccattggaggggaacttcttcgccagttttgccttgggttgggcaataactacattctctggggcatgtgcctatccatttgacacggtccgtcgtagaatgatgttgacttcaggacaaccatttaaatacaagaacggtttccatgcagtaaaactgatagtttcaaacgaagggttcttcacattattcagaggtgttggtgcaaatattctttcagggctggcgggagctggagttctttctgggtatgatcaactccaacagttggcaagccggcatggtcacaattttgagcgcaagatgaaaggggcattgaaatgatgtgcacatggatatgaatatattcagctccttggttgaagtcatcattcaaatgcggtgcacaagcaagaacccctgagcctgaagaagttcacaaaaattattggggaaagacaaaggaaaagttttcctggagatgaatctcacaaggaaggagatggagtcattgcaacaaaagatagctcttgtaaacagagagtgctgaatattatatttaatgtgtagatctaatccttcaagtatgaatacatgtacatgttggtgtttcttcgatcatttgggtccaatagtatcctatcaatgtgaaatgtaaatccaaatccttcagtaggtcatgaccaaactatttttctaaggaaaaagagatggatctcttgactcttgaggaaggttcttcagttccagatttggatttccgctaacatcatgagcgtgtcatgtacaaatgcacatgacatttttgcaggggcgtcagatctttttccaaagagacaggattcaagtggatttcgcatccaataatctgtccatcactgaaaagaggagtaaaggagcctctaatccccatctgtctccgattctgatcattgccggggagctgagtaatttccaccgcactggcagcactgaacaactgaaaggaagggaggctgatgagccgtgtgagctcactgtcaagtctggtgatggacttctccatgggaggtgcggtcaccatggtggccaagatgggggccatgccagcagaatgtgtcaagctgctgctcctgaagacgagaactaggataagatattgtggctggtgaccttcacctactcatacaatggcatcacgacacattcacccacatcctccgcaaggagggtgcaccttcaaccaggccagtgtcatccgctacttcccacccagtgaggagttaaatacatgtaagcttcccaactacttctggcctgaatcatgacaaatgtacctgaatgttgcttctaggtggtacacaggcaccgggtaaatcaaactttcaatggtgaattgttgcttgtcttgttttgacaatacactttccctttagacaaaaatatatttactatagtgcgccaccattgttttttggctagctctctcccccccccacccccccccccaccccctctcccgctggtgtccttagttgtgagctttcatataattttagagatgatacatataaccttgtgtgttgcttataaggttgtaatcgtatcaatggcaaggaactcctgtcgttatttcattctgcaatcattacttgtatgcctgttacttcatactcttgttactgttgctgtcctgatggttcagtaccagtactgttaattgcttcatatgacggtgaaacaaaattaagatgcattcaaagagtttagtgcttgggccttgggaggatatttattgtgctcattagccattattgtaagtgaaccatcacatgtgcatgcatattatttgtgtattggttcattgttagatcaaaaacagaaacgagggggatttttt

SEQ ID NO: 1379 - DNA, 1605 bp, Setaria italica
atccccgtctatctacgaccccgaccgccgtcggggagcaatgggcgccgccgccgccgcgcccgtaccaccgaaccagcgagaggaggcgacgccgccgcctgtgaggtccgcgaggtcgccggcgagcgtggcggcggacttcgccatgggcggcgcggccgccgcggtggccaagacgggggccgcgccggtggagcgcgtcaagctgctgctgcagaaccagggcgagatgctgcggcggggcaccctcacgcggccctacgagggcatcgcccacgccttcgcccgcgtcctccgcgaggagggcgccgccgcgctctggcgcggcaaccaggccaacgtcatccgctacttccccacccaggcttttaactttgcattcaagggctactttaaaagcttctttggctacgacagggagaaaaatggaaaatggaagtggttggctggtaatgtagcctctggcagtgctgcaggagctacaacgtcattactgctataccatctagattatgcacgaacaaggctagctactgatgcaattgaatcccgaggcaacaaacgccagttcagggggctgctggatgtgtacaagaagacacttacaaccgacggcatatctggactataccgaggtttcagtgtgtctattgtgggcatcaccctgtaccggggtttatattttggcatctatgacaccatgaaacctcttgttctagtaggaccattggaggggaatttctttgccagcttcgccttgggctgggcaataactactttctcgggggcctgcgcctatccattcgacacggtccgtcgtagaatgatgttaacttcaggacagccattcaaatacaggaacggcttccatgcagtaaaacagatagttttaactgaagggttcttcacattattcagaggagttggtgcgaatattctatcaggaatggcaggagctggagttctttccggctacgaccagctccaacagtttgcaagtcggcatggtcacaattttgagcgcaagatgaaaggggtattgaaatgatgtgtatatggatatgaatatatttgaatccttggttcaaggtttgatcattcaaaggggatgcacaagcaagatatcccgggtctgaagaacttcacaaaagttaatggtggaaaaaggcaaaaattccaggaggtgaatctccttgctgctcggacgcgattgactatagattgggttatctatatatcttcaattggctatatgctgtagcccttgatgaaatgttacctcagcaatctctggaatggaagtttgcaggctccaaaatggttcttagtctcaaaacccacttaaccctagcaaacccaggtcatacaggtagaatcgacagtaggatggcccttttacattgtactatggttatttgtacagtggcaattctgtgtgaatagtgtttggtggttttccagaaatgctggttatcgccctaattctcttggtttcatatttctttgagctccttttcctatcctgctctgtaaagcttgcaatcagtggcctctaaacataactggtacaacagaaaaggacaaacagagattcatattttt

SEQ ID NO: 1380 - DNA, 1372 bp, Avena sativa
caaacacacactgacacgacacgcacacgaaggcgtggacgcaatgaggcccttcctgctaacgccggtgggcgcccggctcgcgtcgcccccctcgccgtcaacgctctcgcgcctgctcctcccactcaacctacaaaaccgccatgctcacacctgccccacccccagcgcgcgcgccaaccgcccttcctcatcgcttctcctccgccctcgccgccgcagcggtcgcctcttcgcctcgtcgtcggcccctcagatggctgcccctgcggatgccccgggaggatcggcggacgcgttcgaggtgatccgcgctcaccaggcaaaagctgcccggcttcctcctgttgaagaaatacgaaccattctggaccaaagtgtcagaggtgttctgatgacccattcccaggaacatgtgggctatccatcaggttcaatggttgattttgcatgtgatcaagatggttcccccatactagcagtgagtagtttagcagttcactcaaagaatctctcgggaagtactaagtgctctcttctggttgcgaaagacccagaggacagaacagatactgtaatcactgtatatggcgatgctacacctgtttctgatgaggaaaaagacgcagtgagaagtgcatacttaaggagacaccctgaggctttttgggtcgactttggtgacttccgttttctgcacatcaaaccaaaagctgtacgttacgtatctggggttgcaacagctctccttggctccggagaatttagtgctgctgagttcaaggaagcaaaagtggatcctatatcgcaattctccactcctatcacaggccacatgaataaggatcatgccgatgagacaaagctcattgtgcaacactcaaccaatgttaaggtggattttgctcatatgctggatgtggatagccttggtatcaatgtgaaggctggttatgatggaagtgttctgaagctgcgtatacctttccctaggcgtgcacaagacagaaaggatgtcaagacacttattgtggaaatgctacaggcagcaaaagcctcatcatcgcattctgaatgacttctttgttctggaagacgatggctttgtccatgtaaagaaagaaaagccgtaatcactatgagcagagcttctatatttgcgctccagtctcagcgtcagtgaagatggatgatccacagtaaattccatggttctacagttctacacatcatccatcaccattgtgacagcaaacatgtgtgaatttttccagtagaactgaaagaaatgcagagcaacttgtatatccacttgaactgttttgcactcatacatgactgaggttgttgagcagcaaaggtcatctta

SEQ ID NO: 1381 - DNA, 1315 bp, Leymus cinereus x Leymus triticoides
  misc_feature (8)..(10): n is a, c, g, or t
  misc_feature (349)..(349): n is a, c, g, or t
  misc_feature (351)..(351): n is a, c, g, or t
  misc_feature (465)..(465): n is a, c, g, or t
  misc_feature (469)..(469): n is a, c, g, or t
  misc_feature (504)..(504): n is a, c, g, or t
  misc_feature (530)..(530): n is a, c, g, or t
  misc_feature (1280)..(1283): n is a, c, g, or t
gctccgcnnncacactgacacacacgaaggcgtgcacgcaatgaggcccttcctgctcacgccggtgggcgcccagctcgcgtcgctcccctcgccgtcaacgctctcgcgactgctccgcccactccacctacaaaaccgccatgctcacgccatccccacccccgccccccacgcgcgcacctcctcctcgtcgcccctcctccacccttcccgccgcagcagtggccgccgcggcgatcgcttccttacctcctcctcgccctctcagatggccgcgcctgccgatgcccccggaggatctgcggacgcgttcgaggtgatccgcgctcaccaggtaaaagctgcncngcttcctcctgttgaagaaatacgaaccattctggaccaaagtgtcagaggtgttctggctacccattctcaggaacatgtgggttatccatctggttcaatggttgattttgngtgngatcaagatggttcccccatattagcagtgagtantttagcagttcactcaaagaatctcncaggaagtactaaatgttcacttttggttgccaaagacccagaggacagaacagatactgtaatcactgtatatggcgatgctacacctgttcctgatgaagaaaaagatgcagtgagaactgcatatttacggagacaccctgaggccttttgggttgactttggtgacttccgttttctgcacatcaaaccaaaagctgtacgttacgtatctggggttgcaacagctatccttggctctggagagtttagtgcagctgagttcaaggaagcaaaagtggatcctatatctcagttctccactcctattgcaggccacatgaacaaggatcatgctgatgatacaaagctcatcgtgcaacactcaacctctgttaaggtggattttgcttctattctggatgtggatagcctcggtatcaatgtgaaggctggttatgatggaactgttctgaagctgcgaattcccttccctagacgtgcgcaagacagaaaggatgttaagacacttattgtggaaatgctacaggctgcaaaggcctcatcctgacatgctgaatgtcctctttgttctggaaggcggtggcggcgtccatgtaaaaaagaaagccctagccgataagagctttcaggttgctctccattctcagcgtcagcgaagatgtatgatccacagaaaaatccatggtttcatacatcattcagcaccattgtgacagcgaacttgtgtgaattacttccagtcaaannnnaagaaatgcaaagcgacttgtatattgtaaaa

SEQ ID NO: 1382 - DNA, 1433 bp, Secale cereale
gactgagcgaccaccaagcggccagcgaggcgcgcacacacacagaccaagacgcacacacaccaaggcgtgcacgcaatgaggcccttcctgctcacgccggtgggcgcccagctcgcgtcgctcccctcgccgtcaacgctctcgcgactgctccgcccgctccacctacaaaaccgccatgctcacgccatccccgcccccacctccccctcgtcgcccctactccaccctccccgccgcagcagtagccgccgcggcgatcgcttcctcgcctcctcctcgccctctcagatggccgcgcctgccgatgcccccggaggatccgcggacgcgttcgaggtgatccgcgctcaccaggtaaaagctgcccggcttcctcctgttgaagaaatacgaactattctggaccaaagtgtcagaggtgttctggctacccattcccaggaacatgtgggttatccatctggttcaatggttgattttgcgtgcgatcaagatggttcccccatattagcagtgagtagtttagcagttcactcaaagaatctcctaggaagtaccaagtgctcacttttggttgccaaagacccagaggacagaacagatactgtaatcactgtatatggtgatgctacacctgttcctgatgaagaaaaagatgcagtgagaactgcatatttacagagacaccctgaggccttttgggttgattttggcgacttccgttttctgcacatcaaaccaaaagccgtacgatacgtatctggggtcgcaacagctatccttggctctggagaatttagtgctgctgagttcaaggaagcaaaagtggatcctatatctcagttctcctctcctattgcaggccacatgaacaaggatcatgctgatgatacaaaactcatcgtgcaacactcaacctctgttaaggtggattttgcttctattctggatgtggatagtcttggtatcaatgtgaaggctggttacgatggtactgtcctgaagctgcgtattcccttccctagacgtgcacaagacagaaaggatgttaagacacttattgtggaaatgctacaggctgcaaaggcctcatcctgacatgctgaatgacctctttattctggaaggcggtggcggtgcccatgtaaaaaagaaaaccctagccgataggagctttcagtttgctctccagtctcagcgtcagtgaagatgggtggtccatagacaattccatggtttcatacatcattcagcaccattgtgacagcgaacttgtgtgaactacttccagtcaaacttaaagaaatgcaaagcgacttgtatattgtaccgaactgttttgcactcgtacacaactgaagttgttgagcaaacaaaggtcatctcattggaaggtttcacatgtcaaaattagatattatctttcc

SEQ ID NO: 1383 - DNA, 1420 bp, Secale cereale
gcgaccaccaagcggccagcgaggcacgcacacacacagaccaagacccacacacaccaaggcgtgcacgcaatgaggcccttcctgctcacgccggtgggcgcccagctcgcgtcgctcccctcgccgtcaacgctctcgcgactgctccgcccgctccacctacaaaaccgccatgctcacgccatccccatcctcacccccacctcctcctcgtcgcccctactccaccctccccgccgcagcagtagccgccgcggcgatcgcttcctcgcctcctcctcgccctctcagatggccgcgcctgccgatgccccgggaggatccgcggacgcgttcgaggtgatccgcgctcaccaggtaaaagctgcccggcttcctcctgttgaagaaatacgaactattctggaccaaagtgtcagaggtgttctggctacccattcccaggaacatgtgggttatccatctggttcaatggttgattttgcgtgcgatcaagatggttcccccatattagcagtgagtagtttagcagttcactcaaagaatctcctaggaagtaccaagtgctcacttttggttgccaaagacccagaggacagaacagatactgtaatcactgtatatggtgatgctacacctgttcctgatgaagaaaaagatgcagtgagaactgcatatttacggagacaccctgaggccttttgggttgattttggcgacttccgttttctgcacatcaaaccaaaagctgtacgatacgtatctggggtcgcaacagctatccttggctctggagaatttagtgctgctgagttcaaggaagcaaaagtggatcctatatctcagttctcctctcctattgcaggccacatgaacaaggatcatgctgatgatacaaaactcatcgtgcaacactcaacctctgttaaggtggattttgcttctattctggatgtggatagtcttggtatcaatgtgaaggctggttatgatggtactgtcctgaagctgcgtattcccttccctagacgtgcacaagacagaaaggatgttaagacacttattgtggaaatgctacaggctgcaaaggcctcatcctgacatgctgaatgacctctttattctggaaggcggtggcggtgcccatgtaaaaaagaaaaccctaggagctttcagtttgctgtccagtctcagcgtcagtgaagatgggtggtccatagaaaattccatggtttcatacatcattcagcatcattgtgacagcgaacttgtgtgaactacttccagtcaaacttaaagaaatgcaaagcgacttgtatattgtaccgaactgttttgcactcatacacaactgaagttgttgagcaaacaaaggtcatctcattggaaggtttcacatgtcaaaattagatattat

SEQ ID NO: 1384 - DNA, 1480 bp, Triticum aestivum
acccagacccacacacaccaaggcgtgcacgcaatgaggcccttcctgctcacgccggtgggcgcccagctcgcgtcgctcccctcgccgtcaacgctctcgcgactgctccgcccactccacctacaaaaccgccatgctcacgccatccccgcccccacctcctcctcctcctcgtcgcccctcctccaccctccccgccgcagcagtggccgccgcggcgatcgcttcctcgcctcctcctcgccctctcagatggccgcgcctgccgatgcccccggaggatccgcggacgcgttcgaggtgatccgcgctcaccaggtaaaagctgcccggcttcctcctgttgaagaaatacgaaccattctggaccaaagtgtcagaggtgttctggctacccattctcaggaacatgtgggttatccatctggttcaatggttgattttgcgtgcgatcaagatggttcccccatattagcagtgagtagtttagcagttcactcaaagaatctcgcaggaagtactaaatgctcacttttggttgccaaagacccagaggacagaacagatactgtaatcactgtatacggcgatgctacacctgttcctgatgaagaaaaagatgcagtgagaactgcatatttacggagacaccctgaggccttttgggttgactttggtgacttccgttttctgcacatcaaaccaaaagctgtacgttacgtatctggggttgcaacagctatccttggctctggagagtttagtgcagctgagttcaaggaagcaaaagtggatcctatatctcagttctccgctcctattgcaggccacatgaacaaggatcatgctgatgatacaaagctcatcgtgcaacactcaacctctgttaaggtggatttcgcttctattctggatgtggatagcctcggtatcaatgtgaaggctggttatgatggaactgttctgaagctgcgaattcccttccctagacgtgcgcaagacagaaaggatgttaagacacttattgtggaaatgctacaggctgcaaaggcctcatcctgacatgctgaatgacctctttgttctggaacgcagtggcggcgtccatgtaaaaaagaaagccctagccgataagagctttcaggttgctctccagtctcagcgtcagcgaagatggatgatccacagaaaattccatggtttcatacatcattcaacaccattgtgacagcgaacttgtgtgaaatacttccagtcaaacttaaagaaatgcaaagcgacttgtatattgtactgaactgttttgcactcatacacgactgaagttgttgtcatgtcggtcttacgtgacttgtactttgatctttatgatatgaatgagacacgtattgccatgcaaaaaaggttcatctcattggaaggtttcacatgtcaaaattaggtaattgtcctttcctttatgagtttttaccatgtg

SEQ ID NO: 1385 - DNA, 2225 bp, Oryza sativa
gcaattgcgttttctcctttattactcctatttttctctctttgtccgttgcttttgcggcgtggggtgacgcggggtacgcgcgtggttaaccgcctttgcatttcctccttcgactggacgcacgccgaggccgtgaccgtgaccggcgccagatggagggaggggaaggggaagctcgtgggagtcgtagtgattctgtgcttgggttggatgttgggggttgaacgaaccgtagaaagtggtagaacgcgttgccattttggacattgccaatgcaacacgaatgatcggtcgttgtggaatactacgcatttttggttaggaaaacacggtacgatgtcagatgctcgtctagtcgtgtgatactgggattaggcaagttgtgcattgcaatttgtacgttgccaacacgagtgatcggtcgctgtggaatacgcattttggttaggaaaacatgtcagaaactcggtatacccgattttgcggttgagtgacagtcatgagaaagagacgaggaggtaaaatagacttgttattttgcagtgtacaaatactcaatcagttgcatacttgcaatgggctaatggtcaccagcccattcatcctcgtatcactgggttattaggcctgccaagttgacagatgccaaggctggctatttgggccatttcgtccacccggcgcccgcagccgcaagcgcatcgccaacgccgtgccgtggccgagccaccaccaagcggcaaccagacgaggcttcaccggcaccgcatcgcttcactccgctctcacagtctcacgcacgcacgccagcaggcggcacgcaacgcctcgcttcacggcctcggctagagagacgcgtgcacgcgaacgcagatgaagcccttgctgctcacgccggccgcgcggctcgcggccgcggcgccgtcaacgctctcgcggctgctccgcctacaaagcggtcgccaccatgcgcacgcctcctcctcctccaaccgcctattgccccctctcctccgtcctcctcgcgacggtttccgcggcggccgcctcatcgcctcctcctcctcctcctcctctcagatggcggcgcctgccgatgcaccgggcggatccgcggacgcgttcgaggtgatccgcgctcaccaggaaaaagctgctcgacttcctccggttgaagaaatacggaccattctggaccaaagtgttaggggtgtccttgccacccattctcagggtcatgttggctatccgtctggttcaatggttgattttgcatgtgatcaggatggttcccccatattagcagttagtagtttagcaattcactcaaagaatctctctgaaaatcctaaatgctcgcttctggttgccaaagaccctgaggacagaacagatactgtgattactgtatatggtgatgccacacctgtttcagaccaagaaaaagatgcagtacgaagtgcatacttacgaagacatcctgaggcattttgggttgattttggtgacttccgttttctgcacatcaagccaaaagccgtgcgatatgtgtctggggttgcaactgccatccttggttctggagaattcagtgctgctgagttcaaggaggcaaaagtggacccaatatctcaattctcaacccctattacgagccacatgaataaggatcattctgatgatacaaagctcattgtgcaatactcaaccactgtcaaggtggactttgcttacatgcttgatgtggatagtcttggtttcaatgtgaaggcgggctatgatggaagtgttctgaagctgcgtatccccttccctaggcgtgcacaggacaggaaggatgttaagacacttattgtggaaatgctccaagctgcaaaagcctcatcgtcttctgctgaatgaatgtcctgttctagaaagggacgtctttgtccttgtaaatgaaataaagatgtccttttcgatgagttttttctgatctaggaaatgtcatgtttttacacatgatatatcacaatgccacagcttaacaccgaacagatgccaatctacttgtatattatttacactgaaacgctccaccgtgtgtacatttcttacttgtcttaagtcttattggaactttggaagtctgcagatgcagctaccatcatctctcataaatgctagcgaaatgtgtttttgggatagcatttcagcaaaactactttttgaacatggcc

SEQ ID NO: 1386 - DNA, 1539 bp, Setaria italica
gttgcggttgcgggcttgcggctgcctgtgccgagcgaccaccaagctgccagcgcgaggctctccgctgtgttctcagtctacacgcgcacaccggaccccgctcagttgcgcacgcgtgcacgcgatgatgcccttcctgctcacgccgggcgccgcccgcatcgcctcggcgccctgcccctcgccgtcaacgctctcgcgcctactcctcccgctccacctacaaattaatggccggcacaaccaccaccaccgtcaccacgtccacgcctcctccaccccctcgcctctcgtctaccctcgcctccgcaaccgccgcggccgattcttcgcgtcctcccagatggcggcgccagccgatgcccccggcggatcggctgatgcgtttgaggtgatccgcgctcaccaggcaaaagctgctcggcttcctccagttgaggaaatacggacaattctcgatcaaagtgtcagaggcgttcttgccacccattctcaggagcatgatggttatccttctggttcaatggttgattttgcatgtgatcaggatggttcccccatattagcagtgagtagtttagcagttcattcaaagaatctctccggaaatcctaaatgctcacttcttgttgccaaagaccctgaggacagaacagatactgtaatcactgtatatggtgatgctgtccctgtttctgatgaacaaaaagattcagtgagaagtgcttacctacgaagacatcctaatgccttttgggttgattttggtgacttcagtttcctgcgcattaaaccgaaagctgtgcgctatgtatctggtgttgcaactgctctccttggctctggagaattcagtgctgctgagtacagggaagcaaaagttgacccaatatctcaattctcgactcctattacaagccacatgaataaggatcatgctgatgatacaaagctcattgtgcaacactcaaccaatgttaaggtggattttgcttttatgctggatgtggatagccttgggttcaatgtgaaggccggttatgatggaagtgttctgaagttgcgtattcccttccctaggcaggcgcaagacaggaaggatgtcaagacactaattgtggaaatgctccaagctgcaaaagccgcatcctcacatgccgattgatgtctagttctggaaggtgatggatctcacgaatgtaaatgaaagatagctagatcaaagagctcaggcttacattcagccgttctatcagttgaagatggagctacaaaaaatgtgcattgctttgctgtatgtagcaaacaacaacacgcgaagcactcccagataaaccaacggaaagcagcttgtatcattgtatgcaactctttcgaactgcctgttcagcaaacaaacaactgtcttactggaatgctattgatgtagaaggcttaaccgccggccaactcgagtggcttaacgatatacaaggtcctattaactacgttatgaactactgttcttgtgattcgatcatgtgttctgccaattct

SEQ ID NO: 1387 - DNA, 1501 bp, Saccharum officinarum
ctctttttgattctcaaaaaaaaaaggaagatctctttgtgcactgcagtcacggccttcttccatctggccaacgccaccccgtccgtgtgcacaggcagcacagctcgcggtcgcggcctgccgtgccgagcgaccaccaagcggccagcgaggctctccgtggtgcacgcgtgcacgcaacgacgatgcccttccttctcacgccgggcgcccgggcggcgccctcgccgtcaacgctctcgcgcctactccgtccgctccacctacaaattactaatggccggcacaaccaccagcaccgtcacatctccgtctccgcctccgcttcccccctcctctaccctcgcctccgcaaccgccgcgaccgattcttcgcgtcctcctcctcgtctcagatggcggcgcctgccgacgcccccggtggttcctcggacgcgttcgaggtgatccgcgttcaccaggcaaaagctgctcgtctttctccagttgaagaaatacggaccattctggaccgaagtgtcagaggcgttcttgctacgcattctcaggatcatgctggttatccatccggttcaatggttgattttgcatgtgatcaggatggttcccccatattagcagtgagtagtttagcaattcattcaaagaatctctccggaaatcctaaatgctcacttcttgtcgcgaaagaccctgaggacagaacggatactgtaatcactgtatatggtgatgctgttcctgtttctgacgaagaaaaagattcagtgagaagcgcttacctacgaaggcaccctgatgctttttgggttgactttggtgacttcagtttcctgcacatcaaacctaaagctgtgcgctatgtatctggcgttgcaactgctctccttggctctggagaattcagtgctgctgagttcaaggaagcaaaagttgatccaatatctcaattctcaactcctattacaagccatatgaacaaggatcatgccgatgatacaaagctcattgtgcaacactccactactgttaaggtggattttgcttatatgctggatgtggacagccttggttttaatgtgaaggctggttgtgatggaagtgttctgaagttgcgtatccccttcccaaggcaggcgcaagacaggaaggatgttaagacactaattgtggaaatgctccaagctgcaagagcctcatcttcagatcctgaatgatgtcctcgtcgtcctggaagctgatgaatctgtcggtgcaaatgaaagtaaacctaatgaataagagttcttgggtttccatccaatctctgcaccaactgaaggtggagccacataaatttcatggattgatacacgaccttgtatataacaatgagcgcttgaagtacttgtagttggatgaatatgaatacagagcgacttcagtatatgtgtacttactgacatgtagcaactctttcaactgatagttaaccaaatggctgtgaactattttcatc

SEQ ID NO: 1388 - DNA, 1340 bp, Panicum virgatum
gaggcccttcctgctcacgccgggcgcccgggcggcgccctcgccgtcaacgctctcgcgcctactcctcccgctccacctacaaaataatggccggcgcaaccacctccgtcgtcacgtcaacgcttcctcagtctccccacctctcatcaacccgcgcttccgcaaccgccgggcccgattcttcgccgcctcctcctcctcccagatggcggctccagctgatgcccccggcggatcggctgatgccttcgaggtgatccgcgctcaccaggcaaaagctgctcgtctttctccagtggaagaaatacggaccattctggaccgaagtgttagaggtgttcttgccacccattctcaggaacatgctggttatccttctggttccatggttgattttgcatgtgatcaggatggctcccccatattagcagtcagtagtttagcagttcattcaaagaatctctccggaaatccaaaatgctcacttcttgtcgccaaagaccctgaggacagaacagatactgtaatcactatatatggtgatgctgttcctgtttctgatgaacaaaaagattcagtgagaagttcttacctacgaagacatcctgatgccttctgggttgattttggtgacttcagtttcctgcacattaaaccgaaagctgtgtgctatgtatctggtgttgcaactgctctccttggctctggagaattcagtgctgctgagtacaaggaagcaaaagttgacccaatatctcaattctcaactcctatcacaagccacatgaataaggatcacgctgatgatacaaagctcattgtgcaacattcaaccactgttaaggtggattttgcttatatgctggatgtggatagccttgggttcaatgtgaaggccggttatgatggaagtgttctgaagttgcgtattcccttccctaggcaggcgcaagacaggaaggatgttaagacactaattgtggaaatgctccaagctgcaaaagccgcatcttcacatgccgattgattgccatagttctgggaggtgatggatctgtcaatgtaaatgaaagatagctatatcaataagagcacaggcttacgttcagtcgttctatgttggagatggagctacaaatatgttcatggtttgatgcattgctttgctgtatataacaaacagcagtacgtcaagcacttccagttgaaccaacgggaagcaacttgtatgcaactcatttgaactgactgttcagcaaacaaacaagttatcttactggaatgctactgagatgcggaagactttggccaacttgagtggcttaacgatgttcaaa

SEQ ID NO: 1389 - DNA, 1565 bp, Sorghum bicolor
agttccatctggccaacgccactcactctagactctaccccgccgtgtgcacaagcagcagcacagctcgcggtcgcgggcctgccgtgccgagcgaccaccaagcggccagcgaggctctccgcttgcgctgcacgcagacaccgagacaggctccgtggcgcacgcgtgcacgcaatgacgatgcccttgctgctcacgccgggcgctcgggcggcgccctcgccgtcaacgctgtcgcgcctactccttccgctccacctacaaattactaatggccggcacaaccaccggcacggtcacgtctccgcttcccccctcctctaccctcgcctccgcaaccgccgcggccgattcttcgcgtcctcctcctcctcgtcccagatggcggcgcctgccgacgcccccggtggttcttcggacgcgtttgaggtgatccgcgttcaccaggcaaaagctgctcgtctttctccagttgaagaaatacggaccattctggaccgaagtgtcagaggcgttcttgctacccattctcaggatcatgctggttatccatctagttcaatggttgattttgcatgtgatcaagatggttcccccatattagcagtgagtagtttagcagttcattcaaagaatctctccggaaatcctaaatgctcacttcttgtcgccaaagaccctgaggacagaacggatactgtaatcactgtatatggtgatgctgttcctgtttctgacgaagaaaaagattccgtgagaagtgcttacctaagaaggcatcctgatgctttttgggttgactttggtgacttcagtttcctgcacatcaaacctaaagctgtgcgctatgtatctggcgttgcaactgctctccttggctctggagaattcggtgctgccgagtacaaggaagctaacgttgatccaatatctcaattctcaactcctattacaagccatatgaacaaggatcatgctgatgatacaaagctcattgtgcaacactccactactgttaaggtggattttgcttatatgctggatgtggacagccttggttttaatgtgaaggctggttatgatggaagtgttctaaagttgcgtatccccttcccaaggcaggcgcaagacaggaaggatgttaaaacactaattgtggaaatgctccaagctgcaagagcctcatcttcagatcctgaatgatgtcgtcgtcatcctagaaggtgatgaatctgtcggtgcaaatgaaagtaaacctaattaataagagttcttgggtttccatccaatctctgcaccaactgaaggtggagccacagaaatttcatggactgatacacgaccttgtatataacaaagagcgcttaattacttgtagttgcatgaatacaaagcgacttcactatattgtacttactgacatgtgcagctctttcaactgattgttcaccaagtggctgtgaacttatttcaaccaaacagcgtacaactttattacagcacatagctcacaacagctttttcacagcttatgacatcttttccacataaactaaacagat

SEQ ID NO: 1390 - DNA, 1456 bp, Panicum virgatum
caccaagcggccagcgaggctcgggctctcggctctctccgcttgcccgcaggccgcagcagttgcacgcgtgcacgccatgaggcccttcctgctcacgccgggcgcccgggcggcgccctcgccgtcaacgctctcgcgcctactcctctcgctccacctacaaattaatggccggcgcaaccacctccgtcgtcacgtccacgcttcctcagcctctccacctcttctcatcaacccgcgcctccgcaaccgccgggcccgattcttcgccggcgccgcctcctcctcctccccctcccagatggcggcgccagctgatgcccccggcggatcggctgatgccttcgaggtgatccgcgctcaccaggcaaaagctgctcgtctttctccagtggaagaaatacggaccattatggaccggagtgtcagaggtgttcttgccacccattctcaggaacatgctggttatccttctggttcaatggttgattttgcatgtgatcaggatggctccccaatattagcagtcagtagtttagcagttcattcaaagaatctctccggaaatcctaaatgctcacttcttatagccaaagaccctgaggacagaacagatactgtgatcactgtatatggtgatgctgtccctgtttctgatgaacaaaaagattcagtgagaagtgcttacctacgaagacatcctgatgccttttgggttgattttggtgacttcagtttcctgcacattaaacctaaagctgtgcgctatgtatctggtgttgcaactgctctccttggctctggagaattcagtcctactgagtacaaggaagcaaaagttgacccaatatctcaattctcaactcctatcacaagccatatgaataaggatcacgctgatgatacaaagctcattgtgcaacattcaaccactgttaaggtggattttgcttatatgctggatgtggatagccttgggttcaatgtgaaggccggttatgatggaagtgttctgaagttgcgtattcccttccctaggcaggcgcaagacaggaaggatgttaagacactaattgtggaaatgctccaagctgcaaaagccgcatcttcacatgctgattgattgccatagttctggaaggtgatgaatctgtcaatgtaaatgaaagatagctagatcaataagagcccaggcttacgttcagttggtctatgtggaagatggagctacaaatatgttcatggtttgatgcattgctttgttgtatataacaaacaacagtacgtgaagaaattccagttgaaccaacgggaagcaacttgtatgcaactcatttgaacttgttgttcagcaaacaaaacaagttatcttactggaatgctgctgagatgtggaagactttggccaacttgagtggcttaacgatgttcaaagtctgttttactgttttgc

SEQ ID NO: 1391 - DNA, 1555 bp, Panicum virgatum
agagacactcgcggctgccgtgccggctgccgagcgaccaccaagcggccagcgaggctcgggctctcggctctctccgcttgcccgcaggccgcagcagttgtcagactcgctcgcagttgcacgcgtgcacgccatgaggcctttcctgctcacgccgggcgcccgggcggcgccctcgccgtcaacgctctcgcgcctactcctctcgctccacctacaaattaatggccggcgcaaccacctccgtcgtcacgtccacgcttcctcagcctctccacctcttctcatcaacccgcgcctccgcaaccgccgggcccgattcttcgccggcgccgcctcctcctcctccccctcccagatggcggcgccagctgatgcccccggcggatcggctgatgccttcgaggtgatccgcgctcaccaggcaaaagctgctcgtctttctccagtggaagaaatacggaccattatggaccggagtgtcagaggtgttcttgccacccattctcaggaacatgctggttatccttctggttcaatggttgattttgcatgtgatcaggatggctccccaatattagcagtcagtagtttagcagttcattcaaagaatctctccggaaatcctaaatgctcacttcttatagccaaagaccctgaggacagaacagatactgtgatcactgtatatggtgatgctgtccctgtttctgatgaacaaaaagattcagtgagaagtgcttacctacgaagacatcctgatgccttttgggttgattttggtgacttcagtttcctgcacattaaacctaaagctgtgcgctatgtatctggtgttgcaactgctctccttggctctggagaattcagtcctactgagtacaaggaagcaaaagttgacccaatatctcaattctcaactcctatcacaagccatatgaataaggatcacgctgatgatacaaagctcattgtgcaacattcaaccactgttaaggtggattttgcttatatgctggatgtggatagccttgggttcaatgtgaaggccggttatgatggaagtgttctgaagttgcgtattcccttccctaggcaggcgcaagacaggaaggatgttaagacactaattgtggaaatgctccaagctgcaaaagccgcatcttcacatgctgattgattgccatagttctggaaggtgatgaatctgtcaatgtaaatgaaagatagctagatcaataagagcccaggcttacgttcagttggtctatgtggaagatggagctacaaatatgttcatggtttgatgcattgctttgttgtatataacaaacaacagtacgtgaagcacttccagttgaaccaacgggaagcaacttgtatgcaactcatttgaacttgttgttcagcaaacaaaacaagttatcttactggaatgctgctgagatgtggaagactttggccaacttgagtggcttaacgatgttcaaagtctgttttactgttttgcattaaaaagactacgttgtttagcatgtgttccgtcaattct

SEQ ID NO: 1392 - DNA, 1222 bp, Pseudoroegneria spicata
  misc_feature (1191)..(1193): n is a, c, g, or t
cgccacccccacccccacctcctcctcgtcgcccctcctccaccctccccgtcgcagcagtggccgccgcggcgatcgcttcctcgcctcctcctcgccctcccagatggccgcgcctgccgatgcccccggtggatccgcggacgcgttcgaggtgatccgcgctcaccaggtaaaagctgcccggcttcctcctgttgaagaaatacgaaccattctggaccaaagtgtcagaggtgttctggctacccattctcaggaacatgtgggttatccatctggttcaatggttgactttgcgtgcgatcaagatggttcccccatattagcagtgagtagtttagcagttcactcaaagaatctcgcaggaagtactaaatgctcacttttggttgccaaagacccagaggacagaacagatactgtaatcactgtgtatggcgatgctacacctgttcctgatgaagaaaaagatgcagtgagaactgcatatttacggagacaccccgaggccttttgggttgactttggtgacttccgttttctgcacatcaaaccaaaagctgtacgttacgtatctggggttgcaacagctatccttggctctggagagtttagtgcagctgagttcaaggaagcaaaagtggatcctatatctcagttctccactcctattgcaggccacatgaacaaggatcatgctgatgatacaaagctcatcgtgcaacactcaacctctgttaaggtggattttgcttatattctggatgtggatagcctcggtatcaatgtgaaggctggttatgatggaactgttttgaagctgcgaatccccttccctagacgtgcgcaagacagaaaggatgttaagacgcttattgtggaaatgctacaggctgcaaaagcctcatcctgacatgctgaatgacctctttgttctggaaggtggtggggcgtccatgtaaaacagaaagccctagccgataagagctttcaggttgctctccagtctccgtcagcgaggatggatgatccacagaaacttccatggtttcatacgtcattcagcaccgttgtgacaacgaacttgtgtgaattacttccagtcaaacttaaagaaatgcaaagcgacttgtatattgtaccgaactgttttgcactcatacacaactgaggttgttgagcaaacannngtcatcttattggaaggtttcacaggtca

SEQ ID NO: 1393 - DNA, 1527 bp, Zea mays
ggaagatctttctgtgcagtcacggccctcttccttcttccatcgccactcactagtcactattctgcccctccgaccgtgtgtgcacaggaagggccagtcacggcaccgcagcatcgcggtcgcagattgccgtgccgagcgaagcgaccacaacaaagcggccagcgaggctctccgacaccgagccgcgcgcacgcaacgatgcccttcctgctcacgccgggcgctcgggcggtgccctcaccgtcaacgctctcgcgcctactgcttccgctccacctacaaattactaatggccggcacaaccaccagcacggtcacgtccccgcctctcccctcctataccctcgcctccgcaaccgccgcagccgattcttcgcggcctcctcctcctcctcctcgcctcagatggcggcgcctgccgacgccgccggtggctcctctgacgcgttcgaggtgatccgcgttcaccaggcaaaagctgttcgtctttctccagttgaagaaatacggaccattatggaccgaagtgtcagatgtgttcttgctacccattctcaggatcatgctggttatccatctggttcaatggttgattttgcatgtgatcaggatggttaccccatattagcagtgagtagtttagcagtccattcaaagaatctctctggaaatcctaaatgctcacttcttgttgccaaagatcctgaggacagaactgatactgtaatcactgtatatggcgacgctgttcctgtttctgacgaagaaaaagattcagtgagaagtgcttacctacgcaggcaccctgatgctttctgggttgactttggtgacttcagtttcctgcacatcaaacctaaagctgtgcgctatgtatctggcgttgcaactgctctccttggttctggagaattcaatgttgcagagtataaggaagcaaaagttgatccaatatctcaattctcaactcctatcacaagccatatgaacaaggatcatgccaatgatacaaagctcattgtgcaacactccactactgtcaaggtggattttgcttatatgctggacgtggacagccttggttttaatgtgaaggctggttatgatggaagtgttctgaagttgagaatccccttcccaagacaggcgcaagacaggaaggatgttaagacactaattgtggaaatgctccaagctgcaagagcctcatcttcagatcctgaatgatgtcgtcggtctggaatgtgaagaatcgtgcaaattgaagtaaacctaatgaataagagttattgggtttccgtccaatctctgcaccaactgaaggtggggccacagacactccatggattgatacacgaccttgtatataatataacaaagagcgcttgagccttgaagtacttgtagttgaatgaatacaaagcgatttcactatattgtacttactgacatgcataacaatttcaacggattgttcaccaaatgactgaactaattttaaccaaacaacttaattttttc

SEQ ID NO: 1394 - DNA, 1023 bp, Avena sativa
tctcatggcgacctccacctgccacctcccccctctcctccctggccccgcctccttgcgccatctccacctccagccttccccgccccccttcgcccgccacctccgcccgtcgcctccgattcgtctcctccgcgccgcccgtcgccgccaccccgacgccgtcgtcgtcgttccggacgcgcgtccctgggtcggcgacctctcaggagccgcttcctaccgggacggaagcgaggaagatggagacgaggtggagagcgaggacgagggcgaggacgaccgcagcctggacctcctggcccggttcctgcactcggtcttcaggaaggcctcccgccgcgcgcgccgcgccgctaggtccgtgctgccgccctccgtccccgctgagctggtgaagttctcggtcaatggtgtgctagccctcacgttcttgtggatcctcaaggggcttcttgaggtggtctgcacatttggaagcatggtgtttataagcattcttcttgttcgaggaatctggtctggagtaacttacatcagagaaaaccgatacagctatattcaacagctcaaggacgacgacagccggtggagcagagtacagactgccggttgaccatttgcttttcttctcagcaaaaaacacactctgaatcaaagggcccatgaaataatccaaggccactgttgcgataagatagcatgcccccagctcggtgcaagctgctgctgatggttgttgttatgtaacacagctgcacgagaatggaaggaaccccaattgctgtatacaaataagtggttcttttcggcgtgattcgtgcaaggcatagaatagccaaatagttgctgcaaaatgtcaccggcggctagtcgggttttccggctagccctgtgctactagccggtgtagaaagactagtgtttgtcatatggccccatatattagccggtgtagaaagacccatgtctgttgttgtatggaagatggtgcaaaatacttttttttggtctaaataaaaa

SEQ ID NO: 1395 - DNA, 1228 bp, Triticum aestivum
tcccaaatttaatgtgaaaaacgaaaaggaaaaaagggaaatgggggcaaatcaccagcttcccttggcaggctgagcaccagcagcctcctcccatggcgaccatcacctgccacctcccccctctcctccctggcccagcctccgggcaccatcgccacctcaagccctccccgccccccttcaatcggcacctccgcgccccgcctccgactcgtctcctccgcgccgcccgccgccgccatcccgacgccgtcgtcgtcgtcccagacgcccgcccctgggtcggcgacctgtcaggagccgcctcctaccgggacgggagggaggaagatggagacgaggaggacgatgcggacgaagacgacgacgaccgcagcctggacctcctggcgcggttcctgcactcggtgttcaggaaggcctctcgccgcgcgcgccgcgccgccaggtccgtgctgccgccctccgtccccgctgagctggtgaagttctcggtcaatggtgtgctggttctcaccttcttgtggatcctcaaggggcttcttgaggtggtctgcacatttggaagcatggtgtttataagcatccttcttgttcgagggatatggtctggagtaacttacatcagagaaaaccgatacagctatattcaacagctcaaggacgacgacagccggtggagcagagtacagcctgctggttgatcgtttgctttccttgctggcaacatactctgattcaaagggcccatgaataatccagggccactgttgagatagcatggatgctcccagctgtgcacaaaatgctgatgtttgttgttgctatataaattgctgctggagaatcgaaggaacccccctgtagtctatacaaataagtggttctcttcaacatgatggtgaaaaatgttaccggcgactgattgggttttatatctggcctggccccatactggccgagccgatgttgaaagactcgtatttgttgtagtatgaaaggtggtgcgaaatacctatggtcagtacagtgtaattctgtttcattttgatgtatggagtggtcctgaatatgcaaagctagtattttctcctgtgatgccatgaactagcttctgcagtggatttgaaaatcttgccaggcaactgtcttttgatctcgaacagtatgtctcagtcttgctgcttttggtcgttcgtctagattctttgtttgctactctcgc

SEQ ID NO: 1396 - DNA, 1479 bp, Leymus cinereus x Leymus triticoides
  misc_feature (1)..(1): n is a, c, g, or t
  misc_feature (63)..(63): n is a, c, g, or t
  misc_feature (67)..(67): n is a, c, g, or t
  misc_feature (76)..(76): n is a, c, g, or t
  misc_feature (89)..(89): n is a, c, g, or t
  misc_feature (91)..(91): n is a, c, g, or t
  misc_feature (597)..(597): n is a, c, g, or t
  misc_feature (640)..(640): n is a, c, g, or t
naaaactcggtagattgctcatttgtttacctccactgcccaccagctccgtgcttctgtccnctcngatttactntacttgcagctgngngggaaagatcatatcggaagcaagcaagaaaggagaggagggaagacgccatcgatcgaagctagcttggtgggtagttggttaatggagctggcgccatgtagcttcagctgctccacctacacccactgttccatcggcttcacgccagctcgggtccgggccggcgcctggaagatccgggccggggcgcatcagggcggcggggacggcgtcgagccgcgccggccggctggtcgccttgccgctgatggccccccggtcgtcgacgtgcccgcggtcgtcggcgccgaggggttcggaggggcccgggacgcggagctcgccatgtgggagaagctgggcgccgtcgtcaggctcagctacggcatcggcatctacgcgggcatggcgctggccgggagggcgatctgcgacatggccggcatcgactcctcgggcgggttccatccctcgctgacggcgctggtggaggggctcggctacgcgtcgccgcccatcatggngctgctcttcatcctggacgacgaggtggtcaagtactcgccncacgcccgcgccatcagggacgtggaggacgaggagctccgcaccttcttcgccggcatgtccccctggcagttcatcctcgtcgtcgccgccagctccgtcggcgaggagctcttctaccgcgccgccgtccagggagcattggccgatatattcctgagaggcaccgagctcatgaaagatgcccgagggattgtgtccctgagtggaatggtgcctccatttgtcccgttcgctcaaacctttgccgccgccatcaccgccgcgctcacggggtccctctactacatcgctaccgcccccaaagaccctacctatgtggtgacaccagttatgcgctcgcacgccgggcgacagaatatgaagaaactgttttcagcttggtacgaacggaggcagatgagaaagatatactcacctcttctagaaggcatcctggctttctacctcggcttcgaatggatccagacgggcaacattctggcaccgatgatcacccacggcatatactccgcggtggtccttggccatgggctatggaaaatccaagaccacaggagaaggttgcgacaaagggtccaggaaattagacgaagctcggacggactctagtcacaaatatctcgccagctagggaccaagttttgatacagttagtctacgataaagatagagaggagactgtagtacaagacaagatgtacatatgcaggcaggatggcatcacgtcaatatacagtacatacatagtacttatacgtgtgttagtgtgcagaaactacttaactgtatcattttcaatgtatgtatgaagccgatatatagatgaccttttttca

SEQ ID NO: 1397 - DNA, 1777 bp, Hordeum vulgare
ggagaatcaaatcaaataggagtacttgtgtatcatccgactccgacagccggatcgtcgccgccattaaaaaactcggctcgtttgttcaccagctcctcagatttactttgctcgccgccggttgggtggccggccggggaagatcgtgtcggaggcaagcaaggtaggagaggagaggagaggagggaagacgccgtacgtcatcgatcggagtcggagctagctagctagcttaggtgggtggttggttaatggagctggcgccatgtagcttcagccggtcatcctacacccagcagcactgttccatcggcttcacgccggcgcgggtcggcggctggaaggtgcgtgccggggcgcaccagggcggcggggacggcgtggagccgcgccggccggccgggcgcctcgcagcggatgggcccccggtcgtcgacgtgccggttgtggtcggcggcggcgaggggttcggaggggcccgggacgcggagctggccatgtgggagaagctgggggccgtggtccggctcagctacggcatcggcatctacgcggggatggcgctggccgggcgcgcgatctgcgacatggccggcatcgactcctccggcgggttccacccctcgctgacggcgctggtggaggggctgggctacgcgtcgccgcccatcatggtgctgctcttcatcctggacgacgaggtggtcaagtactcgccccacgcccgcgccatccgcgacgtcgaggacgaggagctccgcaccttcttcgccggcatgtccccctggcagttcatcctcgtcgtcgccgccagctccgtcggcgaggagctcttctaccgcgccgccgtccagggagcattggccgatatattcctgagaggcacggagctgatgaaagatgcccgagggattgtgtcactgagtggaatggtgcctccatttgtgccgttcgctcaaacatttgccgccgccatcaccgccgcgctcacgggttccctctactacatcgctaccgctcccaaagaccctacctatgtggtgacaccagtcatgcgctcgcacgccgggcgacagaacatgaagaaactgttttcagcttggtacgaacggaggcagatgaggaagatatactcaccactcctggaaggcatcctggctttctacctcggcttcgaatggatccagacgggcaacatcctggcaccgatgatcacccacgggatatactccgcggtggtccttggccatgggctgtggaaaatccaagaccacaggagaaggttgcgacaaagggtccaggaaattagacaaagctcagacgacgagctctagtcacccaatattctaagcagctagggaccaagttttgatacagctagcctacgataaactaccctagtagatagagatgagaccgtggtagtacaggacaagatgtacatatgcaggcaggatggcatcatgtcaatatacagtgtatacatagtacttatataagtgtgttagtgtatatgtagaaactacccaactgtatcattttcaatgtatgtatgtattcatgaagcagatatatagatgacccttttcctgtgcgtgccttgttgagcctctcaatggggttttgaacttttgacacacttggtctacaatagagtaccactaccaacacaatggcatcacatcaatacatagtgtgtgtatgtgtagtactgaaactacttaactgtatcatgtacatctatgaagacgacatatagatgagctttttatgt

SEQ ID NO: 1398 - DNA, 1706 bp, Triticum aestivum
ctcagatttactttgcttgcagccgggtcggtggccgggaaagatcgtgtcttggagcaagcaagaacggagaggggaggagaggaggggagggaggacgccgtcggtcggagcttgctagctagtaggtgggtggttggttaatggagctggcgccgccatgtagcttcagctgctcgtcatacaccaactgctccatcggcttcacgccggcgcgggtcctccgcgccggcccctggagggtccgtgccggggcgcaccagggcggcggggacggcgtcgagccggggcggccggccggtcgccttgccgctgatgggcctcccgtcgtcgacgtgccggccgtcgtcggcgccgcggacgggttcggaggggcgcgcgacgcggagctggccatgtgggacaagctgggcgccgtggtgaggctcagctacggcatcggcatctacgcgggcatggcgctggcggggcgggcgatctgcgacatggccggcatcgactcctccggcgggttccacccctcgctgacggcgctggtggaggggctcggctacgcgtcgccgcccatcatggcgctgctcttcatcctggacgacgaggtggtcaagtactcgccgcacgcccgcgccatccgcgacgtggaggacgaggagctccgcaccttcttcgccggcatgtccccctggcagttcatcctcgtcgtcgccgccagctccgtcggcgaggagctcttctaccgcgccgccgtccagggagcattggccgatatattcctgagaggcacggagctgatgaaagatgcccgggggattgtgtccctgagtggaatggtgcctccatttgtcccgttcgcgcaaaccttcgccgccgccatcaccgccgccctcacgggttccctctactacatcgctaccgcccccaaagaccctacctatgtggtgacaccagttatgcgctcgcacgccgggcgacagaatatgaagaaactgttttcagcttggtacgaaaggaggcagatgaggaagatatactcacctcttctagaaggcatcctggctttctacctcggcttcgaatggatccagacgggcaacatcctggcaccgatgatcacccacggcatatactccgcggtggtccttggccatgggctatggaaaatccaagaccacaggagaaggttgcgacaaagggtccaggaaattagacgaggctcagacagactctagctagtcaccaatatctagctaggcagctagggaccaagttttgatacagctgttagtctacgatacagatagagaggagactctagtggtacaagacaagatgtacatatgcaggcaggatggcagcacgccaatatacagtgtatacgtagtatttatacgtgtgttagtgtgtacttaactgtatcatgttcatgtagtatgtatatgaggccgatatatcagataaccttttttctgtgtgtgtcttgttgagcctctgaatggggttttgatacactttgtctacgacagagtaccaccaacaggatatggcatcacatcaatacatagtgtttgtatgtgtatgtgtctgtatttagtactgaaactagttaactgtatcatgtatatctatgaagacgacgtatagatgagctcttttatgcgcttgcagttgcatcaacagttttttgtgtcttgtcgagcccctgaaat

SEQ ID NO: 1399 - DNA, 1648 bp, Triticum aestivum
agctcccctcagatttactttgcttgcagccgggtcggtggccgggaaagatcgtgtcttggagcaagcaagaacggagaggggaggagaggaggggagggaggacgccgtcggtcggagcttgctagctagtaggtgggtggttggttaatggagctggcgccgccatgtagcttcagctgctcgtcatacaccaactgctccatcggcttcacgccggcgcgggtcctccgcgccggcccctggagggtccgtgccggggcgcaccagggcggcggggacggcgtcgagccggggcggccggccggccgccttgcagcggatgggcctcccgtcgtcgacgtgccggccgtcgtcggcgccgcggacgggttcggaggggcgcgcgacgcggagctggccatgtgggacaagctgggcgccgtggtgaggctcagctacggcatcggcatctacgcgggcatggcgctggcggggcgggcgatctgcgacatggccggcatcgactcctccggcgggttccacccctcgctgacggcgctggtggaggggctcggctacgcgtcgccgcccatcatggcgctgctcttcatcctggacgacgaggtggtcaagtactcgccgcacgcccgcgccatccgcgacgtggaggacgaggagctccgcaccttcttcgccggcatgtccccctggcagttcatcctcgtcgtcgccgccagctccgtcggcgaggagctcttctaccgcgccgccgtccagggagcattggccgatatattcctgagaggcacggagctgatgaaagatgcccgagggattgtgtccctgagtggaatggtgcctccatttgtcccgttcgcgcaaacctttgccgccgccatcaccgccgcgctaacggggtccctctactacatcgctaccgcccccaaagaccctacctatgtggtgacaccagttatgcgctcgcacgccggccgacagaatatgaagaaactgttttcagcttggtacgaaaggaggcagatgaggaagatatactctcctcttctagaaggcatcctggctttctacctcggcttcgaatggatccagacgggcaacatcctggcaccgatgatcacccacggcatatactccgccgtggtccttggccatgggctatggaaaatccaagaccacaggagaaggttgcgacaaagggtacaggaaattagacgaggctcagatggactctagtcaccagtctaggcagctagggaccaagttttgatacagttagtctacgatatagatagagaggaaactctagtacacgacaagatgtacatatgcaggcaggatggcatcacgtcaatatagtgtatacgtagtacttatacgtgtgttagtgtgtacttaactgtatcatgttcaatgtatgtatgaagccgatatatagatgacctttcttctgtgtgtgccttgtttagcctctcaatgaggttttggtaaagttagtctagtaccaacaggatggcatcacatcaatacatagtatgtgtgtgtgtagtgctgaagttacttaactgtatcatgtatatgtatgaagacgacctgagctcttttctgtgctggcagttgcatcaacagttttatgtgtcttgttgag

SEQ ID NO: 1400 - DNA, 1499 bp, Secale cereale
gactcaccattcccctgaagcgtggcgactggcgaccacttccaggctccacctcgccgccgtcgccgcatctccgctctccgccacgcgccgcggcctcttccccgcctccattggtcgcccgcgtcggctagacggcgagggagagcgtcggcttgattaatcgcgatggcgcggcctcgggcgtgggctccccttcccggccccgctctgtccctcctctccgtcctcctcctcctagtcggccgccgcggcgctgccgggggcgcggcggcggcaggggaagctccgtgtacccggcccccgtcgtctacccgcaccactccagacagatctcctggcatcccagggtcttcctctacccgcacttcctcaccgacgacgaggccaaccacctcgtctccctcgccagggcggagctcaagaggtctgcggtcgccgatgaaacgtcgggcaagagccagctcagcgaggtccgcaccagctccggcaccttcatcagcaagggccaggatccaattgttgctggtatagaggataaaattgccgcatggacatttcttccaaaagagaacggcgaagatatgcaagttctaaggtataagcgcggagagaagtatgagccgcactatgatttcttcaccgacagtgttaacactatccgtggtggacatcgtgtagctactgtacttttgtacttaacagacgttgcagaaggaggggaaactgttttcccttagccaaggcacgcaaaggatcacaccataaagatttgtcagaatgtgcacagaagcattgcagtgaaaccacggaaaggcgatgcccttctgttcttcaaccttcgcccagacgccgagacagacccgttgagcctccatggcggatgcgaggtcatcaagggggagaaatggtcggccacgaaatggatccgtgtggcctcgttcgacaaggtctatcacatgccaggcaactgcactgacagcagcaacagctgctcgcaatgggcggcactgggagagtgcacgaagaacccggcgtacatggtgggaaccgcggcactgcccgggcactgtagaaggagctgcaacgtgtgttagctctggaatgcttcgaacgtcgtcgcttgttgctggagtttgggttcatacaggagcagcaatggcgggtcgaactgagctggtgtcccacgaggtttggtcgtccagatggtaccaggttcttgttactccctgacgacaggttggttcctggctaccagtgtttatttatttattgatgaatggtaaacctgtctagatagtatcagaggacaaacccttgttgattagtgcttgtaatttgtgctaggcaagcagatgagttgattgttagagttggtccatggcaggtttcatgagcttgtggtgccatttttgtccgtagactgtagggactgtaatatcttttctcactcctgtgctatactgtggtatatatatgtagcaccaacacgtgttccc

SEQ ID NO: 1401 - DNA, 1527 bp, Triticum aestivum
tccattcccctgaacctgaagcgtggcgactggcgaccactcccaggctccacctcgccgccgtcgccgcatctccgctctccgccacgcgccgcggcctcttctccacctccattggtcgcccgcgtcggctagacagcgagggagagcgtcggcttaatcgcgatggcgcggcctcgggcgtgggctccctttcccggctccgctctgtccctcctctcggtcctcctcctcctagtcggccgccgcggcgctgccgggggcggcggcggcaggggaagctccgtgtacccggcccccgtcgtctacccgcaccactccagacagatctcctggtatcccagggccttcctctacccgcacttcctcaccgacgacgaggccaaccacctcgtctccctcgcgagggcggagctcaagaggtcggcggtcgccgatgaaacgtcggcaagagcaagctcagcgaggtccgcaccagctccggcaccttcatcagcaagggccaggatccaattgttgctggtatagaggataaaattgccgcatggacatttcttccaaaagagaacggtgaagatatgcaagttctaagatataagcgtggtgagaagtatgaaccgcactatgatttcttcaccgacagtgttaacactatccgtggtggacatcgtgtagctactgtacttttgtacttgaccgacgttgcagaaggaggggaaactgttttccccttagccaaggcacgtaaaggatcacaccataaagatttgtcagaatgtgcacagaaaggaattgcagtgaaaccacgaaaaggggacgcccttctgttcttcaaccttcggccggacgccgagacagacccgtcgagcctccatggcggatgcgaggtcatcaagggggagaagtggtcggccacgaaatggatccgcgtggcctcgtttgacaaggtctatcacacaccaggcaactgcacggacaacaacaacagctgctcgcagtgggcggcgctgggagagtgcacaaagaacccggcgtacatggtgggaaccacggcgctgcccggtcactgtagaaggagctgcaacgtgtgttagtgctggaatggaatccttggaacgccgcttgttgctgaagttggggttcatggaggagcagcaatggcgggtcgaactgagctggtatcccacgaggtttggtcgtccagatggtaccagtttcttgctactccctgatgacaagttggttcctggctaccagtgtttatttattgatgaatgtctagatagtatcagaggacagaccctgttgattagtgttcgtggtttgtgctaggcaggcagagatgagttcgttgttagagttggtccatggcagatttcatgagcttgtggtgccatttttgtctgtagaagactgtagggactgtaatctcttttctcactcttgtgctgtacgggtatatatatgtagcaccgacacgtgttaccctgaatttgacgaacatctccgattcctttggttttgtgc

SEQ ID NO: 1402 - DNA, 1575 bp, Triticum aestivum
cccggcccgcattccagtcccccgctccctccattcccctgaagcgtggcgactggcgaccactcccaggctccacctcgccgccgccgtcgccgcggcgtcttctccgcctcccgcgtcggctggacagcgagggtgagggtcggcttaattgcgatggcgcgggctccccttcccggcccagctctgtccctcctctccgtcatcctcctcctcgtcggccgccgcggagctgccggggccggcggcggcggcggaggcaggggcagctccgtgtacccggcccccgtcgtctacccgcaccactccaggcagatctcctggtatcccagggccttcctctacccgcacttcctcaccgacgacgaggccaaccacctcgtctccctcgccagggcggagctcaagaggtcggcggtcgccgatgacacgtcgggcaagagcaagctcagcgaggtccgcaccagctccggcaccttcatcagcaagggccaggatccaattgttgctggtatagaggataaaattgccgcatggacatttcttccaaaagagaacggcgaagatatgcaagttctaagatataagcgcggtgagaagtatgaaccgcaccatgatttcttcaccgacagtgttaacactatccgcggtggacatcgggtagctactgtacttctgtacttaacagacgttgcagaaggaggggaaactgttttccccttagccaaggcacgtaaaggatcacaccataaagatttgtcagaatgtgcacagaaaggacttgcagtgaaaccacgaaaaggggacgcccttctgttcttcaaccttcgcccagacgccgagacagatccgtcgagcctccatggcggatgcgaggtcatcaagggggagaaatggtcggcaacaaaatggatccgcgtggcctcgttcgacaaggtctatcacacgccaggcaattgcacggacaacagcaacagctgctcgcagtgggcggcgttgggagagtgcacaaagaacccagcatacatggtggggaccgtggcgctgcccgggcactgtagaaggagctgcaacgtgtgttagcgctggaatccttgggacgccgctcgttgctggagctgaggttcatacaggagcggcaatggcgggtcgaactgagctggtgtcgcacgaggtttggtcgtccagatggtaccggtttcttgttactccctgatgacaagttggttcctggctaccagtgtttaattattgattgatgaacggtaaacctggctagatagtatcagaggacagacccttgttgattagtgctcgtggtttgtgctaggcaggcagagatgagttgattgttagagttggtccatgacagatttcatgagcttgtggtgccatttttgtctgtagactgtagggactgtaatctcttttctcactcttgtgctatactggtatatatatgtagcatcaacacgtgttatcctgaatttgacgaacatttccaattcctttggttttgtgctcattttttgtactactgtgctactattagaatgaactgaatcattcatgtgc

SEQ ID NO: 1403 - DNA, 612 bp, Festuca arundinacea
  misc_feature (232)..(232): n is a, c, g, or t
ggcacgaggcttaaaaaggaaacaccggcggaccagcacacgctagccaagacctgagcaagacacactctccagcagggcaagcagcacagcacagcagcaatggccaccatcagcgccgccgcggcgaccaccgtcgttgcccgtgccgtgatcaccaggccgcaggctctaggtctgcctcagctgaggacgaggagccagagggtcaggtgcagctactccaaggacngcaaggaggcgaccccggccgccgtcgtccgtggcgcaggcgcgtccctgctcgctgcggcgggtgcggtgaccgcgtcggcagcgcccgccttggctctcgtcgacgagcggatgtcgacggagggcaccgggctgagcctcggcctgagcaacaacctgctggggtggatcctcctgggggtgttcggactcatctggtcactgtacaccgtctacacctccggcctcgacgaggacgaggagtccggcggcctctcgctctaagccttctcatgtaatccccgtgtaatcatggcgacggtcggtgtaatgtaattccagacatggatatctgtatctaagttgtttccattctgagagatatttagcggtcagaag

SEQ ID NO: 1404 - DNA, 551 bp, Festuca arundinacea
ggcacgaggcaagacacactctccagctaggatcagcagggcaagcagcacagcacagcagcaatggccaccatcagcgccgccgcggcaaccaccgtcgttgcccgtgccgtgatcaccaggccgcaggctctaggtctgcctcagctgagcacgaggagccagagggtgaggtgcagctactccaaggacgccaaggaggcgaccccggccgccgccgtccgcggcgcaggcgcgtccctgctcgccgcggcgggcgcggtgaccgcgtccgcggcgccagcgttggcgctcgtcgacgagcggatgtcgacggagggcaccgggctaagcctcggcctgagcaacaacctgctggggtggatcctcctgggtgtcttcggcctcatctggtcactgtacaccgtctacacctccggcctcgacgaggacgaggagtccggtggcctctcgctctaagccttctcatgtaatccccgtgtaagcatggcggtgcttgttgtaatgtaattccagacatggatatctgtatctaagttgtttccattctg

SEQ ID NO: 1405 - DNA, 649 bp, Lolium multiflorum
aagaacctgagcaagacacactctccagcagggcaagcagcacagcacagcagcaatggccaccatcagcgccgccgcggcgaccaccgtcgttgcccgtgccgtgatcaccaggccgcaggctctaggtctgcctcagctgagcacgaggagccagagggtgaggtgcagctactccaaggacgccaaggaggcgaccccggccgccgccgtccgtggcgcaggcgcgtccctgctcgccgcggcgggcgcggtgaccgcgtccgcggcgccagcgttggcgctcgtcgacgagcggatgtcgacggagggcaccgggctaagcctcggcctgagcaacaacctgctggggtggatcctcctgggtgtcttcggcctcatctggtcactgtacaccgtctacacctccggcctcgacgaggacgaggagtccggcggcctctcgctctaagccttctcatgtaatccccgtgtaatcatggcgacggtcggtgtaatgtaattccagacatggatatctgtatctaagttgtttccattctgagagatgtttagcggtcagaagaaatgcttgactcctgggatattgtgggtcgagcaacttgaataaaacaattaaggaacatttcacgcgcacataaaaaaaaaa

SEQ ID NO: 1406 - DNA, 1048 bp, Secale cereale
gcaccagcaggccggcggcaagcagcgcagcacagcaaccaaatggccaccatcagcgccgccgcggcgaccaccgtcgtcgcccgtgccgcgatcaccaggccgcaggctctaggtctgccccagctgaggacgaggagcgagagggtgaggtgcagctactccaaggacgccaaggaggcgacccctgccgccgccgtccgcggggctggcgcgtccctgctcgccgcggcgggcgcggtgaccgcgtccgcggggccggcgctggcgctggtcgacgagcggatgtcgacggagggcaccgggctgagcctggggctgagcaacaacctgctggggtggatcctcctgggcgtcttcggcctcatctggtcgctctacaccgtctacacctccggcctcgacgaggacgaggagtccggcggcctctcgctctaagctatacagtcttctcgtcgtttcatgtaatccgcccgcgagcatcgccatgcatgatcggtgtaatgtaattccagagatggatatttgtatctaagcgtttccattctgagagatgtttcgccgtcagatggtttgcttgccccgccttggagactctgcgtctcgcgacttgcatgaataaaacatccaaggaaaatttcacgcacccacagacagataggtccaagttctcagtaaaattgctgatctgtgatggtatgtggcattttggccatatagctcttttgcttctagtgtacataactttacatcagctatttgatcaaaaccatataactgaacatatatcagatcgctgcaacagaacatatattttttgatctacaacaaaaacggttaacgattgttgattctcaaggtgctccaagttaggtggaaaaactggtgcctactctaatggtcagttggtactatcttcaatatgattgtcctgagacgcaatctcttcagcagtaacttctatctgttcagagatgcttaaggtgacctacggaaaaaatttcagtgcttccttcggacgagccaccagtagcatcagtaacttcta

SEQ ID NO: 1407 - DNA, 1743 bp, Secale cereale
gtgcggaccagcacacgctagccaagcaagacccgagcaagccacactctccagcaccagcaggccggcggcaagcagcgcagcacagcaaccaaatggccaccatcagcgccgccgcggcgaccaccgtcgtcgcccgtgccgcgatcaccaggccgcaggctctaggtttgccccagctgaggacgaggagcgagagggtgaggtgcagctactccaaggacgccaaggaggcgacccctgccgccgccgtccgcggggctggcgcgtccctgctcgccgcggcgggcgcggtgaccgcgtccgcggggccggcgctggcgctggtcgacgagcggatgtcgacggagggcaccggactgagcctggggctgagcaacaacctgctggggtggatcctcctgggcgtcttcggcctcatctggtcgctctacaccgtctacacctccggcctcgacgaggacgaggagtccggcggcctctcgctctaagctatacagtcttctcgtcgtctcatgtaatccgctcgcgagcatctccatgcatgatcggtgtaatgtaattccagagatggatatttgtatctaagcgtttccattctgagagatgtttcgccgtcagatggtttgcttgccccgccttggagactctgcgtctcgcgacttgcatgaataaaacatccaaggaaattttcacgcacccaaagacagataggtccaagttctcagtaaaattgctgatctgtgatggtatgtggcattttggccatatacctcttttgcttctagtgtacataactttacatcagctatttgatcaaaaccatataactgaacatatatcagatcgctgcaacagaacatatattttttgatctacaacaaaaacggttaacgattgttgattcttaaggtgctccaagttaggtggaaaaactagtgcctactctaatggtcagctggtactatcttcaatatgattgtcctgagacgcaatctcttcagcagtaacttctatctgttcagagatgcttaaggtgacctcggagaaaatttcagtgtttccttcggacgagccaccagtagcatcagtaacttctattggctcagaatcgccagttaccacaatattttcaaggtgttgagctcttgacctggttttcaatggctcatcaggtgggcttgtggctggatgagatatcaatattacagaacttgattgaatctgtacactagattggtccacataagattcatcggggtgctcatgacttctagaattctgcgtgttatcctcttcgtcatggtacgatatgccaagtttctgtgcatgactcaatcctggacaaactcccttgatgtaacctcttgttgtgaacaaaacattggacaatgaattttgactggaaacagtccgtctttcatcaaactgagcacagttagcactttgctgtatactggaaccatcaccactgccgtagccacggtcatctaccaaggctatttcgggagtagcaggtaacaaatggccttctgtgctgaatatgtatttatatggcccattttcaacaatgttatcagggcctacagctaaatcaaaaagaagccagagatattttaccgttctgcaaggaaaaaactctccatgtggtcatcctgcttgtgggtttccacatctgaaatgtggcagtagccgacaggacatttagcagcatattgaaggcttggctagtagacttccggg

SEQ ID NO: 1408 - DNA, 2528 bp, Triticum aestivum
ctcacctgattgccagtgactatgccactggtatggagatcgagtcttatgatggtcagttacttcatttgtccgttgacttggcccagaggttgttacctgcatttgacactcctacaggtattccatttggatctgttaatttattgtatggagtcgatgatgatgaaagcaagataacatcgacggctggtggcggcactttgacattggagttcggtgtcttgagtcggttgactaataacactgtttttgagcaagttgcaaaaaatcagtgcgtgggatatgggcacgcaggtcgaaactcaaccttgttggtgcccatataaatgtctttactggtgaatggacacaaaaggatgcaggaatcggcacaagcatcgactcgttctacgaatatgttctgaaggcatatttattgttcggagatgaagaatacttgtatgtatttcaagaggcttacaaggctgccatgcactacctccaccatgatccttggtatattgaggtaaatatgaattctggtgctactgtttggccactattcaatagtctgcaggcattctggccaggacttcaggttttagctggagatgtcgatcctgccattcgaacacatgctgccttctttagcgtctggaaaaaatatgggttcactccagaagggtttaatctggctacatccactgttcagaacggacaaaggagctacccgctgcggcctgagttgattgaaagcacatattggctattcaaggctaccagagattataggtaccttgatgttggaagggatatactagcaagccttcaatatgctgctaaatgtccttgcggctactgccacatttcagatgtggaaacccacaagcaggatgaccacatggagagttttttccttgcagaaacggtaaaatatctctggcttctttttgatttagctgtaggccctgataacattgttgaaaatgggccatataaatacatattcagcacagaaggccatttgttacctgctactcccgaaataaccttggtagatgagcattgtctttattttggagaccgtggctacggcagtggtgatggttccagtatacagcaaagtgctaactgtgcccagtttgatgaaagacggactgtttccagtcaaaattcattgtccaatgttttgttcacaacaagaggttacatcaagggagtttgtccaggattgagtcatgcacagaaacttggcatatcataccatggcgaagaggataacacgcagaattctagaagtcatgagcaccccgatgaatcttatgtggaccaatccagtgtccagattcaatcgagttctgtaatattgatctctcatccagccacaagcccacctgatgagcctttgaaaaccaggtcaagagctcagcaccttgaaaatattgtggtaactggcgattctgagccaatagaagttactgatgctactggtggctcgtccgaaggaaacactgaaattttttccgaggtcaccttaagcatctctgaacagatagaagttactgctgaagagattgtgactcaggacaatcatattgaagatagtaccagctgaccattagagtaggcaccagtttttacacctaacctggagcaccttgagaatcaacattcatcaacagattttgttgtagatcaaaaagttaatattctgttgcagcgaaccgatatatgttctgttatatgggtttgatcaaatagctgatgtaaagttatgtacactagaagcaaaggaactatatggccaaaatggcacataccatcacagatcagcaattttactgagaacttggacctatctgtgcgtgcgtgaaattttccttggatgtttttattattcatccaagtcgcgagacgcagtcttcaaggcggggcgagcaaaccatctgacggcgaaacatctcagaatggaaacgcttagatacaaatatccatctctggaattacattacaccgatcatggcgatgctcgcgagcggattacatgagacgacgaggaaactatgtgtagcttagagcgagaggccgccggactcctcgtcctcgtcgaggccggaggtgtagacggtgtagagcgaccagatgaggccgaagacgcccaggaggatccaccccagcaggttgttgctcagccccaggctcagcccggtgccctccgtcgacatccgctcgtcgaccagcgccagcgccggccccgcggacgcggtcaccgcgcccgccgcggcgagtagggacgcgccagccccgcggacggcggcggcaggggtcgcctccttggcgtccttggagtagctgcacctcaccctctcgctcctcgtcctcagctggggcagacctagggcctgcggcctggcgatggcggcacgggcgacgacggtggtcgccgcggcggcgctgatggtggccatttggttgttgtgcttgcgctgcttgccgccggcctgctggtgctggagagtgtggcttgctcgggtccggacgcgtgg

SEQ ID NO: 1409 - DNA, 2945 bp, Triticum aestivum
gaacatgatgcagccgatgcggctgcggctgcggcgccaaggccgcgcctcccccctcctctgcctctccgccgccatcctcgcggccgctctgctccccggcgccgccgtcgcagacggcgtcacgccttccgaggcgcgcctgcttcgcgacgaggtgaaagatatgttttatcatgcatttgatgggtacatgcaacatgcttttccacttgatgagttgcgaccgttgagttgtcaaggggaagactcccttggtggttatgcacttactcttatcgactctttggatactctggctttactaggtgataaggagagatttgctgctggtgtggagtgggttggtaagaacgtccgctttgatatcaacaaaactgtctcagtttttgaaaccaatatacgtatacttgggggtctgttatcagctcacctgattgccagtgactatgccactggtatggagatcgagtcttatgatggtcagttacttcatttgtccgttgacttggcccagaggttgttacctgcatttgacactcctacaggtattccatttggatctgttaatttattgtatggagtcgatgatgatgaaagcaagataacatcgacggctggtggcggcactttgacattggagttcggtgtcttgagtcggttgactaataacactgtttttgagcaagttgcaaaaaattcagtgcgtgggatatgggcacgcaggtcgaaactcaaccttgtcggtgcccatataaatgtctttactggtgaatggacacaaaaggatgcaggaatcggcacaagcatcgactcgttctacgaatatgttctgaaggcatatttattgttcggagatgaagaatacttgtatgtatttcaagaggcttacaaggctgccatgcactacctccaccatgatccttggtatattgaggtaaatatgaattctggtgctactgtttggccactattcaatagtctgcaggcattctggccaggacttcaggttttagctggagatgtcgatcctgccattcgaacacatgctgccttctttagcgtctggaaaaaatatgggttcactccagaagggtttaatcttgctacatccactgttcagaacggacaaaggagctacccgctgcggcctgagttgattgaaagcacatattggctattcaaggctaccagagattataggtaccttgatgttggaagggatatactagcaagccttcaatatgctgctaaatgtccttgcggctactgccacatttcagatgtggaaacccacaagcaggatgaccacatggagagttttttccttgcagaaacggtaaaatatctctggcttctttttgatttagctgtaggccctgataacattgttgaaaatgggccatataaatacatattcagcacagaaggccatttgttacctgctactcccgaaataaccttggtagatgagcattgccttcattttggagaccgtggctacagcagtggtgatggttccagtatacagcaaagtgctaactgtgcccagtttgatgaaagacggactgtttccagtcaaaattcattgtccaatgttttgttcacaacaagaggttacatcaagggagtttgtccaggattgagtcatgcacagaaacttggcatatcataccatggcgaagaggataacacgcagaattctagaagtcatgagcaccccgatgaatcttatgtggaccaatccagtgtccagattcaatcaagttctgtaatattgatctctcatccagccacaagcccacctgatgagccttcgaaaaccaggtcaagagctcaacaccttgaaaatattgtggtaactggcgattctgagccaatagaagttactgatgctactggtggctcgtccgaaggaaacactgaaattttttccgaggtcaccttaagcatctctgaacagatagaagttactgctgaagagattgcgtctcaggacaatcatattgaagatagtaccagctgaccattagagtaggcaccagttcttccacctaacttggagcaccttgagaatcaacattcgttaacagattttgttgtagatcaaaaagttaatattctgttgcagcgaactgatatatgttctgttatatgggtttgatcaaatagctgatgtaaagttatgtacactagaagcaaaggactatatggccaaaatggcacataccatcacagatcagcaattttactgagaacttggacctatctgtgcgtgcgtgaaattttcctttggatgttttattattcatccaagtcgcgagacgcagtcttcaagcggggcgagcaaaccatctgacggcgaaacatctcagaatggaaacgcttagatacaaatatccatctctggaattacattacaccgatcatggcgatgctcgcgagcggattacatgagacgacgaggaaactatgtgtagcttagagcgagaggccgccggactcctcgtcctcgtcgaggccggaggtgtagacggtgtagagcgaccagatgaggccgaagacgcccaggaggatccaccccagcaggttgttgctcagccccaggctcagcccggtgccctccgtcgacatccgctcgtcgaccagcgccagcgccggccccgcggacgcggtcaccgcgcccgccgcggcgagtagggacgcgccagccccgcggacggcggcggcaggggtcgcctccttggcgtccttggagtagctgcacctcaccctctcgctcctcgtcctcagctggggcagacctagggcctgcggcctggcgatggcggcacgggcgacgacggtggtcgccgcggcggcgctgatggtggccatttggttgttgtgcttgcgctgcttgccgccggcctgctggtgctggagagtgtggcttgctcgggtct

SEQ ID NO: 1410 - DNA, 1160 bp, Secale cereale
gccacactctccagcaccagcaggccggcggcaagcagcgcagcacagcaaccaaatggccaccatcagcgccgccgcggcgaccaccgtcgtcgcccgtgccgccatcgccaggccgcaggctctaggtctgccccagctgaggacgaggagcgagagggtgaggtgcagctactccaaggacgccaaggaggcgacccctgccgccgccgtccgcggggctggcgcgtccctgctcgccgcggcgggcgcggtgaccgcgtccgcggggccggcgctggcgctggtcgacgagcggatgtcgacggagggcaccgggctgagcctggggctgagcaacaacctgctggggtggatcctcttgggcgtcttcggcctcatctggtcgctctacaccgtctacacctccggcctcgacgaagacgaggagtccggcggcctctcgctctaagctatacagtcttctcgtcgtctcatgtaatccgctcgcgagcatcgccatgcatgatcggtgtaatgtaattccagagatggatatttgtatctaagcgtttccattctgagagatgtttcgccgtcagatggtttgcttgccacgccttggagactctgcgtctcgcgacttgcatgaataaaacatcaaggaaaatttcacgcacccacagacagataggtccaagttctcagtaaaattgctgatctgtgatggtatgtggcattttggccatatacctcttttgcttctagtgtacataactttacatcagctatttgatcaaaaccaatataactgaacatatatcagatcgctgcaacagaacatatattttttgtatctacaacaaaaacggttaaacgattgttgattcttaaggtgctccaagttaggtggaaaactaagtgcctactctaatggtcagctggtactatcttcaatatgattgtcctgagacgcaatctcttcagcagtaacttctatctgttcagagatgcttaaggtgacctcggagaaaatttcagtgtttccttcggacgagccaccagtagcatcagtaacttctattgcgtcagaatcgccacgttaccaccaatattttctaaggtagttgtagctcttgtacctcggttttctaatggcgtcatcaggtgggtcgttgtgg

SEQ ID NO: 1411 - DNA, 745 bp, Secale cereale
gcaagccacactctccagcaccagcaggccggcggcaagcagcgcacacagcaaccaaatggccaccatcagcgccgccgcggcgaccaccgtcgtcgcccgtgccgccatcgccaggccgcaggctctaggtctgccccagctgaggacgaggagcgagagggtgaggtgcagctactccaaggacgccaaggaggcgacccctgccgccgccgtccgcggcgcaggcgcgtccctgctcgccgcggcgggcgccgtgaccgcgtccgctgggccggcgctggcgctggtcgacgagcggatgtcgacggagggcaccggactgagcctggggctgagcaacaacctgctggggtggatcctcctgggcgtcttcggcctcatctggtcgctctacaccgtctacacctccggcctcgacgaggatgaggagtccggcggcctctcgctctaagctatacagtcttctcgtcgtctcatgtaatccgcccgcgagcatcgccatgcatgatcggtgtaatgtaattccagagatggatatttgtatctaagcgtttccattctgagagatgtttcgccgtcagatggtttgcttgccacgccttggagactctgcgtctcgcgacttgcatgaataaaacatccaaggaaaatttcacgcacccacagacagataggtccaagttctcagtaaaattgctgatctgtgatggtatgtggcattttggccatatagctcttctga

SEQ ID NO: 1412 - DNA, 1753 bp, Secale cereale
accagcacacgctagccaagcaagacccgagcaagccacactctccagcaccagcaggccggcggcaagcagcgcagcacagcaaccaaatggccaccatcagcgccgccgcggcgaccaccgtcgtcgcccgtgccgcgatcaccaggccgcaggctctaggtctgccccagctgaggacgaggagcgagagggtgaggtgcagctactccaaggacgccaaggaggtgacccctgccgccgccgtccgcggggctggcgcgtccctgctcgccgcggcgggcgcggtgaccgcgtccgcggggccggcgctggcgctggtcgacgagcggatgtcgacggagggcaccgggctgagcctggggctgagcaacaacctgctggggtggatcctcctgggcgtcttcggcctcatctggtcgctctacaccgtctacacctccggcctcgacgaggacgaggagtccggcggcctctcgctctaagctatacagtcttctcgtcgtctcatgtaatccgcccgcgagcatcgccatgcatgatcggtgtaatgtaattccagagatggatatttgtatgatatctaagcgtttccattctgagagatgtttcgccgtcagatggtttgcttgtccccatgggagactctgcgtctcgcgacttggatgaataaaaaatccaaggaaaatttcacgcacgcacagataggtccaagttctcagtaaaattgctgatctgtgatggtatgtggcattttggccatatagctcttttgcttctagtgtacataactttacatcagctatttgatcaaaaccatataactgaacatatatcagatcgctgcaacagaacatatattttttgatctacaacaaaaacggttaacgattgttgattctcaaggtgctccaagttaggtggaaaagctggtgcctactctaatggtcagttggtactatcttcaatatgattgtcctgagacgcaatctcttcagcagtaacttctatctgttcagagatgcttaaggtgacctcggaaaaaatttcagtgtttccttcggacgagccaccagtagcatcagtaacttctattggctcagaatcgccagttaccacaatattttcaaggtgttgagctcttgacctggttttcaatggctcatcaggtgggcttgtggctggatgagatatcaatattacagaacttgattgaatctgtacactagattggtccacataagattcatcggggtgctcatgacttctagaattctgcgtgttatcctcttcgtcatggtacgatatgccaagtttctgtgcatgactcaatcctggacaaactcccttgatgtaacctcttgttgtgaacaaaacattggacaatgatttttgactggaaacagtccgtctttcatcaaactgagcacagttagcactttgctgtatactggaaccatcaccactgccgtagccacggtcatctaccaaggctatttcgggagtagcaggtaacaaatggccttctgtgctgaatatgtatttatatggcccattttcaacaatgttatcagggcctacagctaaatcaaaaagaagccagagatattttaccgtttctgcaaggaaaaaactctccatgtggtcatcctgcttgtgggtttccacatctgaaatgtggcagtagccgcaaggacatttagcagcatattgaaggcttgctagtatatcccttccaacatcaaggtaccta

SEQ ID NO: 1413 - DNA, 735 bp, Secale cereale
accagcacacgctagccaagcaagacccgagcaagccacactctccagcaccagcaggccggcggcaagcagcgcagcacagcaaccaaatggccaccatcagcgccgccgcggcgaccaccgtcgtcgcccgtgccgcgatcaccaggccgcaggctctaggtctgccccagctgaggacgaggagcgagagggtgaggtgcagctactccaaggacgccaaggaggtgacccctgccgccgccgtccgcggggctggcgcgtccctgctcgccgcggcgggcgcggtgaccgcgtccgcggggccggcgctggcgctggtcgacgagcggatgtcgacggagggcaccgggctgagcctggggctgagcaacaacctgctggggtggatcctcctgggcgtcttcggcctcatctggtcgctctacaccgtctacacctccggcctcgacgaggacgaggagtccggcggcctctcgctctaagctatacagtcttctcgtcgtctcatgtaatccgcccgcgagcatcgccatgcatgatcggtgtaatgtaattccagagatggatatttgtatgatatctaagcgtttccattctgagagatgttcgccgtcagatggttgtcgttcgtcccagtggagactctgcgtctcgcgacgttggagtagaaataaaaactaccgaaaggtaaactttacgaacgaaacaaaaaaaaaaactacgaagactacg

SEQ ID NO: 1414 - DNA, 1754 bp, Triticum aestivum
ctcgtgccgaattcggcacgaggagcaagccacactctccagcaccagcaggccggcggcaagcagcgcaagcacagcagcaaatggctaccatcagcgccgccgcggcgaccaccgtcgtcgcccgtgccgccatcgccaggccgcaggccctaggtctgccccagctgaggacgaggagcgagagggtgaggtgcagctactccaaggacgccaaggaggcgaccccggcggccgccgtccgcggggccggcgcgtccctgctcgccgcggcgggcgcggtgaccgcgtccgcggggccggcgctcgctctggtcgacgagcggatgtcgacggagggcaccgggctcagcctggggctgagcaacaacctgctggggtggatcctcctgggcgtcttcggcctcatctggtcgctctacaccgtctacacctccggcctcgacgaggacgaggagtccggcggcctctcgctctaagccatagtcttctcgtcgtctcatgtaatccgctcgcgagcatcgccatgatcggtgtaatgtaattccagagatggatatttgtatctaagcgtttccattctgagagatgtttcgccgtcagatggtttgcatgccccccttggagactctccgtctcgcgacttggatgaataaaacatccaagggaaatttcacgcacgcacagataggtccaagttctcagtaaaattgctgatctgtgatggtatgtgccattttggccatatagttcctttgcttctagtgtacataactttacatcagctatttgatcaaacccatataacagaacatatatcagttcgctgcaacagaatattaactttttgatctacaacaaaatctgttaacgaatgttgattctcaaggtgctccaagttaggtggaaaaactggtgcctactctaatggtcagctggtactatcttcaatatgatcgtcctgagatgcaatctcttcagcagtaacttctatctgttcagagatgcttaaggtgacctcggaaaaaaattcagtgtttccttcggacgagccaccagtagcatcagtaacttctattggctcagaatcgccagttaccacaatattttcaaggtgctgagctcttgacctggttttcaaaggctcatcaggtgggcttgtggctggatgagagatcaatattacagaacttgattgaatctggacactggattggtccacataagattcatcggggtgctcatgacttctagaattctgcgtgttatcctgttcgtcatggtatgatatgccaagtttctgtgcatgactcaatcctggacaaactcccttgatgtaacctcttgttgtgaacaaaacattggacaatgaattttgactggaaacagtccgtctttcatcaaactgggcacagttagcactttgctgtatactggaaccatcaccactgctgtagccacggtctccaaaataaagacaatgctcatctaccaaggttatttcgggagtagcaggtaacaaatggccttctgtgctgaatatgtatttatatggcccattttcaacaatgttatcagggcctacagctaaatcaaaaagaagccagagatattttaccgtttctgcaaggaaaaaactctccatgtggtcatcctgcttgtgggtttccacatctgaaatgtggcagtagccgcaaggacatttagcagcatattgaaggcttgctagtatatcccttccaacatcaaggtac

SEQ ID NO: 1415 - DNA, 575 bp, Leymus cinereus x Leymus triticoides
  misc_feature (287)..(287): n is a, c, g, or t
  misc_feature (289)..(289): n is a, c, g, or t
  misc_feature (467)..(467): n is a, c, g, or t
  misc_feature (477)..(477): n is a, c, g, or t
  misc_feature (481)..(481): n is a, c, g, or t
gcacgaggagcaagacacactcaccagcaccagcagaggccggcggcaagcagcacaagcacaacaaccaaatggccaccatcagcgccgccgcggcgaccaccgtcgtcgcccgtgccgccatcaccaggccgcaggctctaggtctgccccagctgaggacgaggagcgagagggtgaggtgcagctactccaagggcgccaaggaggcgaccccggccgccgccgccgtccgcggcgcgggcgcgtccctgctcgccgcggcgggcgcggtgaccgcgtccgcngngccggcgctggcgctggtcgacgagcggatgtcgaccgagggcaccgggctgagcttggggctgagcaacaacctgctggggtggatcctcctgggcgtcttcggcctcatctggtcgctctacaccgtctacacctccggcctcgacgaggacgaggagtccggcggcctctcgctntaagctaccnagtnttctcgtcgtctcatgtaatccgctcgcgagcatcgccatgatcggtgtaatgtaattccagagatggatatttgtatttaagtgtttccattc

SEQ ID NO: 1416 - DNA, 985 bp, Avena sativa
agcaaggcacacacactctcccgctagcagcaccagcagcacagcacagcaacgatggccaccatcagcgccgccgcggcgaccaccgtcgttgcccgtgccgtggtcaccaggccgcaggctctaggtctgccccagctgaggacgaggagccagagggtgaggtgcagctactccaaggacgccaaggaggcgaccccggccgccgccgccgtccgtggcgcaggcgcttccctgctcgccgcagcgaccgccgtgaccgtgtccgccgccccggccttggcgctcgtcgacgagcggatgtcgacggagggcaccgggctgagcctcggcctgagcaacaacctgctggggtggatcctcctgggcgtcttcgggctcatctggtcactctacaccgtctacacctccggcctcgacgaggacgaggagtcaggcggcctctcgctctaagtctcctctttgaccccgtgtaatctgtgtaagcacggcgatggacggtgtaatgtaattccagttccagacatggatatttgtatctaagtgtttccattctgagagatgtttagcggtcagaagaaatgctttgcctcccatgatattgtgcgtctagcagcttgaataaaaaaaatcgaggaacatttcagacacagatcttcacagatttcagtagggctgctgacgatctgtaatgtgcactgcacctatttggccatatagttcattgtttgcctctagtgtatacaactttacatctgctatttgatcagaactatatatagttacaaaaacaaatctaatcggtacaacagaataaaattaacaaatgttgattcccaagttcatttgccataggaaattcagttagattgtttctggtggtaaatactgcttctgggcccagctcatagcacgactcaaagaatgcccccatctcaaccactgattccagctcattaaccactgactcaacactgcttgcttc

SEQ ID NO: 1417 - DNA, 727 bp, Avena sativa
cacactctcccgctagcagcaccagcagcacagcacagcaacgatggccaccatcagcgccgccgcggcgaccaccgtcgttgcccgtgccgtggtcaccaggccgcaggctctaggtctgccccagctgaggacgaggagccagagggtgaggtgcagctactccaaggacgccaaggaggcgaccccggccgccgccgccgtccgtggcgcaggcgcttccctgctcgccgcagcgaccgccgtgaccgtgtccgcggccccggccttggcgctcgtcgacgagcggatgtcgacggagggcaccgggctcagcctcggcctgagcaacaacctgttggggtggatcctcctgggcgtcttcgggctcatctggtcactctacaccgtctacacctccggcctcgacgaggacgaggaatcaggcggcctctcgctctaagtcttctctttgatcccgtgtaatctccgcgcgtgtaagcatggagttggtcggtgtaatgtaattccagttccagacatggatatttgtatctaagtgtttccattctgagagatgtttagcgatcagaagaaatgcttttcctcccttgatattgtgcgtctagcagcttgaataagaaaaaaattgaggaacatttcagacacagatcttcacagatttcagtagggctgctgacgatatgtaatatgcaccgcacctatttggccatatagttcattgttt

SEQ ID NO: 1418 - DNA, 694 bp, Pseudoroegneria spicata
ggaccagcacacgctagccaagcaagacccgagcaagccacactctccagcaccagcaggccggcggcaagcagcgcaagcacaacagcaaatggccaccatcagcgccgccgcggcgaccaccgtcgtcgcccgtgccgcgatcgccaggccgcaggccctaggtctgcctcagctgaggacgaggagcgagagggtgaggtgcagctactccaagggcgccaaggaggcgacccctgccgccgccgtccgcggcgcgggcgcgtccctgcttgccgcggcgggcgcggtgaccgcgtccgcggggccggcactggcgctggtcgacgagcggatgtcgacggagggcaccgggctgagcctggggctgagcaacaacctgctggggtggatcctcctgggcgtcttcggcctcatctggtcgctctacaccgtctacacctccggcctcgacgaggacgaggagtccggcggcctctcgctctaagctacacatagtttcctcctcgtctcatgtaatccgcccacgagcatcgccatgatcggtgtaatgtaattccagagatgtatatttgtatctaagcgtttccattctgagagatgtttcgccgtcagatggtttggttgccccgcttggagactgcgtctcgcgaattggatgaataaaacaatcaaggaaaatttcacgcacgca

SEQ ID NO: 1419 - DNA, 1574 bp, Triticum aestivum
gaaacaccctgcggaccagcacacgctagccaagcaagacccgagcaagccacactctccagcaccagcagaggccggcggcaaagcagcgcagcacagcaacaaatggccaccatcagcgccgccgcggcgaccaccgtcgtcgcccgtgccgcgatcgccaggccacaggccctaggtctgccccagctgaggacgaggagcgagagggtgaggtgcagctactccaaggacgccaaggaggcgacccctgccgccaccgtccgcggggccagcgcgtccctgctcgccgcggcgggcgcggtgaccgcgtccgcggggccggcgctcgctctggtcgacgagcggatgtcgacggagggcaccgggctgagcctggggctgagcaacaacctgctggggtggatcctcctgggcgtcttcggcctcatctggtcgctctacaccgtctacacctccggcctcgacgaggacgaggagtccggcggcctctccctctaagctacacatagtttctcccgtcgtctcatgtaatccgctcgcgagcatcgccatgatcggtgtaatgtaattccagagatggatatttgtatctaagcgtttccattctgagagatgtttcgcggtcagatggattgcttgccccgccttgaagaccgtgcgtcccgcgatttgaatgaataaaacatccaaggaaaatttcacgcacgcacagataggtccaagttctcagtaaaattgctgatctgtgatggtatgtggcattttggccatatagttcctttgcttctagtgtacataactttacatcagcttttgatcaaaaccatataacagtacatatatcggatcgctgcaacagaatatactttttttgatctacaacaaaatctgttaacgaatgttgattctcaaggtgctccaagttaggtggaaaaactggcgcctactctaatggtcagctggtactatcttcaatatgattgtcctgagacgcaatctcttcagcagtaacttctatctgttcagagatgcttaaggtgacctcggaaaaaaattcagtgtttccttcggacgagccaccagtagcatcagtaacttctattggctcagaatcgccagttaccacaatattttcaaggtgttgagctcttgacctggttttcgaaggctcatcaggtgggcttgtggctggatgagagatcaatattacagaacttgattgaatctggacactggattggtccacataagattcatcggggtgctcatgacttctagaattctgcgtgttatcctcttcggcatggtacgatatgccaagtttctgtgcatgactcaatcctggacaaactcccttgatgtaacctcttgttgtgaacaaaacattggacaatgaattttgactggaaacagtccgtctttcatcaaactgggcacagttagcactttgctgtatactggaaccatcaccactgtcgtagccacggtctccaaaatgaaggcaatgctcatctaccaaggttatttcgggagtagcaggtaacaaatggccttctgtgctgaatatgtat

SEQ ID NO: 1420 - DNA, 569 bp, Triticum aestivum
acactctccagcaccagcaggccggcggcaagcagcgcaagcacagcagcaaatggctaccatcagcgccgccgcggcgaccaccgtcgtcgcccgtgccgccatcgccaggccgcaggccctaggtctgccccagctgaggacgaggagcgagagggtgaggtgcaactactccaaggacgccaaggaggcgaccccggcggccgccgtccgcggggccggcgcgtccctgctcgccgcggcgggcgcggtgaccgcgtccgcggggccggcgctcgctctggtcgacgagcggatgtcgacggagggcaccgggctcagcctggggctgagcaacaacctgctggggtggatcctcctgggcgtcttcggcctcatctggtcgctctacaccgtctacacctccggcctcgacgaggacgaggagtccggcggcctctcgctctaagccatagtcttctcgtcgtctcatgtaatccgctcgcgagcatcgccatgatcggtgtaatgtaattccagagatggatatttgtatctaagcgtttccattctgagagatgtttcgccgt

SEQ ID NO: 1421 - DNA, 619 bp, Triticum aestivum
gccttattaaggaaacaccctgcggaccagcacacgctagccaagcaagacccgagcaagccacactctccagcaccagcaggccggcggcaagcagcgcaagcacagcagcaaatggctaccatcagcgccaccgcggggaccaccgtcgtcgcccgtgccgccatcgccaggccgcaggccctaggtctgccccagctgaggacgaggagcgagagggtgaggtgcaactactccaaggacgccaaggaggcgaccccggcggccgccgtccgcggggccggcgcgtccctgctcgccgcggcgggcgcggtgaccgcgtccgcggggccggcgctcgctctggtcgacgagcggatgtcaacggagggcaccgggctcagcctggggctgagcaacaacctgctggggtggatcctcctgggcgtcttcggcctcatctggtcgctctacaccgtctacacctccggcctcgacgaggacgaggagtccggcggcctctcgctctaagccatagtcttctcgtcgtctcatgtaatccgctcgcgagcatcgccatgatcggtgtaatgtaaattccagagatggatatttgtatctaagcgtttccattctgaga

SEQ ID NO: 1422 - DNA, 1151 bp, Setaria italica
acgatttgcagccacatcggctcgcgataatttcgtgtatatcgccttaaaaggaaaaggccgccaactagcgcacgcgagccacgaacacaccaaacttctccagcaagcggccagcgagagatccggatacgcagcagccatggccaccatcagcgccgccgtggcgaccaccgtcgttgcccgcgccgcgatcgccaggcccaacgctctcgggctgccccagctgagggcgaggagcgagagggtgcggtgcggctactccaaggacggcaggaacgcggccgccgtgagcgccaagggcgcgggcgcgtcgctgctggcggcggcgggcgcggtgaccgcgtcggcggggccggcgctggcgctcgtggacgagaggatgtcgacggagggcaccgggctgagcctggggctcagcaacaacctgctggggtggatcctcctgggggtcttcggcctcatctggtcgctctacaccgtctacacctcggacctcgacgaggacgaggagtccggcggcctctcgctctagatcgtatcccgtcccctcccgttgttgttgatccggatgtaaacatggcggtggtcatcggtgtaaactcgggcatggctatttgtatctaagcttcaacttttgcgagatgttagcggtcgagtgaagtgatccgtggagattacgcgcatatagcaaacttcacgagaaacgttctgcataaatttgagctttcagtagagctcttgctgtttagaggcgacaaagccctttaagctcctgatcagcctgggacaaacattcatctccctccctctccacgctcaacttcgtccacacaaatacacaatggcacaactcgcttcctccacggtggcgccaccattcccacagcccacaccgccacagaccccagtcctccaccgtggccgaaaatgtacaaccacatgacttatgttaattactcacgtcattaattctacagtccatgtcccccacacttacataacagcttgttagcttcagctcctcgatttttggagtctaaaatttgtaaggaagtggtttaaacctctacaccaagtgcagctccaagaccatagaggcgtagctccaagaaagaaatggtttctatgtcattaatcagggcgcatgt

SEQ ID NO: 1423 - DNA, 1442 bp, Panicum virgatum
cttggtatgtcaaattgaacagcaccagtactttgactcatactcccgctgaaggatatgaatatagcaactgtggagttcaaacactttggccaatctccaaatccaaaaacaacccgccagccggccccaagttctgctaacatctccctgattaaaattaaagttcctaaccagcagggaccacccgacacgacgggtccagttggctcatgccgattggccgcgagcggataggccatgggtgtgcaaggatagccaagcccgtgcctcacccaatcccagcggcggccggcgatttgcagccacatcggctcgcgataatttcgtgtataccgccttaaaaggaaaacgccggcgactagcgcacgcgagccacgatccaccaccgcacactctccagcacccggcggagcaagcggccagcgagagatccagaggcagcagcaatggccaccgtcagcgccgccgcggcgaccaccgtcgttgcccgcgccgccctagggctgccgcagctgagggcgaggagcgagagggtgcggtgcggctactcgagggacgccaggagcgcggcggccgccgtgagcgcgaggggcgccggcgcgtcgctgctggccgcggcaggcgcggtgaccgcgtcggcggggccggcgctggcgctcgtggacgagaggatgtcgacggagggcaccgggctgagcctggggctcagcaacaacctgctggggtggatcctcctgggggtcttcggcctcatctggtcgctctacaccgtctacacctccgacctcgacgaggacgaggagtccggcggcctctcgctctagataatatcatgtccgtcctctgctcctgttactaccgatccggatgtaaacatggcggtggtcatcggtgtaatgtcagacttggctatttaatttgtatctaagcttcgcttttgcgttggatcatgaagtgatgatatgttgatccgtggagattacgcgtgtactgcaacttcgcgagagaaaaaatccctatagtgttctgcgtaagtttgagctttcagtagagctcttgctgtttagaggcgaagaatctctttgcaagctcctgatcaacctgggccaaacattcatctccctctccctctacggccacgctcttcttcgtcgacgcaatgacacaacccacttcctccacggtggcgcctcattcccactggccagtacaccgccgtggcctacaccaagtcttcagtacatgtcctccacacatattaacagcatgctaacttcagctcctcgatttctagtctaaaaccaaggaaagcggcatctacttttctatttatagtgtttatatgacatagcaagtgtatgaaactaactggcagtgctcggttggaattgctgtaataatctgttcttcaataaagcccatcatgtatgcactttctg

SEQ ID NO: 1424 - DNA, 570 bp, Eragrostis curvula
  misc_feature (215)..(215): n is a, c, g, or t
  misc_feature (273)..(273): n is a, c, g, or t
  misc_feature (280)..(280): n is a, c, g, or t
  misc_feature (382)..(382): n is a, c, g, or t
  misc_feature (436)..(436): n is a, c, g, or t
  misc_feature (457)..(457): n is a, c, g, or t
  misc_feature (462)..(462): n is a, c, g, or t
  misc_feature (483)..(484): n is a, c, g, or t
  misc_feature (490)..(490): n is a, c, g, or t
  misc_feature (537)..(537): n is a, c, g, or t
  misc_feature (554)..(554): n is a, c, g, or t
gggagtaagacaccaccactctcgagcaccagcaggaccaatgcagccagcaagagacccagccccagcagcagccatggccaccgttagcgccgccacggcgaccaccgtcgtcgctcgcgccactctagggctgcctccgctgagggcgaggagcgacagggtgcggtgcagctactccaaggacgccaagagcgcggccccggcggtgagcntcaagggcgccggcgcgtcgctgctcgcggcggcgggcgcggtgaccgcgtccgcggngcccgcnctggcgctggtcgacgagcggatgtcgacggagggcaccgggctgagcctggggctgagcaacaacctgctggggtggatcctcctgggggtcttcggcctnatctggtcgctctacaccgtctacacctccgacctcgacgaggacgaggagtcnggcggcctctcgctctagatngatcncccggcgctccgatcctgtcnntgatcntctgggactggatgtaaccagggtggtgattggtgtaatttcagacntggctatttgtatctanttaagttttattacta

SEQ ID NO: 1425 - DNA, 1542 bp, Sorghum bicolor
atatcttaagaaaaacaaaggttggtacaaaaaatagacaataagatacaaaatgacctctaaagaataagaggacattaaagaccaaattggttgtcttcttcctttgaacctttactgtctctcgaaacttgaagattgcactgacaagacaaccaagaaaaaggacacctgcaaacaccctaactggacaagactttgaagatcacaaaagtcactcgccgctcataagcacaccaaatactaagatctgaagcatatctgataggttaaactctcaatggccctttgccgacgttagatcaaatgccgttgaggtagggagagagagacattattccaaagtaccatcattgccactacaacagattattgctgatgtggaaatctaaagccaacgtctagagtggagtgttggggacagtctaagttgcagttgttatagttaactgcaaaagcttcatatacttagagaaagacatttcttttgtgagagagaaaagagaatgtgatcctttgcaagaaaagaaaagaaaagagaagggagagagaggggaataaaagtgaccgttaaaggagaaaggcactgtagaggccaccagaaataaacttatctacttgagccattttatttgtactgaaaccaacattgctggtgcctggtgcccagccagcagtcaccaggccacctggctaccctgaattccacgtccagaactccagatggccatcgacggggtccagctggctcaacccgattgggtgcgagtggataggccgcgggtgcaaaaggatagccaatcccgtgcctcacccaatcctagcggcggcagacgatttgcagccacagcggttcgtgataatctctttcgtattcgccttttttaaaaaggaaacgccgccaactggcgcacgggagccacagagcaaaagcaccacactccactatccagcaaaagagatccagaggcagcagtcatggccaccgtcagcgccgccgcggcgaccaccgtcgttgcccgcgccgcgatcgccaggcccaacgctctagggctgccccagctgagggcgaggagcgagagggtgcggtgcagctacgccaaggacgcggccgccgtcagcgccaaggccgctggcgcgtcgctgctcgccgccgcgggcgcggtgaccgcgtcggcggggcccgcgctggcgctcgtggacgagcggatgtccacggagggcaccgggctcagccttgggctcagcaacaacctgctggggtggatcctcctgggggtcttcggcctcatctggtccctctacaccgtctacacctccgacctcgacgaggacgaggagtccggcctctcgctctagatccatccatccatccatccaccctctcctgctgttaaaggatctgcatgtaaacatggtggtggcggccaccggtgtaatttcagacatggctatttgtatctaagcttcacttttgcgagatgttagcagctggattataagtaataatattttgatccggccgtggagattacgcacgca

SEQ ID NO: 1426 - DNA, 750 bp, Pennisetum glaucum
gcgataatttcgtgtatatcgccttaaaagcaaaaggccgccagatagcgcacgcgagccacaaacacagcaaacttctccagcaagcggcccgagcgagagatcctgacgcagcagccatggccaccgtcagcgccgccgcggcgaccaccgtcgttgcccgcgccgcgatcgccaggcccaacgctctcggcgggctgccccagctgagggcgaggagcgagagggtgcggtgcggctactccaaggacggcaggaacagcgcggccgccgtgagcgccaagggcgcgggcgcgtcgctgctggcggcggcgggcgcggtgaccgcgtcggcggggccggcgctggcgctcgtggacgagaggatgtcgacggagggcaccgggctgagcctggggctcagcaacaacctgctggggtggatcctcctgggagtcttcggcctcatctggtcgctctacaccgtctacacctcggacctcgacgaggacgaggagtctggcctctcgctctagatcgtatcctgcccgccccctctcctgttgtacgttgttgatccggatatatatatatgtaaacatatggcggtggtcttcggtgtaatctcggacatggctatttgtatctaagcttcaacttttgcgagatgttagcggtgggggtgacaagtgatatatgttgatccgtcgcgcatatatctgcgtaacttgagctatcagtaaacccctttatgctcctggtcaacatgcg

SEQ ID NO: 1427 - DNA, 616 bp, Zea mays
tttcgtgtattcgccttttttaaaaggaatcgccaccgactggcgcacgggagccacggagagcaaaggcagcacactcagctatccagcaaaagagatcgagacgcaggagtcatggccaccgtcagcgccgccgtggtgaccaccatcgttgcccgcgccgcgatcgccaggcccaatgctctagggctgcctgcgctgagggcgaggagcgagagggtgcggtgcagctacgccaaggacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaacctgctggggtggatcctcctgggggtcttcggcctcatctggtccctctacaccatctacacctctgacctcgacgaggacgaggagtccggtggcctctcgctctagatccaccctctcctgttaatgatctgaatgtaaacatggtggtggtcatcggtgtaaatttagacatggctatttgcatctaagatccatcctctcctgttaataatgtttggagact

SEQ ID NO: 1428 - DNA, 605 bp, Saccharum officinarum
cacgagacactccactatccagcaaaagagatccagaggcagcagtcatggcccccgtcagcgccgccgcggcgaccaccgtcgttgcccgcgccgcgatcgcgaggcccaacgctctagggctgcctcagctgagggcgaggagcgagagggtgcggtgcagctacgccaagaacgcggccgccgtcagcgccaaggccgctggcgcgtcgctgctcgccgccgcgggcgcggtgaccgcgtcggcggggcccgcgctggcgctcgtggacgagcggatgtccacggagggcaccggcctcagcctggggctcagcaacaacctgctggggtggatactcctcggggtcttcggcctcatctggtccctctacaccatctatacctctgacctcgacgaggacgaggagtccggtggcctctcgctctagatcatatcgaccctctcctgctgttaatgatctgcatgtaaacatggtggtggtcaccggccggtgtaatttcagacatggctatttgtatctaagcttcacttttgcgagatgttagcggttggatgaagtaattaataatattttgatccggccgtggagattacgcacgca

SEQ ID NO: 1429 - DNA, 660 bp, Cynodon dactylon
cgatccagacaccgccgctctcgagcaccaccagcagctagcaagagatccagaggcaggcaggcagcagcagcagcaatggccaccctcagcaccgccgtcgtcgcccgcgccgcgatcgccaagccaaacggtctgcctcagctgaaggcgaggagcgataggatgcggtgcagctactccaaggacgccaagagcgcggccccggtcagcatcaagagcgccggcgcgtcgctgctcgcagcggcgggcgcggtgaccgcgtccgcggcgccagcgctggcgctggtcgacgagaggatgtccacggagggaaccgggctgagcctggggctgagcaacaacctgctcgggtggatcctgctgggagtcttcggcctcatctggtcgctctacaccgtctacacctccgacctcgacgaggacgaggagtccggtggcctgtctctgtagatcgatcccgtcctgtcattgatcaatcttgatgtaaacagggtggtgattggcgtgtaatttcagacatggctatttgtatctaagttttacttcttcgggatgttgttagcggtcggacgcaataatattttggatcctcaagaggctcctatggataaagcaagaactcactagaagatcaatttactgcataaatttgcactt

SEQ ID NO: 1430 - DNA, 1921 bp, Secale cereale
tcagcctccacgcagccgcgcgcgctcggcggccccgtctcgtccgatccccgcgacccccgcgtcccgcaatggcggccgccggcgagtcggccggcgagctgctgcgccgcgcggcggcgctggtccccgcggagcactacgcgctcgcggccctcgtcgccgtctccgtcctcgcgtaccggttcctggagctccacgtcgtcggggacctcctccgcggcctccgcggccgccgcgtcgagctcaccttccacccggcctccgagatctaccactgcgtcgcctccaagtgccgctccctccacggcaggtacctggcgacgccttggcttgcgagcccgcatttgcagacattgttcctgggaatccatgggagaccgccgtccttcacctacaagaggcaactgtacacagttcgtgatggtggaaccattgctttggattggctgctggcctttgatttggaggatgcagatgggatcatttcaaacgattcttcaacaccccttttagttgtcgtccctggattaaccagtgattctgatgctgcttatgcaaaacacttggttcatgccatggcgagaaaagggtggaatgttgttgtaagtaaccacaggggtcttggtggtgtgtccatcacatcagattgcctctacaatggtggatggacagaagatgtccgagaagttattaattatctccatcgcaagtatccaaaggctccgatgttctgtgttggtacaagcataggtgccaatatcctggtcaagtaccttggagaagaaggtgagagtactcccgtggctggtgctgcatctatttgttctccatgggatctggtggtatgtgacagatttattgcccgtaagcttgtgcagcggttttatgacaaagcgcttgcatttggtctaaagggctatgcaaagctacatcaacctgtcttggcccgccttgcaaattgggagggtattaaacagtcacgctctatccgggagtttgaccaccatgccacttgcattgttgcaaaatatgagaccgtggatacctactaccgccggtgcagcagtgctagttttgttggtaatgtgtcagttcccttgctttgtataagtgctttggatgaccccctttgcacaagagaggcaattccttgggatgaatgcagagcgaacaagaacattgttttggcaactactcaggatggtggccatcttgcattttttcaaggactaactgctggaaaactatggtgggttggagctgtgtctgagttcctctgtgctctgcatgacagctcgtacatgcatcgacaaaaggcggaagaacatgttctgcattcttcactggagtcgtccattgacaagagcccgtacgtcaacatccttggagacgggatgatagctccggtcagaaacgatggccccccttctagccagatcaccgacgacctgaagccgaatgccacggtgaacagcacgcaagaagatgaacaagccaaggaagtggagaacaaaagcggcacggatgtggatgcagtacccgttcaaagcccggcagctgcagggtccgcaaagctgcaaggggaggaacgctacgctgataagatccgcgacgccatcgctccggtcaagagatccttaagcaagctcacccggtaccaagggaggtcagtctggctgctggcgtacgttgccttggtgacatcgtggccgctgcttggctccctggctttcatgctcttcaggaaaaagtcgaggaatcctctgtccgctaagtaatcatggggcagataagtaaactgtgcccatagtatttacttactccgtttgcatcatggtctgtatgtacgccttggtgcagcggtgggaataataacagtgtcatacgtgcacctaccttcagctatacgtgttgaggc

SEQ ID NO: 1431 - DNA, 2144 bp, Hordeum vulgare
ggggacccgcgaggaaggagcgcggtttgcctaaaagcgatcacacgcgacgtctctctcgtcctccgccttggctcggacggctcgcgaggctagccatctccgtccatcgcgtgcgtgggtcgccgcctccgccgctcaaacaaccttcatatacactaccaccgctcccactctcgctccatccctccctccctccctcgctccggcctccacggcgcagccgcggcctcgtctcgtctcgtccgatccccgcaatggcggccgcggccagcggcgagtcggccggcgagctgctgctccgcgcggcggcgctggtccccgcggagcactacgcgctcgcggccctcgtcgccgtctcggtcctcgcgtaccggttcgtggagctccacgccatcggcgacctcctccgcggcctccgcggccgccgcgtcgagctcaccttccacccggcctccgagatctaccaccgggtcgcctccaagtgccgctccctccacggcaggtacctggccacgccttggcttgcgagtccgcatttgcagacattgttcctgggaatccatgggagaccgccgtccttcacctacaagaggcaactgtacacagttcgtgatggtggaaccattgctttggattggctgctggcctttgatttggaggatgcagatgggattatttcaaaagattcttcaacaccccttttagttgtcgtccctggattaaccagtgattctgatgctgcttatgcaaaacacttggttcattccatggcgagaaaagggtggaatgttgttgtaagtaaccacaggggtcttggtggtgtatccattacatcagattgcctctacaatgctggatggacagaagatgtccgagaaactattaattatctccattgcaagtatccaaaggctccgatgttctgtgttggtacaagcataggtgccaatattgtggtcaagtatcttggagaagaaggtaagagtactcctgtggctggtgctgcatcaatttgttctccatgggatctggtggtaggtgacagatttatttcccgtaagcttgtgcaacggttatatgacaaagcccttgcgtttggtctaaagggctatgcaaagctgcatcaacctatcttggctcgccttgcaaactgggagggtattaataagtcacgctctattcgggagtttgaccaccatgccacttgcattgttgcaaaatatgagactgtggatacctactaccgccggtgcagcagcgctagttttgttggtaatgtgtcagttcccttgctttgtgtaaatgctttggatgaccccgtttgcacaagagaggcaattccttgggatgaatgcagagcgaataagaacattgttttggcgactactcagaatggtggccatcttgcattttttcaaggactaactgctggaaaactatggtgggttggagctgtgtctgagttcctctgtgctctgcatgacagctcgtacatgcatcggcaaaaggcggaagatcatgttctacattcttcactggagtcgtccattgacaagagcccgtacgtcagcatccttggagacggaatgatagccccggtcataaacgaaggccccccttccagccagatcaccgatgatctgaaaccaaatgccgtgataaacagcacacaagaagatgaacaagccaaggaagtggagaacaagagcgtcacggatgcagacacagtgcccgctcaaagccctgcagttccagggtccgcaaagcagcaaggcgaggaacgctacgctgataagatccgcgacgccatcgctcccgtcaagagatccttgagcaagctcacccggtaccaggggaggtcagtctggctgctcgcgtatgttgccttggtgacatcgtggccgctgcttggctccctggctttcatggtgttcaggaaaaagtccagaaatcctttgtccgctaagtaatatcgtatggtgttttttcgcaaaaaaaagaagagtgggtaatatcatatggtacagataagtaaactgtgcgcatagtatttacttgctccgtttgcaccatggtctgtatgtacgccttggtgcagagagtcggaataataataaaatcgtacgtgcacgtgttgaggc

SEQ ID NO: 1432 - DNA, 1986 bp, Secale cereale
tgtcgttacgctcgaacaagagagcctctccttctattgtctcttttctgcgcgccccggcgagcaagcgcagagtgcatggagcatattattgcgggcaagtttaagcttgggaggaagattgggagtggctcatttggggagctataccttggtattaatatacagaacggagaggaagtgggaataaagttggaacctgtgaaatcgaaacatccgcagctgcactatgaatccaaagtttacatgctgatgcagggtggaagcggtatcccacatctgaagtggtatggtgttgagggagagtacaatgttatggtgattgatcttcttggcccaagcctggaggacttatttaactcctgcaacaggaaatttactatgaaaacaacccttatgcttgctgatcaactaataacacgggtggaatacatgcattccaaaggatttcttcaccgtgacatcaagccagacaacttccttatgggcttaggccggaaagctaatcaggtctatataattgactatgggcttgctaagaaatacaaggacctccagactcataaacacatcccctacagggagaataaaaatctgacaggaacagcacgctatgctagtgtgaatactcatcttggaatagaacaaagcaggagagatgatctagagtctgttggttatcttctactgtattttttgagaggaagtctcccatggcagggtcttaaagctggcactaagaaacaaaagtatgatagaattagtgaaaagaaaatgcttaccccggcagaggttctgtgcaaatcttatccatcagagttcatctcatatttccactattgtcgttccctgagattcgaagacagaccagattactcttacttgaagaaactatttcgggatgtatttgttcgtgaaggatatcaatttgattatgtatttgactggaccgcactcaagtatcctcatatgagttccagtaacaagcttgttcgacaaccaagtggtagattggctggagttgggccatctgttgagagaacagaaagaccttcagtaggacaagagatccgggatagattcaccggtgctgtggaggcatttgccagaagaaactcgagctccggtcgccatggacacggagaccattcgaggcacaaaagcattgcggattcattcagttcatctagagaagctcttgctgctgatacggagaaaacacacatcttgtcccggactgggagctcatcgaagatggctgccacgccatccagccggccaacctcttcaggggactgcaccggtcggttgttctcgggaagtggcggcagcagcagccgcccatcatcgtcgaccgtccaaaggatccaccaatccggaggcagcggtgcggagaacggctcgtcttcacccgtcgcccggaatgcgccagggagatcaagccgacgggacagccacgcggcactccggagcttcgagcgcctgtcgatcagcgctgacagaaggaagtgatcgacggccctggaggcgatgacaattgccaaggatttaacaccggtcgatctgtgcgctcacaagagttcaggatacatgaacaatgacttgatgacgaatggttaagcagaatggccaggaaagagtggtgtcctggtttccatgcatgcatgttctttcttcaaactccaaatgaggtgtttgtcatataagatcatgggctagaagtaagtaattcttttcaacggcaaattcggcttgatgtgtacccctcttcttccagtataggactttgaatcatagggaagaagaggctgccaaatttatatataatatcgatcttttatgatcatagtttcataagaatcttggtgttctctcaaattttagttgttccactcatttgtgcatgactgagacattttctcatatttttcctgcaatatatagtcgttttgcaatagtatcacattcaagagttgttcaagctta

SEQ ID NO: 1433 - DNA, 1891 bp, Triticum aestivum
tacagaatggagaggaagtgggtataaagttggaacccgtgaagtcgaagcatccacaactgcactatgaatccaaagtttacatgctgatgcagggtggaagcggtatcccacatctgaagtggtatggtgtcgagggagagtacaatgttatggtgattgatcttcttggcccaagcttggaggacttattcaattcctgcaacaggaaatttactatgaaaacaacccttatgcttgctgatcaactaataacacgggtggaatacatgcattccaaaggatttcttcaccgtgacatcaagccagacaacttccttatgggcttaggccggaaagctaatcaggtttatataattgactatgggcttgctaagaaatacaaggacctccagactcataaacacatcccctacagggagaataaaaatctgacaggaacagcacgctatgctagtgtgaatactcatcttggaatagaacaaagcaggagagatgatctagagtctgttggttatcttctactgtattttttgagaggaagtctcccatggcagggtcttaaagctggcactaagaaacaaaagtatgatagaattagtgaaaagaaaatgcttaccccggcagaggttctgtgcaaatcttatccatcggagttcatctcatatttccactattgtcgttccctgagattcgaagacagaccagattactcttacttgaagaaactatttcgggatgtatttgttcgtgaaggatatcaatttgattatgtatttgactggaccgcactcaagtatcctcatatgagttccagtaacaagcttgttcgacaaccgagtggaagattggctggagttgggccatctgttgagagaacagaaagaccttcagtaggacaagagatccgggatagattcaccggtgctgtggaggcatttgccagaagaaactcgagctccggtcgccacggacacggagaccattcgaggcacaaaagcactgctgattcattcagttcatctagagaagctcttgctgctgatacggagaaaacacacatcttgtcccggactgggagctcatcgaagatggctggcacgccatccagccggccaacctcttcaggggactgcaccggtcggttgttctcgggaagtggcggcagcagcagccgcccgtcgtcgtcgaccgttcaaaggctccaccaatccggaggcagcggtgcggagaacggctcgtcttcacccatacccgtcgcccggaacgcaccagggagatcaagccgacgggacagccactcggcattccggagcttcgagcgcctgtcgatcagcgctgacagaaggaagtgatcgacgaccctggaggcgatgacaattgccaaggatttaacacccgtcgatctgtgcactcacaagagttcagcagacatgaacaatgacttgacgacgaatggttaagcagaatggccaggaaagagtggtgtcctggttgccatgcatgcatgttctttcttcaaactccaaatgagatgtttgtcatataagatcatgggctagaagtatgtaattcttttcaacggcaaattcggcttgatgtgtacccctcttcttccagtataggattttgaatcatagggaagaagaggctgccaaatatatatattgatcttctatgatcatagtttcataaaaatcttggtgttctctcaaattttagttgttccactcatttgtgcatgactgagacattttctcatattgttcctacaatatatagtcgttttgcaatactatcacattcaagagtttttcaagcttacaaacccaagcgaagagatgtgtactttactccatgaacttgtcctaggtttaccttacaaatccag

(The sequence listing continues in the following parts.)

What is claimed is:

1. A method of increasing leaf number, plot coverage, rosette area, rosette diameter, growth rate of plot coverage, growth rate of rosette diameter, leaf blade area, or early flowering of a plant, comprising;
   (a) transforming plants with a nucleic acid construct comprising a polynucleotide comprising a nucleic acid sequence encoding a polypeptide having at least 95% amino acid sequence identity to the amino acid sequence as set forth in SEQ ID NO: 657, wherein said polynucleotide is operably linked to a heterologous promoter for directing transcription of said polynucleotide in said plants;
   (b) selecting a plant obtained from step (a) transformed with said nucleic acid construct which overexpresses said polypeptide, and exhibits increased leaf number, plot coverage, rosette area, rosette diameter, growth rate of plot coverage, growth rate of rosette diameter, leaf blade area or early flowering as compared to a wild type plant of the same species which is grown under the same growth conditions;
   (c) isolating regenerable portion of said transformed plant selected according to step (b); and
   (d) regenerating transformed plants from said isolated regenerable portion of said selected transformed plant of step (b), wherein the regenerated transformed plants overexpress said polypeptide, and exhibit increased leaf number, plot coverage, rosette area, rosette diameter, growth rate of plot coverage, growth rate of rosette diameter, leaf blade area, or early flowering as compared to a wild type plant of the same species which is grown under the same growth conditions.

2. The method of claim 1, wherein said polypeptide has the amino acid sequence as set forth in SEQ ID NO: 657.

3. The method of claim 1, wherein said nucleic acid sequence encoding said polypeptide has the nucleotide sequence as set forth in SEQ ID NO: 438 or SEQ ID NO: 184.

4. The method of claim 1, wherein said nucleic acid sequence encoding said polypeptide has the nucleotide sequence as set forth in SEQ ID NO: 438.

5. A method of selecting a transformed plant having increased leaf number, plot coverage, rosette area, rosette diameter, growth rate of plot coverage, growth rate of rosette diameter, leaf blade area, or early flowering as compared to a wild type plant of the same species which is grown under the same growth conditions, the method comprising:
   (a) providing plants transformed with a nucleic acid construct comprising a polynucleotide comprising a nucleic acid sequence encoding a polypeptide having at least 95% amino acid sequence identity to the amino acid sequence as set forth in SEQ ID NO: 657, wherein said polynucleotide is operably linked to a heterologous promoter for directing transcription of said polynucleotide in said plants;
   (b) selecting from said transformed plants of step (a) a transformed plant having an increased trait selected from the group consisting of: leaf number, plot coverage, rosette area, rosette diameter, growth rate of plot coverage, growth rate of rosette diameter, leaf blade area and early flowering as compared to a wild type plant of the same species which is grown under the same growth conditions;
   (c) isolating regenerable portion of said transformed plants selected according to step (b) having said increased trait as compared to a wild type plant of the same species which is grown under the same growth conditions; and
   (d) regenerating transformed plants from said isolated regenerable portion of said selected transformed plants of step (c), wherein the regenerated transformed plants overexpress said polypeptide, and exhibit increased leaf number, plot coverage, rosette area, rosette diameter, growth rate of plot coverage, growth rate of rosette diameter, leaf blade area, or early flowering as compared to the wild type plant of the same species which is grown under the same growth conditions.

6. The method of claim 5, wherein said selecting is performed under non-stress conditions.

7. The method of claim 5, wherein said polypeptide has the amino acid sequence as set forth in SEQ ID NO: 657.

8. The method of claim 1, wherein said selecting is for an increased leaf number as compared to a wild type plant of the same species which is grown under the same growth conditions.

9. The method of claim 1, wherein said selecting is for an increased plot coverage, rosette area, rosette diameter, growth rate of plot coverage, growth rate of rosette diameter, leaf blade area, or early flowering as compared to a wild type plant of the same species which is grown under the same growth conditions.

10. The method of claim 5, wherein said selecting is for an increased plot coverage, rosette area, rosette diameter, growth rate of plot coverage, growth rate of rosette diameter, leaf blade area, or early flowering as compared to a wild type plant of the same species which is grown under the same growth conditions.

* * * * *